United States Patent 11,492,637 (RESISTANCE GENES ASSOCIATED WITH DISEASE RESISTANCE IN SOYBEANS) - sequence listing, part 4

SEQ ID NO: 37 - DNA, 480769 bp, Glycine tomentella
atggaatggaaccaaaagaaagaatcccattatgtgtaggcagcatcttccaccaactacagtataaatcgactctaagtccctaataagaacaaaatcttaatctaattcacagtactgtccaattcaacatcaaatttcagtttatataaaaagaaattaatttcacatctatagaataaaaagaaaagaaaaagtaagaagatatgtgcatatcctttaatactatataataataacaataaaagttggtgagtgatatgcatgcatcattaaaaaactaattcgaaggatatatgaagaactacgccactttaatcagttttttttattaataggttctcaagttcaaaccggtggtataatattaaataaaggatatggagttagttttttatagaactagttagatagtcgatgatgaaaaaatcaaaagggctattatttcatgtagtaatgttgacgctcgcatgcattagggtttgggtggcgcaacgtgatagagacgtgcatgatgaccatgaaaatttagtaatataaacggtgattaggtcccttcgaaggaggaaacgaagaagagaatacaagttatatatttattatattaaattacgatttttttttcttttctagattgtgcctttgcctattcttcgccgtgcttcatggatccaccattgcatcatattatattgtacgttatgtatggtgtttatgtatttttggtttttgcttcaaactttcggatttatttgtttatttaataataggtgttagtgatttgtttattgggtgacagtagtagcattaccatatgatatcatagtatataatgtattgggggcatatatagaatagaaaacactgaagtctaagggatcatgattatggcttgggagcaagtctgaatggacccccataatgattaagagagggcagtttttaaatcgtgggttgggtgggcatttccacgattgcccgctgacccgatatgcgtgcatgctttaaggatttaggaatctcttggcttaattgcttaaagggaaattacttttctgaaacattaaaatgaaataggaaagtggagatggggatcaatcttatgcgtaaagtagaagttacaaaatcttatgcgttggtaagtaggcccaagacgtaagccactgacaaagcatgacttcatactgatttcatattcactatatttacaaaagaagaagaaaaaaatattagattagatatataaaaaaatagagaaaattaaataggtatagtattttttttttcaagttttttgtcttaatcaagattttctatgtgctagcattattgtatctacaatttatcatgttagattagtgattaatttgcaacaatttctgtagctgtgcatctaaattaagggtaagactaattaatgatatgaccaattagtggaagaaattaataatatcgtgaaattttaagagtcaaattaatgttgagtataattgtatctccttgcaaagtcagtaattaagaaaattacttttagagttgtgtttctcttatatttctttaacccatttgattataagatgaaaatattataaagattatcaatatgacatattgtgtgtatgtagcttcatattgtagagagtctttacttgaaagtgaactaaagcgagccgtcgcgtaaagacagatataaatattagaatgagagattatatacgagaaaagtaaacacaatgatgatttttagtatatcaaaataatgcacacaaaaaagttataaaaaaatatataactagaaaagatggaaaaacgcataaggaacattatgactatcatttcttataatcacgcacttgatgtaaagttatcatcatgatatgtatattgagtttaaccatttgctaaggtcatgtattgtaatttctattactatttcttttctgtttcgcatgatatatttcttttttcttgtgtggtggtggatatatcactgtatagccacgtgatgtgtatataatgtggaagatgataatgataatgagctaggttggaatgaatgaatgaataataataaatgtgcaatgaatggaaatactgttgcagataagataacatgcagagggcagcaacttttacctttcttgacgttgcagcatgtgagggataacatttggagtccgaggacaccaccccaagacctttgctttcagattccgcaaccaccacagatcatgtcatggtgctccattacggtagaaccacaaactgaaagtgaggacccgcaagtaacttcaaatgcatcttgttaattgtatccctaattgttaacttatgatctaaacccttttccctctctctttttttcttttcttcttactttcttttttctttttccattttctattctaatggttttgattattatttattttgatttttcttccccttttatatttcttttaactgacatggagattatggagaatcacatccccccaaaacagtgtttattcaattagggttttggggtggcagcattacccaaaattgtattcccatgttgggcggggtgggtgaggaattgccatcaactgtattaccaagcacaaaactcaatctaatttgatccactaacccattttccccttttagtctctatttattctcatttatattgtttattatgcttattaaaaaattatactatcgtttattctcaagctacaagtatatatatataccaacataatgagtagttgatatcaatttattttgtgcataattagtgtaagatgttaattattagttagatatgcatcatgtgtgtattactgattaaaatgtacatgatgcacatttcctttactatatttgtactaacaaatttgagcttactaattaaattaataatgcacttttatcagtttatgtaggaaatcagcgtatatcgcaattgttagtcttgtaaagcactgacacccgcgagaaccgtacataaaattagcaaataattcatgcatatgggtgcttttaatattaaaaatataaataaaaatggagaaaaattaatttgattaataaagcactatattttactaataaaatgttaattaaaagtatgtacatttataacctgtagttatccagaaattgttttaatttaatagaaaattatttttgcaaatatcaacattatatctaatgttaattgaatgaagtttagaattgattaaatgaattcatgaaagtaaatgtatttaattaaataattgttaagaaaaaatatttaatcaacatgcaagttcatagggcgtataccaaaaaataaataagacagttatataaaaagaaaatacgtatagaaatcatttcattctcaaaactaatgactcaaattatgaatacaaataaatttaaccattaacaagatagattaagaaaagtacatatttttttctttattttcgttaaataggaaaaaaaatcattaatgataaaaaggatcctaaacagagcatagtaaatgcagcagcataaattaggaccaatatattgaatgaataactagttaataaaaatcattttttaaagcttaaaagacacgtgaggaaggagagtatacattgacattatttcactttcaagatttaggactcaaatatatgatataggggcagattttttttacaagaaataagttttataagacatgagcctgaactgcttttcaaacataaggtttgagtcagagcggggcaaactttatcggaatcctatttaatatttctcttttttagaaaatgagacctttaattgacaatttaaaaataaatgactcatttaaataagaaaaatactttgttcaataaatattatcaaattacattccaaaatcagttaaaacatcctaagggttctaacaagtcatttgaatagaattgctctcttcgcatgtgttaaagaaaaatcatctataacattttcaacatcaacttcttccaaaaaatcgctttcaatagtcattaaagcaagtccatttagtctctcttgtaacatagttgtttgtagatacgacttcaacaatttgagttttgaaaaacttctccctgcagaagcaacagtaataggatagtcaataaaattctataagcaattgttgcatttggaaaacaagtaaaacgctttataaattgtaatatttcaattgctcccaatttttctttaggtaaaagtgcgattttgctgaaagaaattgttggaaatatttttaatataaaacataaattttttattcaaacactatttttacagctccccttggaccccttggttattaaaataggcattaccatctcttctaatttttagtattaaacatatgttgcaataattaatatttgaggtccgttattttttgggaccctatgtagttgagcaccttgaataggtccagaaccggccctgatttgagtttaacttatttatctaatataggtcattttatttacctcatttgatgtcttaaaaaatctagcctaatcctttaaatagttataagtaggctaacagatttaaacttgtatggaatatggactgcattaaatatttaagatgagagttttattattcataataatcatatttggtccaaataagattatttttcataacagatatacgtattttattcccaaaaaaaaacttgtacacaagtcaacaagctttaacctttaaaacaactaactaatatataatttcaaaatttaatgataaaagtctaatacaacaacaataacattaatattaatataggttatattattattcatttaaattggacaatgtattatatataaaatgtttttgaaactaaataaataaaagagtggatgtttgtgtgcagattaatagcctataactaaaacctaacataatatttgtttttctggtcgagaaaacgtctcaacatctttttttgttgttgagctcatcccaatttctttaacaattctgtatgaagattacggactggaccagtttgttatggtttaagaggcccattatatggacaactcttggatggaagtcttcaaaagttatcccaagtaccaaaaaaaccgttgccttaatctatggatcagactcttattttttgtcatttactcgatcattgttttagccttttaggtctttcataggcgagtaagtttatgtataactattgactaatgtttcaaccattttaaatgttcaagcatgaagctataacacatgtcatatttccctaacactttgagttaaatacgaaatgttaaattctataagattataaataaattgaactagtttacaaattatttaaactttttcaatagagcctattctcgtattacctttttatatatgataatcacaaaatttgaatataaaactttatgtaaacttctcaattctctgactactagattaattctaataatattatgaaaaagtctacttcaattagttaaacagtatgtgaattgttgtaaatttcttatatccgagtttcaatttctaggaaccaaaaaatttctaaaaggtttgattctcatgttacctaatggacaaagcgtttttattttaaatcacacgtcatgaaagttatgttggaaaaaaaaaacaaactatgcatgaaaattgagattgaaattgatcgcagcatgaaggatgttgttacccataataagaggcccttggatttcaaacaaacaaatttggaacagaggtatgaaatgatgcacaagaataataatatgagctacattacactgtgaatatgctgctattctgttagttttgcttactcctgaagaggcaagagctgcatgccactgaccaaagagaaaaaggtgcactgaaaaattgtacgtgaagggggagtggctgctgtcccaagaatatacagctccgttacactatactagaatcatatctgaaaactgtttcgttctcctttcttgctgtattttttctatgttggtttagctactgattcctaaatttgaattgggactccaactatgcatattccttaaaaattcaatttcttcactgtgattccaaaattacctaaagcctaaataaagatgctttctcaatctttctttagacattttaattttgatgtattatacactcttttaaaaatttagatatggaatgtatatattatacattttttttcttctgaaaatttaattacaaaatatttaagaatgatttatgaaacatttccaaattaaactttcaataaatatttaatacatttcaaaactaaaattgtgaaagtattttcaatatgttgctgaaggaacattttgaatattctagaaaaagtgttctgagaatttaaatgttttactatatgtaaggatatttttaatttttttttctgttatctgaaataaaatttaaaagaaactaaagactgtgaaactagtaagaagaaatttttttaatctacataaaaatactaagaaatgtataacaactcactcactttattaaatcatttgacccttggttaataaggagagattatgttaaaagtaatgtccagccacttaagaggagatataaaattagcttggtgatcaaagaaagaagtcgtaagttcaaatttctcccactaacattctaaaaaaattaaccattaacatttgaggataaaataaaaatttaaccacttaatagtcaacatcaaaagtccaacactccaacctctgctcaactctctactctacagctgtagagttcgtttagcaaaagtccaacttttgcaatctttggacctggacctctcttccatactcacaaatagaaggctctaattatcacacgattttattaaaaaggaaaaaagaaacaacgtaattcctttccaaaagattctggtcctcacaatactatcatctcttttacttttctaaatgattataagaggggtgataataaacatttcttatttggtggagtaccagataagaggggtgatagtaagattttattctgtttaatatatttacattctcgcaagagtggttcagacttaaaaggatattagagacggggtaaggcgtacgcaactgaaattccagtcatcattacgtggaaactagggaacctctgataacaaacagaatagattcttaacttgtttgaaaggaggaggagcattttatttaaatcagcccgacagaatacggatttcagaggtggagaaatgtttattataagagcatatagtgagaagataaaatactaattttgattcaaaaagtaagcatgcaaccatgattagcttcacaagcacattggccagtttgaggttaaaagtagttaataaaataaaaaaagttttatcccaatagctggatcacaataattcgattcgataaagtttgttgtagttagaattggatcaatttcagatatgctgacaagtgttcctgtttaaacattcttttcttataaaccaactcataagaaagtcagtttaagcagcagctatttatttatttgtctaatgatcttaatttatgtgctaaataatttataatcaaaattataacaaggcaaataataataataactttttcttaaaaaatcatcaaaaccaaacatgagctagatatactacgttttcataaaaacttctcaactcataatgatatttggaaatcattatacgtcttcataaaaacttctcaaatcatatatttcaattcagttaatgttgcatgacagtaggtgaatcaagaaggcatcaaattcgaatgaaaataagaaaccaaacctcattttatttgaatttcattaacaggtcaaccacatgcacgacaaacaaaacaagtctccgactctgtccaaatctaatctatggtatgcaagaagacggatcaaatctaatcactaaccattagtcgggcttatctcactcacttttcagttttcactgccaaaatctgattgaagtcagctgaggtggcactgcactaaattactgtttttgaattcaccacatgaaatcttactattgatacttgcagctcaggcaagctgtggcagtcagttgatctatatttctactcattgtatcatttcaaatacaaactaactcaatgtcaactcacatggcagaatgtagttacaataatgatcaagtagtagaaagattaatcatttttttttgtcttaaccttccgattcatcaggaaaaaaaagattctaattaatctaaagttcaatccggagacaaataaaatctgaccaagaattatttcccatcaaggattaaattcaagtaatacccgaataatttaactttaacttcaacacattaactacttgtgtccaatcacttgtacctaaagattaatcataagtcctaacatatagacaatataccattcagcaaatcctttttacataagaatacaaaattacaaattagtatacaatgagaagaaaagatgcctccgcaaccaccataaatgttatgattatttattgatcactttgcaaaatataaagataaacacaattatttaaggaaatcttatcagtatcaactgcaagcacaatatcacatctgattcgcatgatgcgttcattatttcagaaaggaaaaaaaaaaagattacccctattgcagtatgaaagttagaatacagacagagtagctcaaaggttaaccggaaaacagaaacaaaattctatccagccctcaaagtctctctaaaagacaaggaaggtaagaaacaagtgtaaactctccctagtccttggcaggttttaatggatgaatactgaagttatagtggagggatcattctcatcaactataggacaaattaattacactacatatttctcaagtcatgataaaatttcattttacaagaccacatcaatctcagcttaacaagaaacattaaatcgtacattacttcaaaacatattcagactaatagataaaagagcaaaaacttctaatttcgacactaaattctcattgactatgagtactgcattgattaagtgatcatgcatcgtattcatcattctcccatgttaaagaagcactttagatcaggtaaccggctacttcaattaggcgacaaaatcacacggagaaaaagggaaagaaaacatgccatcaagaaatttcaaccagaaagcaagaataacagtcactaatccccctattgttcatttaccatagataaagtgacataaaccaaaaactcttgtacataaatgcgtttttctatccacatttcaaagccagaacaaagaaaaactacacatacatatacatatacataatacatacatacattcatcttgatccgattacaacacggtcatgtcacggcaagcatttcctcagcttctggattgcagtgtacattttccttcttgaaccaacagcattgatccccatgtccttgagatcctccaaagtcaacatcggaagcaactcgtcatcgacctcatggatctcaaacataggcgcatacctactcagccctaactcgtaaagccaagacctcactccatcgctcttcctccgttcccacgactccgattcaacgccgtcgttttccgaaaccctaaccctaggatcctcgttccgatccacgtgccaataatccactccgttgtcctccaccgaatgcactggactctgttcgtgttcgtgttcgaaatccctaaaaccttcttcgtcaccgttttcgtcgattgtcgctctaggagcccaatttgttctcaatcgcttcgtcgctggtcctcgttttgcttttcctcttcggctgttgctgtttccgaaatcttcgccgccgttcgcgaggttcgtcacggagcgcgccttcgaggttctggaagattccttcggagtccgccagctccatggcggcatgctcgggcggcgcgtgtgcgagtcatggaagtgtgcggaggcgcgttggtcgccgatctcccccaggcgaacacttggacggcgctgccgcttccgagctagcgccagaggagcggcgatctcggcgcttggttgcgacgttgttgccggagccggagctgcagtttcctccgcgacgtccggtgcggaggggattggaggttccggcggcggtggattggtttcgggctcttccgccattgtgcttacagtagttgtggtgatgtgcgcgggataagggagatggagagttttctggtgcggtagggtgcaacggtgcaatcaccttctaaggtttttgcgccgttggatggttatgatgcgggttgttgaaataggtagatggagcctagctagtagattcaggacttcaggacaagtggctcgtttgaatatttgaatggatcgcgcatgccatgtgtaaaagaactgcattggatatccccaaattaactaactttagttaactttactacttaatcatacgtcttaggatgatttctccaagggttgggttagtctttcaattatcttttaaaaaatggagtataattatcattattatttgagtgcctctctaactttttatgtaaataaaaatacaaatataagagagatatctgacaaacttttaatttaatatttcttagctttattatcacgtaataattattgcatttatttacattttcaagcttaaattacaataattatcttatctttctcttatttattgcaatttttctcttttttagatagaattgcttgtgatttagaattacttactcataaaaccatttggcacaaggattcgttaagcaatacatgtcaatcattagtgaataacctctaaagttaacaagtcataaacattatttttgctcagtgataagttatggtcattgagcggaatacttttggaaggctacttgaagaataattaattttcattgagcgaattatacatatctctatatgaattgtgtttatggaagaaacatcaaacataaattatgagaaaaatttgaggtggcaatcattggaaaacattcatataataatcgagagactagttttcaatttgtagttgctatgcctccatcttcatccaagctccatttttctttaaattttgtaattctttcaatttgtagttgcctctcatattaacgagagactagttttcatctttttaaaggatttagtgtattaagtaaattttatgtaatcattttactatctattcaatatttgggttaaatatcaatgtttattctttgtattcaatatttgtttttgatcagtcatccaatcacattattcttatagtttaattgacacaaaaatacttttaaaactaagaaatgaaaatgatgtccaatgaatgttataaataatacttattagtctctttagaacctttgaccatgtaatcaacttatttaacttacacaactttttgaaaatgggattttatctatgataataactcgtatctgtaatttttgaatgaattttacccatactaggtatagttttttttttttataactttacttatataaaaaataatagatataagtctttgagttattccctgcattaaacatatgtaggtaaaagtactttttagattacctatattaacttctatgcataagaaaatatttcataaaaagtatcatcttatgataattttaatcaataatatcttaaaattatcaataaagatacttcttattaatggaagattcactttcaatcactttaaaaatacaaaagggcaattttttaaagacaaagaaccaagttaaaaaaaaaaatataatttagcctatctttatcttatttatcatgttttaactatcctattaactccacatttattttttaactatcctatctcattcccaagaagatgatttctttagaaataaaagatttttttagataaaatattattgaaaataaacgggaatatctttatcaatattatataacatttgaaactcaattttatttataaatcttattagttaatcataaaatcttgaactcatttcagttattcaacacatttatcgtaaaaatcattgcataattatttaataattaatttgaaggtgtttaaagaaatctacatctataattgttaaaaaaaatcaaatattaacaactatgagaattatcggtttatgctttgaaaaaaaaaaaaaaggattatcgttttaaaaaatagataaaatcggaaacacagtaaaagtctgcatggtacttgggtcattctcgttcgtaagcgctaagcaccacacggggtttctttcggggatcactgacgtgtacggtctagattcaaaatcccatagattctccttcgcatcgtatccctataaaatcgcctctccctttctcctgttcccattcttccgtgaccctcgcttatcatttgttcgtttttattttttttataatcaaaattttcactattatcgttactgttgtcatttttgttctctctttcgaaaaattcgatggcttaatcgctcgtcgaatttgaagaaaaccttctgcgattcgcgatctcacggaacagatccgacgcggtgaaacttccgattttagtttttaacactgttgttgcgccctaattctgagattttcgaaggaacgaaattggaaccctaatttaatcacttcgccataaaacttttcccgctattttaggtcccgattcgattctcggttggttttgtttgttggttggttgggtctgctttctatggttttcggatcgttattggattttgagaaattgggaaatttggagaagatggggaaggaggtagaggatgctgaagagggtgagatttcggatactgcttcggtagaagagatttcagaagaggatttcaataagcaagatgttaagttgttaaataataacaataagcccaatggaagtgatgctagggtttgggctgttcatgatctttactcaaagtaccctactatatgtcgcggctatgcgtcgggtttgtataaccttgcttgggcacaggccgtgcagaacaagcctttgaatgatatttttgtgatggaagtggactccgatgccaatgctaacagtaacagcaacaactccaatcgactggcttctgttgctgtgaatcctaaggatgtggtggtggtggatgtggacaaagaggaaggagagttagaggagggtgagattgatgccgatgcggaacctgaaggagaagcagatagtgttgtggctgtttctgattctgagaagcttgatgatgtgaagagggatgtttctaattctgagcagcttggtgtgaggggtgttctagagggtgttaccgttgctaatgtggcagagtaagtggaactgttgttaatggattttgtgttccttttctctgaattgttggcattggagtcacattacaatgtttgtaacattaaattgattttttgtttgttgttgtagatcgttttctcaaacttgcagtaagctgcaaaatgctcttcctgaagtgctcactagacctgctgattctgagagggatgatctcgttcgcatgtcatttaacgctactgaagtggtttattctgtaaagacccttgactgcttttgctgatatcatttttttgtttctactgggatttttgtcatgattgttttatgatttatcgtaggtgttttgctctatggactctttaaaaaaggaacactacaaggataacatattaaggtttttcaaaatctaaagtttttaggtggtagcagtaaattatttcagtttgcaatgccatctatcactaactatgtttccttcactacacacttttcatgtcagattactttcttctgtgaaggatcaacaacaggctcaattattttctccagagcatataaaagaggtgatgtttaatgttgactgaattttggaagtcgttttactattatcctcataatcttcaatttagaaattcaaagatgggatagaatatgaaatgtggttgattcttactacagattcagggcatgatgactgcaattgattctgttggtgctttagtaaatagtgaggctattggcaaggagaaagaattgcagaccattgtacagacgcatgagataaagactcaggaaaatcaagatgtagaagctgctgaattgatttctaatagtaagcctttgcatagtgacataattggggcatcacatgctttaaaatttggacaaaatagtattaaaggtagaggggttctgctcccgctgttagaccttcacaaggatcatgatgctgacagtttaccatcaccaaccagagaagcacctttgtgcttccctgtgaataaattactttctgttggagagcctatggttagatctgggtcagcagctgctaagctggagtcaggaaagatggaacttgatagtgaaggttctaaatttcatctctatgaaactgatgctttaaaagctgtttccacatatcaacagaagtttggtcgaagttccctttttacaaatgataaatttccaagtccaacgccttcaggtgactgtgaggatgagattgttgatacaaacgaggaggtctctagtgcttctactggtgattttttaacaagcactaagtcaactcttttggatcagccacctgtttctgctacttccatggataggtccagcttgcatggattcattagttctagagttgatgcagcaggtcctgggtctttgccagtgaaaagctctgcaaagaatagagatcctaggcttcgtttcattaattctgatgcaagtgctgtggataatcaatctacattgatacataatatgcctaaagtggaatatgctggaacaacaatctcaaggaaacaaaaggctgctgaagaaccttctttgaatgttactgtatcaaaaagactaaaaagttcattggaaaatactgagcataatatgagcgaagtaagaactggaagtggtggttggttggaagagaatgctgggcctggagctcagttgatagagaggaatcatttaatggaaaaatttggacctgaacccaaaaacactttgaatacagtcagtagttcctgtactggttctgataattgcaatgcaacaagcattagaaatgagcaggcaccaattacagctagtgatgtgctagcttccttacctgctctattgaaaggtgcagctgtaaatccaaccatgttggttaacttacttagaatagcagaagcccagaagaaatctactgattctgctacaaatatgctgctgcatccaacaagctcaaatttggctatgggaacagattcaactgcaagtattggttcatcaatggccactggtcttcaaagttctgctggagtgcttccagtttcatcacaatccacgtccacggtaaaatgctgtttgtcttaagtatacactactgaagtcaatttttgaatattcacttgtggctatggtcttaatatccaattatctgtttctttcttctaaaaattgaattgaaaattttaacatcatgatccttcattatgaatgaacttagttgtggaatttgaaagtcacaatttagtgttatgaaaatccgtcaagctaactgtagtttacatttttgcatgtggttggcacaatcagacacaaaccctacaagatgattcaggaaggattcgcatgaaaccccgtgatccacggcgcattctccacactaataatactatccaaaagagtgggaacttggggaatgagcaattcaaagccgttgtatcccccgtgtctaacaaccagggaacttgggacattgtcaatgcccagaagcttgagggtagggtggatagtaatttagtgcctattcaatcaagtgcacaacctgatattgctcgacaattcgcccggaatctgaaaaacattgctgatattatgtctgtttcccaagaatcatcaactcccactcctgttgctcaaattttttcttcagcatctgttccccttacttcagatagaggggaacagaaatctgttgtgtcaaactctcagaacctgcaggctggcatggtatcagctaatgaaacagctgcatcaggtccctgtcgatcccagagtacatgggagatgttgagcatctttttgaaggttatgatgagcagcagaaggctgctatacagagagaaagagcaaggaggattgaagaacagaataaaatgttttctgctcgaaaattatgccttgtattggatctagatcacacactacttaattctgctaaggtaatttgcatggaatgggttctcctttggttgaaaatttgtgttattgcaagttaacaatttctctttcagtttgtggaagttgatcctgtgcatgatgagatattgagaaagaaagaagagcaggaccgtgagaaaccacacagacatctttttcgctttcctcatatgggaatgtggactaaactcagaccaggaatctggaacttcttggagaaggtaataatatggattcttttatatgctttaggcatgacattgtgcaatggcttaattttgaaataaagaattcatatctttcccaaatgctttataggctagtaagctctatgagctgcatctgtacactatgggaaacaagctatatgcaacagaaatggcaaaggtgcttgatccaaagggagttttgtttgctggaagagttatctctagaggtgatgatactgattcagttgatggtgaggagagggctcccaaaagcaaagatttggaaggcgttttgggtatggaatcatccgttgtaattatagatgattctgtgagggtctggcctcataacaaactgaacctgatagtggtggaaaggttcgtgtaacatggggtttcaaactcatgcaattctttcctggttttatatatctagcagatgaatcattcctatattaaattttaagacattgcaggtatacatacttcccttgtagtagacgtcagtttggactgcctggcccttcccttctcgagattgatcatgatgagagacctgaagctggaactctggcatcctctttggcagtgagtatatattatttttttctctttaatttggtatgacctgttcagctgataatttcttctcttcctctttaggttatcgagaaaatacatcaaatcttttttgcttctcgatccttagaagaagtggatgtcagaaatatactagcatcagagcagagaaaaatcttagctggttgtcgcatagtatttagtagggtatttcctgttggtgaagcaaatcctcaccttcacccattatggcagacagctgaacagtttggtgctttttgcaccaaccagattgatgaacaggttactcacgttgttgcaaattccccagggactgataaggtgtggttttattcccaaactatcagcatgttatgttagtctgtctgtctgtcatgttaaaaaatatagattcctgcattgctacagatctttataatattagagtaatttgatgggataaaaagggtaaactatgtgatgaaatttagtgtaaatcaaactattcatgatttttagtttggtttatgtttggataaacttctctagaaatacttctaggaaaagaaaatatgaagaacaaatgaaatgagtttctccatgagtcaaaattagttcatgtatatgctaatttgtagaagctctctcacaacttctctaaaaaatgatttttaacttatgcacaagctaattttaacttatggagatactcatttttctctctctcattttcttttagaagtgcttttagataagcttatctagaaacctggatatccagatgattaatccagctgtgctcccctttgctcataacatggcaacttaaactctttgtccatggcatatttatggacatcatttaataaaagaccgttttacttttatcaattagaagggagcccttattctctgttttttctccaacttctcttttgttaattcccacaacgaacaacttgctgtaaaatcttcactactatggtgtttgtggcagactgtgttcttgtgaattgaatttgaagcctaataaatgctacttgttctttcctttttcttgagcaggtgaattgggctctaaacaacggaagatttgttgtccatcctggctggtgagtatctcataatttacatttttgtttgtccttctgtgtcttttttcttcttggatttgacttgtgctgcttctttccccctcccttataaaacagggtggaagcatcagcattgctttataggagggcgaatgagcaagattttgccattaaaccataaaaaagaaactgacctaattctctttcgtaaactaaaatatgtgaaaacataaatcaagaatcacattgattttggggtgtgattggggagtgtgtgtaattttaccatgatgactgacctgttgttggagttaaatggaggacagtgagtgcccttgtaattctggggacacaagggttaggtagggcagggcagggcagggcttgacagaattggttgactgctttaggggctaggtgagtgatattgtaggggtgtcttttgtgagtaatagctctcggtaaatttttcatgagatggtattgggagtgaaatttatttctgttgctgacaaaggaaagttaaagacctctcagcattaagagaagagttaaaatgtgtggaggaactacctgaaggaggtattgactgaaacctaattcggggggaaaacaattcatttgttagaatagaacttgagtctaaggagaagcgggtgctagaacagtcgagtcagtttggaaatggattcatggccccagcaaaatgaatttctgataactgagtttgtatatcaatgcgtcactgtcaaagcatttgaggggcttaaattaatcaccattcaccctactcccttccccaaaacaataaagcttggcagggagggggagcagatagaaaatgaaaggaagtatgtctaaccatgatttatagtccaaacctcttggttgcttttaccgtcaattcatgaggattgcgttgctttacaattacaacaacccaattggaaaatcttgagaatttgtaaaaaggcaaactaattcatgatatcatttttggatataaagcttttataaccaaaatagaaaaaaagaagaaaaaaaggatgcgttctattatatacccaagaataatggtaatgagattcttgtgcactactggaaaaggaccacacaaattataccatcgagttatagttcaattttggtaacattaatgtacacttgattgctgtctaggactcgtagctggcatgtgtcatgtgtcatgctcttgcagtgattagaatcctattggtcgacgttttttttataaagaaaaactgtcattatttcccaataaattaagtatctctatcaacttcattttaatgatcaaaaggtgtatttttattctgcagggctgtttttacatcattattttttttttaaaaaaaaactgtataagattatggatttgtctttgtaagtttttttagaaacattgttaaaagaagaaaaaatagatgaatttttttataagtaaaattaaattttcacttagttaatttttagaaatatactaatatagtttttctaaaagatgagatgacatctataaaggaattaatgaaacattcattttagtttataaaaaaatttattttattttattttttgtttctagaattgtttatagagaaatttatgttcaaataagcctttcagtatttgaagacgtggaagattttttatgcaataaacgtatttctgggtcttgcatagaaagtgccaaacattacattatgcaaactcattacaatataacctcagggttatcatttgaaaatacaaaacaattggtccagtttgttttttaacaatttttccacccagactcctttattttctgaaaatttcaagctactaaatcacatcaaatgaaaacaagttattagatttgtaatttgcattgtttaaagaagactattgaatcaaagctaaatgtttatataaaagaaatataaaatattaaactaatgtttatgtggtagtaaggggtagatgggttctttctgtagaagttaatgtccgtttggattggactaaaatggatggatgatgggtgagacaaaagtatgtggtaggagtgtattagagaatataagcattcctataagttaatttgctttgcaatggcctatatttaaatgggttagatttgactgagactcgttaaatagtaggtctctttttgttgtatggtttgtatttggtacacttaggctgcaggttgaaaggttggtttttgtattgaataataaaatgtaaaatctaaaaaaatgaaatattgaaaaagttgaaaaattataaacattgatacaaactgaaagatatctaagactaatgaaaaacataacaaataaaacataaaatattaaataataattcatattttaaaaataccaaacaataaaaacttaaacaaacaagtaatttatatttttaagaagtaattgatctgtgcaggtttgttcgattacttgcagatctcaacctgtataacccatgaattaaatggatcaatgtatgtgttgggactaaaatttcatgtagttctcgttacattttgaaaaatccatttaaaagtataataagaagtgcaggaagtaagaaagtaatactgcgatgcaagaaactacacccatgacttatagtccatcgttgtgactgtgtattgagttgggtaagaaagataacactcatcaaattcaatttcaatggttgtcttgtttaagagtaatatatatttttaatgaattttcttaatattatacatgttacttaaaatatgtatttacaagtgaaaaagagaaattaatttctaacaattttaaataacttgttttgacagaaaagattcagggcatttcccattgacatatgtgttgaatacaaaggaaaatacaatgaaattacatctcaatggacatttttgctaaaaatgagccacttaatttatttgcatttctactagcaaattaaactgaaccataaattttcatttgtgtgatatggctaagaatgacaccacatttagtaatgctggtccctccatcccttaaatttcgactatagtcttccaaactgtctcaaaaatttctgcattatagggtaattgctctacacacttcatagcttgtaacaaagcataagcctccccctctttgacctccaacactgtggataatcactttgtatggtcttgaacgaaatttccaaattcatctaacaagcagcacccaaaaccagctttattactgtcattgaaaaaggccgcaacatggtggacgctctaacaacaattttaaacaacttaaataattttaaaaaatgcttagcgagtcaggacatgaaattaatattgttgactacaaagcaattacaccctctttctagatatgacacagcatagttattggcatccattagactattaccattaaaattcgtacagtaacgaaaagaaaaataaataccatgtttaaattgtacataatgataacaattagcaaattgtacgaaatgtctaaatttgcatgcagcatcgttataaaacgtacaagaaaaagcttataaaataaataaataaaacgtacaagaaaatgaaggaaagaagatcgtgaaagagacgtgttcaactgttcaagtatattgataatgtgggaaatgggttcacgaaaaagaatcacagatgtgagtgatcaatatttatgtgaaaataagaacagtggtttgtaacattattgtgaactatggttataggccaattttatttataatgttaaaattttaaatcacgaatctagagagtcgctggattcggtagggttttacctaagcactacgtgattcaaaaatagtcttgtagctcatgtaccttgtaagacaccgggacaagatgcatggtagcataatgaagtttctccaatgaaatatgccccaaacaagaaccgagaacagatgtagaacatgggatgagactgttaaggccgttgaattggtgggggataattaatatcaattgttattgaaaaattattagataatttcgaactaccaaatgtcttatgattctgtctaatttatgcaacatgatttaagtttttaattttattaaagagaattaataatgcttttatgtcatatagaattagttatgatcataatggtactaaaccattttataatttctgatactacatctgtgcttactgctgataaaaaaaaacatcatatctgcttactgttaatattgcttccaaatgacagtagatgatcaactattttagcaggatataattattacgagtaataattttttttaaatataattgcatgtttaagacgaattcgaaagactactagtttagttaagatcgtctgtgttttttttatccatgtgctcggtgatgtggatggtcaaatgttaatgcgtgtataatttgttgtttcgatactcaattttttctttagtccaaatttaagttttaattggatccttatcatcactagttagtttattcattaataaagtgttgaaaagacaatagctagctgatttgtcaaaccattttgcttctataatctatgctatgcctattcaatggcaataggcccaaaaggaggatagaaagatagaatgtatgtatgtggatgaagtgcatgcagatgcagcatttgaattaatgtatatttatatggtggcctctgtcacagatcagtgagaccatacccttcttgttgtgacaaaggaaaaagccttcgtttcctttggtagagtagaaagctgcacactgtgaaagaagagaaagagaaacacgccatgcccattcattctaaaggtgattttgacctcattctcttccttccctgtcttatccaacacaaacacttttatttttttatcggtcacatggtcctatatagagcctgtgctttaataatgtatttcaatactaatatttaatactatatattaaattgtttataaaaatgtgtttagtatcgtacgtcctattattccttttagacatgattattaaccacggataatcatcatcatttcagaagcaaggattgcgaaaggccaagatgatttcctcaaagtggatgcatgtatatggttccatctttgtgctccaccataattattgcactgaaatgatgataagcgattatggtcgagcagtgttaatcagtgacatattttacagttaagttaatcattttcaacccattttttctttctaatcaaacacgttataagaagtcataaacatgtaagtatatataatttattacataattaagtaaaacttatattttttataatttctaataacttttagtcaataatagaacaatatttcaagaaatgtgataaaagctcatctcatatttggccttttgctctaaaatattggtcttgctgtgagaaagttcttctagaagttggtttaaatgggccaacagcagaaaggtaaaaagaacaatcgggcattgaggttgaagaactttgaggagggaaataaataggtaaaaatgcttttcagagccatggaaacatgaccttatgatttcataaatggtagatttagcagtggttggttaaaaagaaagaaagaagacaagattgtcttgacaaacaagtagggagaagctttaacccaacacggtcaagtgataatcataaccaacagtgacctccatattctattctgtactacatgatcacctgcatgcctccgagagaaagcaagaagttgcaatttccaatcttccttttttcctcctttttttattttttcggttatcatgtttgtaccttttacaaaacttctgatcttatttactcccgccgtgagtgccacagttttaattactttgggaagcatataataagttataataaattagatgtaataatattttattatagaagaacatatatactacccatggaacatgctgagtattttagctttttgaaattatgaatttgttttggatatgggttcatcttgtattgtaccattggattactcttctctcccctttatcctatcatcttccttcttcttagtattgctactaaattaaataatttaaaagaaaaaaatgggaccatgcgattgaggtgctggtgttgcttcaggctgtggtgtgaaggtgatgttttttttggataatcattttattggtatgaaatatttatcaattttattgataattaatctctgttggagaatttaattatctttaatgagattctctttttctaattatgtttttttcattgataagatttgaatctgagactttacttaagaaaaataagttcaattaaattaattacttattggtatgaagaagataatttaggttaattagtgaaatcactttatccaaagaagggaaaggattgtgttgtttgctagtgacacaagggtcgaccatccatgattcatatgtagcaatcatgaagtgatttatatgaaaatgagtaattttattattagagttgaataattttgtacatcaccaaatatagtaataaggagtcacttttcaaataatagaacaaaattttatggttgagaatgaaccaaaacaattacaaatagaaataggcagagttagctctctacaattaataatttgtattagaggtaataagacattttaatagtggttcaaacacaagaatttccaaatttaaatttggacaaattaaaaaacttgtggctaaagctccacctatagaattagttcccagtacagattgttgcaggcgaaggaacgtggtatccctgaccctcatcacgtctcttcttcttcttcctatacaacacatgcatggaaatcaagggtgtttgtgacagaaatggaaacggatttacctgtgtctaaattttttaattggattaaattttagaaaatgtttgatagacactaaataaataataattttatggagaaagaaaaaaatataaatataataaaatttatgatatagtaaaaaaaatattttttaaaaaataaataataatttatgtatcattactcctaaatttttaacttaaatttgactcaattaagatatgatgataacatattagataagattgaatgaatctaatttattgacataatatattaacttgtaatattatgtatagttaaatcgtataattaacgtatatagttataattaatgtataatttctcttcttaattacaaagtacattaaataaataaatatataggacacaggcgagattcttgagaacatcgaagattcgaaactgcgaaagtgtgaattgcagccatttcaatactaaaggagctttattcttggtttcaccttccttcacatttcccaaccacatgatccatttcttaattgcttttagagtttaattatttaaatctttaaaattttgattttacatttggcattatcttaattacttaattaatatgtaataattagagttaaaaattatttttcttgttcttttgctttctcttttaatagtctgtccataaaagacttgcgtaagatttattcctgcgttgtctgttattcagttaactagatatataatgatttacaacacgggtcgctccgccacgttccatcgtatttttataaattaattttcattttttctattgtaactaaaaagatatttatttatgttattgttgataaaataatttaatttaattaactttagttcaataaagaattaaattattattttctaataaatgtaataaataaattttttatgttaattattgtaataattgaattaaataaaaatagtataaaaatttcaaatcttcattaaatttaaataataaaactataatttttaaatttttttaaaatgttaccgttttattttactgatattttcgattattttatatgataaaagtttaaaaacaaatactacatttaatataaaaaaattctggattgtttgatatataaatgtgttaaatattattttttaaaaattttccgtaatgatttattcatgatggcatcatccaataattatttcttataaatgataattataatttctatcctaaaaaatgaaattaaaacaaattaatattatgatataatgagtaagtaattaaaatttttttgaaacaaaaattatttttataatttaattttaattttaatttttatctctttcgtatatttaaaaaaattatttatgatattattgataaaataatttaaatttattaactttgattgtcttataacaaagaatcaaattattattttcaaataaatatatgaactaaatgttattatgctgataatcgtaacaatttaattaaataaaagagtttaaaattttcaaatgttatatgatggaaatttaaaaataaataatatatttaataaaataaatattattgattgtttgatgcgcaactatgttaaatattttttaaattttttttcccataattgttcactcatgatgacctagtaaaaaaaaaattaaacagccaaattaaaaaaagtttttgtttccttaaaaagtttaaaattttcaaatcttaattaaatttaaataataaaatattatttttaaatttttttaaaatctcaccattttatttgactgctatttgccaattattttatatgattaaaatttaaaccaaatactacatttaattaaaaaaattgatgattgtttaatatgtagctatattaaatattttttttaatttcccgttatggtttattcatgatgatatcatctaataattatttcccgtaaatgataattataatttttatcataaaaatgaaattaaaactaattaagattacaatataatgagtaagaaatttttataatttaattttaatttttatctatttcctatatttaatatatttttattgatgatattgttgataaattaatttaaaataattaattttgattgtcttataacaaagaatcaaattattattttctaataaatatattaactaaatactattatactggtaatcgttttaattaagtaaaaagagattcaaaatttcaaatctatatgatgaaaatttaaaaacaaataatgtatttattaaaataaatattattgattgtttaatatatataactatgttaaatatttttttaaaaaaacttttttttccataacggttcactcaagatgacctagagaataattatttttcgtaaattataattgtaatttttatcactcaagttgttactttgatattttcacccattcaccaatgatgtctccaattttaaaatgtttaatgaaataaaaaaataagtattaactagagattcctatttcattaacaaaaactttatatatatatgcttgaagacgtttaaaataaaattatacatttatttaattcttaccaataaagtaatatatctattgatgacaatgaatttatctcttattatagtttattgtagcttaattatttgacaattgtgatatttttctatataaaaataataagtaaaagtaaataatattgtgtgcgtgtattatgtatatgaaaattgtctaatgatgttaaaggattttgttcttataattttttctatatttaggtttactcatgaaagctttattagtagtaaattattttactcatgtcctttattgaatataatttttatctcctcttattatgtttatgggtttaatattcccatgctaatacatggtttaacaaataattattaaggtagatataaattaaaaaatcataattgaatttatgctcttatcaatgaatgtaaatacatggtttaacaaactttctcatacattacggcagatatccacaatatcaataaacagcttcacaatgaatcttatattcaaaaagatgttttttttaagaacataataaattaataactcattttttctcaagaactcttcatcatttatttgaaccacaatggaaaataaagctagaaggagacagagagaagcggatggagttgaagactgaaggtgtacattaaatagatattagaaaattaccattttatcatataagaaggacaggtgtcaccaaattaaataagggcaaaaatgaaatttccatggcctattgtttttttaaaatttagagtcttttcgaaagaaaaattaaaataatattgggattttgtattttttaactggctagtatgataccttgcgtacataggaaataccactggttacgcgttaaagagataacgtgtgaaagagataaaagaaatgatataatgagtatttaagatttaaaagaaaatattaatttacttatcaaaaaggggtgcaattagcaagtcttaatttgaaaatattggagtacagttataaaaaagggtgtgcagttagcaagatttaatttggaaatattgaagtgcatttattaaaaaggaggtgcaattagcattttaatgttcaattaccattttacccctatttttgccaagtgtcaatcaactgaaaaaggcaaaaacggaatttcatatgcctattgctttcatatatttatagtagatagtagaaggattcaaaagaatcttcgttcattactttttcaaagagtaacctagttaggaaaaaaaattaaaattggacaccgagtgttttatatattctcacattctcactccttttgttagtacgtacatcatgaatctcatttttcctttaactttgctttactaaaaatgtttgctaaattctaagttaaagaaaaaaataaatatgaagcaaatggagttcaacagcacgatcaataaaacagaatgaactctattatacaaattttagatggtgatgattttattattgttgcatattttatcttctatgtttgtttagttagttaatttgaatttcaattaaatctgatagcagattagtttgtttaggatttttaaattgattgtaagtttatacatagacattctcattttatgaatttcaatgattattttatggagaaactttttgattgagcactaaacaatgaggttgagtgcaaacactaggttgaatacaaacttaccaaaaatttaaagcaaaagtcctaagacctgaattatttccatcccaacatccattagtgctttggagaaatataataatataaaaacaatgtaataagaatggtgtgataataatcaatgctttaaaaatcgaattggtgattgaaccgggccagtagggttcgattttaataacattgatagtaactaactaagcctgtttatggaaagacgaagtgtggggacgaaagcaaattaatattggctttagctttaatggtggtggtagggaggtcccatgcatgaatgcataattcaactgcaaacatgactcttcattcttgtttggtagttctttttatttgacaaacaggtcaaacaaaaccaaacctcacgcaatctgctaccagatcgatgcatatcatatatcatattcatatggtatcacttagtaaaatgcaaatgcaggcacatatttcaatttgcacccataattatcttctcatttcacttcaatctgtctcttggctgcatatacatactgtactaccgtgtctctgttcttttctccctccacattggagattcctacaacaaagtctcactttaatttattctatttggttttgttacttttctacactccatttgctattcaccactcacgtgtttgtctcaaaatcggagagttggtttatttactatatataataggaattagcatatatataatgaaaacggctgttacaaatatattttaatactattgaatgatttgtatccatgattggtttttaagatgttctcacagatttatttaacatgcattagttggattttatgtgaatttcattaaaaatacatatacttaagtgttcaaattagttttaatttacaattttatatttaaatgtatttcaccatatgtaaagctaaccaatttaatctccatttgattttgccaaactcctttaactagtcagatattgatggacacatgatttatatgcacatttcaatcgacttatttgattgaatcaacttgtttcaaaattaaagagttttatttagagcttttaaaaataattatttgttaaaattaacctatttcgaaatatacattaagtttaataaacaagatggaaagtatttgagagaggttttataaaagactatttgttttaaattctctttcaatttttttagaataatcataaagatatgaaaatacttgtctttattcttgtccatcgtgcagtataaatgtaaagtaatgttttgtttgattgaaagaaaatgggaaagatgaaaagggaaataaaataaaaataatatgaattatatttggatctcacaccttttatattatattttaatttaaatatctttattttttcactattataatcatttctatcaaagataacacatttacttaaaaaaattctagcggataaactgaaaaaagtaattctagcagataactgtggagaacaatgaagaagatccataacatgcaataatttagttattatccaaataaattttgaggaagaatgggtgtttgaaaaaatacaaaagtgagagtggggaaagagtgaacgaatgacagtagtaaaacaactcaaattgtcacacacgtgcatttgcacagtgatctaaatcacttcacttcacttcactccacagttcactgtactttcactccttcgccattttccaaccccaactttcaaaatacaccaaaactccaaataatataataatatttacaaaaggcaaaaacgttcctactttttatatactcaatagaggcacacacacaacaacaacaaaagcttttttgtgttctgcaactgaaagtgaaagaagggaagcagaaaccaaaccaaatcatgtgttctctactttggagttccattgcattgtgtgtagcactcctactccttcagcttggcattgtgcacccttcaccctctcaccataggatcactcgcttaccgggtcaaccccatgttcagtttcatcagttttcaggttatgtaaccgttgatgacaaaaaccagcgtgcactcttcttctactttgctgaagctgaaaaagatgcactttccaaaccccttgttctttggctcaatggaggtgctcctcactcacttcttgtttcttttcgcacctgtaaataaaaaagttctcaatcagacaagaatttgaaagtttggaaacttatgctttgtgttgtgtcttgttcttttgaagggcctggttgttcttctgttggagttggtgcattttcagagaatggaccatttaggcccaaaggagagggcttggttagaaaccaattcagctggaacaaaggtacctacctatctatcttcttgaacaaatttttgtctatacatatctattgttttccatcaatggggtggtttcaattttagcataactttgagaatatgacatgctgattagcattgtgcacatatgagttgcagaagcgaatatgctgtatttggaaacgccaattggagttggattctcttactcaactgatacttcctcttacgagggtgtgaatgataaaattacaggcaaggttttaatgttcacacttctatttgacattaccaacttttttacttttttagtcccgccgtaaaataattctcaatgttattggtttgaatggtaattggccaagaaccattaggtgcaagcattttcacatggctaaagaaagagtttattaaaggaagatcccggtcaactttctttcttcttaattagttctcaccatctcccgtttgcttttcttgtttgttatctttaccttttacaaaattctgtcctgacccctttgtccaaagttttgcttattaacataatgttatatcacagcctgctattttactttacagttatgccttgtccacttcctaaatagtgctgtttttctttacaaaataaacagatatgctcctttaaagattgccttggttttctgtaacactttgtttttctctttatagctagggataacttggtgttcttgcaaaactggtttataaagttcccagaatacagaaaccgaagtttgttcattgtaggagaaagctatgcaggtaacactaccatctttttatgtttttcaattatgaagaagctatggttaaaatattcatatatttatgtattttgaaatttatgattaggccattatgttcctcagctggctgaccttatgcttcgattcaacaaaaaggagaagttgttcaatttaaaaggcattgctgtgagttatgattgcacaaacttccaattattcttcttttcttattcctgccacgtgtcagcttgcttttatgcttctgatatccgttaagattttgaaaactagaaagcaaaaaagttcagctaaagattcatcagctttgcaatttgactaagaaatttaggcatctgaagcaagttagtttcctttggtgcagcttggtaatccagttctagaatttgcaacagatttcaattcgagagctgagttcttctggtcacatggattaatttcagatacaacgtacaaaatgttcacttctgtttgtaattattcaacatatgtgagggaatactataatggtgctgtttctcctctctgttcaagtgttatgagccaagttagtacggaaacaagtagatttgttgacaaatatgatgtgacccttgatgtttgtttatcttcagtgttctcacaaaccaaagttctcaatccccaggtgagtttatcctatagcttctctttaattccaactgtcacaacaacttgattttctatataacttcaatcaaagtactgagggcatgaaatactggttttgtttttgttgtcaaacagcaagtcactgaaaccatagatgtatgtgtggaagatgaaacagtgaattatctgaacaggaaagatgtgcagtcagctttgcatgctcgtcttgttggagttcaaagatggtctgcttgcagcaagtaattctcctctctagccttcattaacatgttcaggaactaattgagttaaaccttgtgttctaccttgcctttcttcatatgagaatgtcttttagtgttggtatttcgagtctgggacagagtttgtcttgttttcaacatttcatctctaccttgcttaatgctttcctcaacagctttgtctcttgttaacatgaatgttatgctatatgattatgatatatccatcagtgtcctggattatgagctgcgtgacttggagataccaacaatcacggttgtggggaagctagtcaaggagggaataccagtattggtatacaggtacatgtttacatccttatgaagtgaaaattctattctagatcaaacgaatttggcgtagattagagtgtgtataattgcctttgagaatgaattgataattgttgttttgcagtggtgatcaggactcagttatcccactgactggaagtagaacattagtacataaattggcaaaagaactaggattgaacaccactgtgccatacagggtgtggtttgagaagcagcaggtgaaacttattctgttgagttttgctgagattactgatcacattgaatttgagtttactatctatgtaacatcaatgtaaataattttataatgtcaaccaaaaaaaagtcatggtagttatagttttcgggataactgttgtaaaagtcaacaaacttactagagaaaaaagattatgcaataacaatataaaaaaatgttcatccaataataaattaacatgtatgataattttgttaactttgataataactaccttagaagtcatgtttttatcatgatttgtaattggttgacatgtgattttttttatagtatatagtaattaaattcaacatatgcataacaatttgtgattaaatgatattataaaaactgagtgcatatactctttagtctttactcattgaaattttgttgtacttatgaaatgtagcatgtttgtttcaggtgggtgggtggactcaagtttatggttacatcctttcatttgccaccatcaggggagcatcacatgaagctccattttcacagcccgagagatcccttgtgctgttcaagtcattcttagaaggagcacctctaccagaagagttttgatatgcatatatatgttggtggtgtcggtaaaatgtgattgttggattgtagtgtggttcgtttcactgttaatcaatggtgcccaatttcaagtgtagaaaattgtgtgtgttttttttttgttctgtcacagtgcattgtttacttttactatttataaagctgcattacgtaactagcagtaactgtctgctcttaattatgttaatcggtaacatagtgaaataatcttctgtttatttatttttcaagtaaattctggaaagttacaactagtaaaaaagggggaaaagaaagttacgctgatcacaagtgtatcagaactgtagtttcttttctttttttttttttttaatgttaatccctcagttgatcatggaacttcatatacacttattaccttattttttaaaaaaatgagcatcacctgcttatagttatgcaaactagctaaccataattagaagtgcatttttcaaatggctaaacttcactttttttgggtcaaaagaagcaaatatatggaatgattatagtctgtcttgcgggacctaggccaatgagataccgtgttattgttatgcaaactaatgagtagtaatggctaaccataattcaaaatgtatctgccaaaaacacaatggcgtagactctaggaggccagtggaaacaaatcacgaaatgcacttgctagcttttgaaaaatttggtgcactgaatggtaggtacactactaggccaataaattattgatagatgttaatggaacaattttcaggaaatttcatcttaagggacattgaagatgaatatttattttaaaggaatttaaaaagttcaaaatgttaaaacttaaaaggggccacatataatttatttttatttaaagagaaggaccgttagatttcaattaataaacaatattggccttataaagaaatttgtgaatgatccttttttttgttttttttaaagactaaacaatatatgattgtgatttctagtaaatatgagttttatgtatgttttttcataaaaaaaaatcatttttgctttctaataaaacaaaaattttacttttggtcattggtattgttttagtccctaataaattagcatattttgtttgttacttgataaaaaaatttcatttgttattagtccctttgaaaaaattaataacaaataaaaaattattaggaaataaacataaaattcagtaattttaaagaactaaaaagtgtcaaataccaaaaacaaaatttttattttatcaagaacttgatgcaaagaaaaatttatcatgtaccaaatgcaaaattaggatatttgttagaaaaacattttttttataaaataatccttttttgtccttcatgaaagattagcagttataaaaggaattttattttagataaatggaactggaaaaaaattgtaaatgattattacttttgattgactagtaatagatgaatttttatattggacataaaaggttcaaaaaattattaatgagttatgagagttgttattgtatggccatttgttgcccacagtgcgtaactaattaatagtaaataattaccagtttttttatggataattagaagttactcttatagaatcattatttgcaagttttatattaaatcgtaaattaacaataatttatgaatgactattatttagtattaaatagttatttttttattaagtgaataagaataataagaacaaatttattttcataaagacacatgaaaactataaaaaaaatgtaaataaatatcatttattaataagcaattatttatccttaagaagtggccattatttttattatgggaattttcgtccaatacataaaataattatctctaaaaaaatacttatataatatacttttaaaataaattaaacatttgatatttgataagattgaatattcactcatcattctttttgttgtggcacacatatatgtggatagattcattaactcttagaacaacaccgatggtcaatgaaggggcaaaatattaaaagaacttggtcaccttacataaatcattgactaaaggtcttgggaaaaaaatgcaaaaggtcattgcttagctgcttatagaccgttgcatatcttcaccatagatcatcaatacttgtatgacttcggttgttgtcatcagtttttgttttttgtgacaaatgtcgaatttcttatagtgtttatctttttcttttagctaaaaaaaagttgaatccaatgcattaaaagaaaacatttttaaacataaaagtaacttttttaaatgatgatatatataaaaaaaaagttgatagaagttaatttgaagaaatttccactttttaaagagaagaatatctcaatcattagttgagacaaattaagctaaaactcagattgttactcccccgtgcaaactctgtaattatttgactgtaacttgagttatagacgtcatatttaggaatggtaaaacattgagataaaggcttttcacacatacttaaagtgtttttttttttaataatattttccgtttggtgccagtttttgtttgaattcatatcagatttcagtttcttacattacagcttctatttaacattaatactaaaattccatctacctatttcacttgttgcactgtgtgattgccctatcacttgtttaggttaaggtgaaagtttgtgtgatacattattcataaaataaaataaaaatgtttgtgtgatacattattgatcctgcccccttcagcaataatcattcatattttttgcatgattaagcaccaaatatttgtcctatttttgctctttttcgtttgctggagcaagtaccaaatatctgaatgattgagttgtgccacatgtgaaaaaccaaattaaggaaaccacaaaaagttatggcttgtgtatgccgacttcccatttttcctttgattggaacccaccaatttaaggatattccattttcatgcccttgccgttatctatctcatttggatagtgtgttcaactctttcttcctcttttttttccccatgattaatgtatgttgttccttttccatgttttctttttcttatctcacaattatgtccttacctcttgataaatgcttagttttgcataaaatgctttctagtttagataagcaaatcaggtggagaaaagagatatttgtatgttcacattacaagtagaactttgaaagattaccagcaatcggtttatgttaatgacattcatggcatgttcctctaggatacagctatagtactgggcaagaaaagaaaactctagttaacatgactagtcatttacaaacatgatatactagtgtaacctaaaccaaccacaacctgcaaaatcggccaaaagaaaaggaaatagaatagagaaagagaaaatgggatatagagaaagagaaaatgggatattagaaaccacaccattaaaaccaagatcaagcataacaatcaattacaccagaatcatggccaccaaccaaataggggggggaaagggggggcggggaatctctagaaactgaagaatgaaggtttggttcaaaaactgtgcagttgcgttagcatgtgaacaagctcatcactagaaggcctatctgcaggcatatcagagaggcatgcagcagcaatcctaacagccattagcatctcatcttcctcaccttcttcccctaacatgctcttatctagagcttcgtgtgcctcgccggcttgctgcaagtgtctcagccaacatcccaaacttcccccactggctgcttctccaaagaatggatctgtaggatccttacccgttaacaaaacacctagtatcatgccaaaactaaagatgtcacttttgtcagtgtacctgctgaaattgcaaaaaaaacaccattcaatctgaataccatgaagttccaaatacaagaatggaatgaagttaaaataaaaatcttattggcaataccatacccatatatgcaatgcatcaatcaagcaatctttttattgttattatttattgctattgatattgatgcatccagagacatacaccaatgaaaaactagaaatatttcaagataaattgggaaaaaaaacctttgtcaaatattattataatttagttgtggtctcagtcaccaatctaggttagtagtttgcagcatgtgaactgtatattcatttggaccagacttagtgccaactgcctaaggtctaaaacttgacatcaggaagtaatgggtagttacaaaaactaattgcaaagtctttattaaataataccaaattcaatcagcaaatgatacaatgacaatacagattacagaataataactgcgtttcaaaacaagagtctttcattaaggtgctacaaaggtggcaaaaacccaataaggtgtggagcttttgaaaaggtaacgaattaaaaaaaattcccaatatcaaccaccaagttaccctattggtgtaaaaaagtgaaagaacagaaacagaccaagttcaaaacactagtgaatgaccttgattgagaccaattgatttgtcttacctgcaattatggaaacattcaggaggagtgtagagagaacttcctctatccaaattgggtagaagtttagccaacccataatctgccaatctgggttcaaactcagcatccaacatcacatttgtgggcttcaagttgtagtgcagaatctgaggcacacaagtgaagtgaagatactgaagacccttcaccacaccaacagcaatcctgagcctaacttcccaaccaaagggcagctcattctccctcactttactcaacacatcagcaagactcccagtggaaacataatcataaaccaatgagaacctatcaggctcacgaatataggccctcaaactcatcaagttcctatgcctaaggcttgcaagaagctcaagctcagtttgtatctgcatcttcactgattttctcttagcctccggggaattgctctcaaagggtgttagccttttgactgcaatagtgagtccattgtcaagcacagttttgtagtacttcccattaggactcgaaccgagcaagtggttttcctttgccaaagctgattggagtgtcttgggggcaatttttggggagaatatgacaggccccttgaggattggtgtgcggttcagatactgaacaacacaacgaaccacaagtgcaaagagaacagaagaaactagtccagtgactgctcctaaaaccatactcaaaattatcttcctaaggtcatccttgtatactgatgaagatggtggtgatggtgttgacctagaaggtgagggaggctcagaagaaacatgtttactcaaccttccttgacactgcacagtgttgtggtgcaagctgaacaagaagagaagaaaaagtggctgaaatgccaacaactcccttgcatgagaagaaagggtgtgccttttcctaaacatgaaagcacaacacaaacaaacaaagccacaaccagaaaccaatctcagaagctccaaaatgaggcatgaatcactcacatgctcaaaacccccatcaactcaaacacttggaaacaagaccaagaagaaacttttatactttatgctaaaatgggtttaaaaaaaaagttgcaagcataagcataagcatcttcctcaaccttttaaacccaaaatcttcacaagaaagccgtcccaaaaaagtgagctgacatgttttcgccgaatagttttacatattttccaccgaatcccatctttttcctcctctcaccacccataaattttccagcttcacacgaatcagaacaagaatttgaacctataaaagaagaaaaaaaaaacacccccaaaaaaaacccactattccgaggtgccagcagggactaacaaacccaaccaaaagcaaactagacccagaaacaagttgcaatctttttccttggaaaccaaacaaaaagtcaaaaagttgaacagaaattgaaggggcatggacatgtggtggtagtagtagtaaccaaaacttgaacaacaataacagcaactaagaacagacacacacacataagaaaaaaaaaaaaaacgcccctcggaaactaaactgcaatgtgcttaaaacacaaaacacagtgaacgcacacagcatctagagtgagtgagagtgattcagtgattgtccctctgttatgtttctctctcatccgatgacaacaaacaaattacaaagagccatacctcttctgcgacaaaaactggttcccgcctttgtgagtactcagcactcaggacacagtactatgtgggccccacatttgtccgaaagcgaaacatcgaaatccgtgagagggagaatgtacagttcgtctcgaccgtctgatctcatcagactacatctgggccgttgaattaaggttgcatgggaatttgtgatatgctatatgagtgagtggttaacaactctagcgattgttatgtttggtgtgtgtcattaataaagttctctctttttcgatcgaataattgcttttaattactacttacgtttcaatttcaaataataatatatgaatattaattaactaatatctttaagatattaattaaaataaaaatatttattatgaagattataaaaaaaatataagaaaaattatgtataatataattttgcgtttcttatttttttttaaatttcttaactaataccttaacaatattttttattatttataatgctatatttgcatgcttttacttttcctctttctttctatcttaccttttcttttcgttttctttttctatgtgataggtggaagttgctaggattaggaacgcctttaatcagattttaatcaaattttaactttcaagttctctcgtggaataggaaaaattctttatgacatttttggattgtttttaaatttaatagtcaaaattaatttctcattatacccattaaatttaaaaagaaaatgaatcgagaggataagatacactcttcagattaatgtgatgtaggaataggtagtgcaattgaatgagtgttgcattgaataaaaataaatcgaattatctaagcataataaatgatttattcgagtccgaggatctagcactatggggtgagtgaatgagcaacacatgttcgtataggtgcaagcaatactagtatgaataaattatcatgtttgttttgttcatttgtggcatgagacattttgaaatcagaaatgatagtacgtagattttaaattactagtataatccaaatcaagcatttacaaataatatccatttggtaaattactagagttaattattatagcaatatacattttaatataaaatatatagctaagattaacttaaatatatatatatatatattataactatatttaatggtttaaaactatttctttcaaattctaaaaacagacatataattggatacagtcagttccttttttttgaaaaaaaaaaaaaaactaacaaaatgaaaccaagccaaatgcaacaaataattcagattgcgaatttcacatattaggtgcaactatcattttaataaaaatattaatgccgttcatagaccagtggtgtctttgttgaatgtcaaatttttggttgatagtcaactatttagacaaggcattgtatgctttgacccattagtcataaatttatacttgaaaagtggtttcgtgcaagggaatagaattatgtgaaaatgaccttgaccttttaaattaatttaaataatagttaatcaaacttgtgcaccaaaatttatgcttaaaacacacgccaaatcattgagtctttttccctgaaagtattctccacaatgtttaattcagtttaggtaaaatttaaaaaagaaaatactgagaaaaaataaagagatataataaaaaagaatctacggcaagttaaaatcaacttatctaccttaagttttaagaagttctcttatttaacttttccaaaagtaaaaaatatataatttgattttaatttatttgcctccctattttttcctatgagtattcttttaataagtttatacatattggaattatcaggaccatatttaatataagatttcgcgaatagtggtcttattttataagtaaactctttattttcgtaaaatgcaagtgatattaattatgtcctaagatattaactttttactcctagttattgaaaaattatattaaaataatgttttgcgtgcaatacttaagatggtaaatcgtatcattttctaatactgaaatgttaaattgacgctaattttttcagtaaatcaaatcaaattactattattttaataattaaaaaacagaattgatgttcttatttttcaaagactaagttaatatcacttgtatttatttgaaagattacaaatgtatctatcctctaagttgtggtctcgttattagtcataacctagttcaacaggccccacttcaggtgttgttacttggtcactgatatcaataattatgttgaggtcacccgtgacaaaagttgagttttagttgatagctgtgttaacacaacatgagtgttggccactataacctacaagattcctcacggtttgttttgtagataaaaaatgtttatgtaaaacagtgaaaattcctattacaagattacaaaatatctagacctctttgattgttgtatttgggcagcaaatgtgattctttactgttggatacaatatatacaatggacacttccacccaattcttttttttggaaaatatataaatatgtatattaaacaaaaatgatatacaactacatggggcatctcccgatcatacaatagccataagggccaacgaaggacatcacttgctcaaaaagcaaatatacacaatatcagatatacctggaaaaaccaaaaagcaaaaatacatttgctagtacaagtgagtcaggtgagcatacctcatcgtcctaagcttaatcctatcaaccaagtcagctaatacaaacgaatggttatcaaaaagaatgctattcctacagtccatatgctgaaaatagtggtagccaaagcaagacagcggaactttcctcggatgcccgaaactgccctatggtgcactaaggcattaagcactccctgaagagaaatattattcctgggatattgtgcccaattcatgatttccgtccaaatccttagagtgatacaacatctgaagaaaagatgatcattagattttggatgctgcttacagaaacaacatagagagcccttttcaagaaaaggggccctatccagcgtgaggagcttatgagaagccgccagccaaagagtgaacgcctccttaggtggattagccgaattccagaccacttttgcccaaaacttgttaggctgaacagatctgaaatattcataggcagtttcagctttgaagcctccccgctgaacccaagaattcaaaagggacacagccaactccgggcttccctcctctacaaccagcccatcctttatgcttcccagccttttcatgagagcgaaatttgatttcgctgcatggaagctccaaaccgaaccaccgttgaagtaaaagtggctgacccacttcacccaaagggattctttttcgaaagcaaagtcccaaagcaccctggttaagagagccttattccaggttttcaagtcatgcagcccaaggcccccttcttttttgggggtacacaccactttccagcccacaagaggtttctttctccctacatcaccttttccccacagaaaattacgacaataagcttcaatcctctcaattacagtcaccggaaagggaaagagagccaaccagaagtttacaatcccaccaataacacctctaagcaattccagccttcctgcataggagaaatgcttagagtgccaattctgcaccagccctccaatcctgctgagaagaggagaataatggcagacgttcaacctggaggccatcaacggaatgcctaggtaacggatagggaagctacccgggctaaaaccagtgagagcatacaggtcagccatagtgatatcatccacccctgaggtgaaaatggcatatttgccttggctaatagataggcctgagatgctgcaaaaataagccaacttattaaaaatggtggctactgatggatagtctcctcgagagaagagaagcaagtcgtccgcaaatgtcaggtgagtgatgttaaggggggcacaactaggatgaaaattataaagcagattgttcttcaacccattgaggtctctggacaaaaactccaagcagatgacaaacagataaggagataaagggtctccctgtctgatgcccctctttccctgaaagtgcctgtagattttacctttaacagcaagactatacgaagtggtggagacgcactccataatccagccaataaatcgactcggaaaacctagggcatgaagcatgtaatccaggaactcccaagatatagaatcgtatgctttgtggagatcaacattaagcatacatctgggggagtttctcttacgggcatatttcctaaccagctcttggaccaggaaaatgttatttgccatactccttgctttcacgaacgccacttgcgcttgatcaattatagagtcaagggctggtctaattttattagcaagaacctttgcaattatcttatagattaaattgcagcaagaaataggtctaaactgggtaacccgagaagcattggctgccttcgggataagagctataatagcatgattaatttgtctaagcaacctgcctgaactgaagaattcttgcactgctgcaactacatcattgcctatgactgaccaagcctttttgaagaaaaaaacgttgaaaccatccggccctggggatttatttatgttcatctggttaacaatactggtgacctcctgagctgtaggcaatctgaccaattctggaaaaagatcaacaggcaccttattgccttgcaagctgtcttccagagaagggagattcgtaccatgcgaagtcccaagcaaggaagagaaatatttcacaaattcatcaccaatttcctgctgagaccccgttctgcttccatcctctctataaataaccagaattaactttgcatttctgtctctgctgatgagagaataaaaaaatctggaattccggtcagcctccactaagtacttattcttagttagctgagctatcttgcgggattcagctaacctgagctcattaatagctgcccgagcagcagctatttttaccattaagttgcggttattaggcgtttgttgggcttgaagcaagtccttaaggtaactagattcagcttccttaattttcctttccaagtcaccatattccttcttatacagctccttcaagactggtttaagcatcttcagctttttacaaatttggtatatcttgcagccttgaatttcaattgtccaaacagactccactactcgagaaaaatccctggaatcagccaccgcattgttaaatctgaagatggacttaccaacaggaagggaaggattcatattaacaataagaggggcatgatcagacactgagcagaaatcctccactgctgcaaacgatgatctgaaaacagatacccactgcatattgcaaagggctctatctatccttgaccaagtatgaccattagtccatgtgtaagagctccccaccgtcctcaactgatgaagccccacatcggagcagcaattattaaaatctctggactcataagctgtgacatctgaaccatttttcctgtcctctggattcaatacagaattaaagtcccctagaaccagccaaggacctgttatattgctagccacctgctccaaagaactccacatgtgccttctttccgatatagaatgaaggccatacacaaatgaagctgcaccttgatcagtagtaatttttgaagcaaaattacagtggattaattggggagtgaccaccacctccgtgatgtccactctatcttttctccacaacaagaagatcctcccagccccactaagattgaaattatgaccataagcccagcagctaaatctcttctccatcagaccttttagataaccttcattgagcttggtttctaacaaggccactacatccacctgtttctcattgagaaatctctgcaccgcccggtgcttaaaaggggcattgaagcccctaatattccaagataagaaaatcatctctttgtccgggaagaaaccttcccttcaaaagaaatgacaaattttcccatttttacattgccagccttagctgtcttatgctgcatcttctgttgggtcttagtaactggcccaacgttagaggctgctttcttcttcttcttcttagtagccagttcccattctccatctgattggtcaccagaggaagcatatcctgtgctgatttctctctctgtatctgcatcactgctatcatcagtgccatcctcaactaggggtaacttatctcccaactcttttttcccctcactccttttgtctcccatgttagaaacaggcttctgatgtgagagatgtatggagagacccccatccaaaggtctagactgactggaagtaggctgatctgaggttttggccgaaacccctgattgcctgggaatcagttttctagtacctgctagatcaatatctttctggttctgttgatagccctgcaacctgatcgaattacccttgtttttgtctctgatcccaggttggcccccctgaacctgaagctcattattttccttagaaggattttgcgtagtgttgcaactcttagagtaatgccctattgtcttacagacgttgcagaaaacaggatttgtttcaaacactatctgctgcaagaaggactttcctgttgctgttttcaccagcacctccgtaaccaactccttggaggcatccacttctactaacgctcgggcaaaagagagtgatcctctagaagccgtcagctgatctgtgcgaataggggtaccaactcttgataagatttttgctagagcagaggcattccacaattccaggggcaggttcttcagctttacccagaccgggaatttgcttagttcctcatctccaaaatcaaagaggtcaggcataatctttaacaagaggagtctctgataaataaaataaggaccattggctagcaccaagtccctatcctcctcagatcgaaatctgaagattaaccatccacttgcatgggttgagtaatggaactccactccccatttctggcaacattgaagcaaggcttttttccctgggaaccttcctgcaacatatccaatgaggccaaaaccccaaaccttaccaaggggttggatgtcctctttctctaaccagacgaagtctggattgtccatcgccactggttccagaactatgcctttggaaggctgcctgttatctttaaacaaatttgcccacttattcttctccttattgctaccatctccctcatccaattcagcacctccttccactgattgtgcaacataagtgtctttcgtgcccaaagatatggacccttcaacactagaagagggatcagcctggagacatctgacagggttatcagcaaccaccttatcatcttctgctaccaaaggatcagcaacctgttcctgcgcaacttcatctacccttgtgtttccatcaccagaacagggcatacggtgaaggacctggaacactgtcggactagatgtttcaatggagtcatgagaagatgactctggcggattgaaagccaccttagatgctcgatcggtggtcaacaatctctcctccccccgattcttctttttagactttcccatgtctccaaacacaggacatagaaagcccagaagatggctctacttacccccctactgctacgagaacggccacaagagctagaactcaagagaggaaccctaacctgcaacaaaccccaaaggaaacggtccaggatctccgttccttgagaagaagagaccaaacagatataaaggtgtgcagattacaatgagattcacagaatacacagactcattctcaacaaataaactaagatattacaaaaacacaaaggaagccactgaatcgctgctccgggaatcaaactttgaagaagaaggagcaaagaactggtagcctcaaactctgcacccctactcagaacaaggactgaagacaactacttgtgatgagagaaaccacctccactatctagcagccaccaccagttggggatacggagtgcagtgaggaagttcaggccccaccgtgctcaactcaagctatcggcctcactacttgaatcgaatcccagacccgaagacttcctgtgccctagcgccgctgctactgactccgcttgactagaaagggtgacgccgaccttcgtctccaccagagaaacaaaacccaaggcttcaaagtcccaaagctcgtcggaggatatctctcggagccgcgatgagaaaccaaccagataagcacggggaagctctctccgaggtcgcgacaaaacccagtctacccttcttcaccgagaccgactgttatctccgccaccacagggtggctaagaatggccgagacccttaaaggtcggcctcgagcttctgctttcctcctccaagcactggtcgagagaaaaatcgcaacttttagtgatgtctaagagagaaggagagagtgagctacttcggaagtgatcgagacgcgaagggagcaagtggccgacaggtccgccacgtggcagctccagctactccactccaccaccctctccactacacgggttggtgattccctccagagagtacaaaccgtcacctccttacaaacaaaacaaaggcttcataaatgctataccacctgcacccgcaagaactgctctacaccttatagcatcaacaatcaacagccaaaacagcaccaaggggagaaagcgtaaagggaacactacggcttcacctcaatcttccaatccgatagccatggctacagggaagcacccaagggatggagattttggaaaccctcatgttcttacgtttatgcactttcttccttcatccccgttattcattttatatcatttatagtactggctacgtactacaagtatagaatagcagctgaattggaacgtggagcaatcgagtacatgaagttgtattatgcaacgaatcctcgaattcgctctctttctctgctgaagctgaaggatgggaccctgtcttaatcaaaagaaattctctcacttccacccaattcttgaatttactattgtaaactgggggtgaaatggaccacttcacttttcgattcaattgaccaaaaaactctcatgccttcaacatggtgccccacgccgtcttttcaacaccgaaattgtatatgataacaataatttgggtttttcttttgggagggtggtatttctataatagcaggtgattgatagttttctttatctttttgcctttgaaaataatacatcagaacattagagaactagggacatggcatcctcagcacatgtcccaccaagtaatcccaaaaatacaaaaatgtaaattacagccacaagaacaccttcacaaaaaccaatgtacacaacatacacaaatctctagtctaatgcatcgcagcttcacctcaaaagtaaacaaaaatacacaaacatcatattacgaagtgctggctgggtgctaccagtgcagcatatgcataactcttttactaagaccaatgtggccattttacaataagatcttagcactattttgcacaagatgactaagggcaggcatttcaacctacctctctcccttaatccttcacactagtgacatttacttgaaaaaacagcttttcaattaatgaaatacaaatttacataatccaatcttccatattttatatgtgtattatactccgaggtttttgcctatcactcatccattagaatcagtcgatggagcatggacttctctgtcaccgccagcatttgactctgcagcaagctcaataggggttcttccctgctcatctacagctcgaggatcggctcccctgcatttttaaagattcagtgtcattcaatgaaccatttctttaaaataaattcagaataggtgcctggaatggtcattaaatgaaattataagtgtgaagctgactattaaattgttgaaaaaaaccagataaaccatcatataacatcagactcacctagaaagcaataatcttgcaaatatagatcttcctttgagaatacagcgatgtagtggtgtttgacctctcgaatcagttgcattaacatttgcaccatactgtaggaggagctccaccatgccaatatctgcagtttcacatgcgagatgaagtagggtgcacccatctagattgtccataacctggccttctttagtggaggaccagtccaatgtgttccctgctagagtagagctgtgatcatgactagtctgctcttgtaatagcattactttggcaagggttaaggagctgctgcatgttggctcataaacagcattaacatcaacatcagaattaacaatgtaacggtatacagcttttttatcattagcatgaacagcctcccagatttgttgtgctaccaagagacggtattgattgtcctttggattgcgaacaaaaaacttctcagcatactgccatgaaaaaacaagtggttcagggagtctgaaatacagcaattagaaggtagcataaaaggctcaataataaaaaaaaaaaaagtaaatacataaacacagttaatatagtaaatatatctccaggtgcttggccttacagcccaaaatgcaaacaaataagctatgcattgctgtatataaatcaaccaaaatctcaagtcaaatagagatcaccacctcattcataccctctggtcattttaaaagttaattaaagagtatgctttcattaataaataaaaattataagcactcagcagtgacaatttagtctccaagtttctgcactagttttgtctgggaaatatatccaattatcattaagttctgctaaagagcttagacatgagatgcatcactttcgtttgatgcctaggtaggaattctaattgtgagaatcctactttcttttcttttttctacagcttcctcagtctaaactctcatctggatttatgtgagacatattactttaaattagaccaaaatcaacaaaacattcttcctcttattccctaaatctcaccattttacaggtcttttagaaaaaaagtagctgaacatctttctctgttagaaggagttgaagtatagaggcagagtatggtcatacctttgcatggatgaacttttccttcacagatagagaatcagattgacaaggtttggtgatgaagaacatcattggtttatcagacttgcttaagcttcaaattagtagaagagaatatcagcaatacttgtcaaacaataataatagtaataataatgggtctaatgcaaagatataataatggggattctttaccctgtagggacaagatcaacctgaaaggcacttcttgattgtaataattcctcccatactgagttggcaaaagtattcccaagagactgaaataaacttatgacagaaggttcccacactttaacatccaatgtaagagacctgacctgtaacaatagagaaaaaggagttagatgatcaatatattacagccccatcacaaaatagaagtgacagctaaaacttaaatatctaaccagctataccttcaattgcaatcatcatcacaatattaacctctaagttactatatataaaaaggcacttacgaagtgggttgcattttataaaaacatctatgaacatttgtgtagtttattataaaagttagatttcaaagatatttcttttataaaagaatttatcagaagagattagagaagagaaataaagaacaggagaatcaaaaccctcctaaaagaacaagataccagtaaaaaaaattacagggaaaaaaatcctgaaggaactctcccttccctctgtatatccaataaaaaattctgtttgctgatattggatttctaagaattaacaactagggcaacagtggctcttcaaccatagttatttcacaaagacaaccaactgttttaaattacacaatttatatcaactcctttttcttttattacaccatgctcattgtcaagcatcaaattatattcaagagtgaacaaataatttgcagatataacataaacaaggatcaagagaatggaattgtatggtctacctttgatatgtgcacaccaaggttacgatgtacaccagaacactcaatgcaaacaagaacaccaagatttagcgatgcccaatctggttcaggagctccacaatcggcacatttatcattcccacaaactcttcgcaacacatctattggcttctcacttttagtgcaggatcgctgctgttgcaaacttcttgaggggcgctccagatgcgcagcagtaaaacttctatctgctgcacattcttcaacagcagagtgatcaaaatctgaactttcaaaagaactactctcactggtagacctatgatgaccacttcccattgggcttgcaggcaacatctgataacaattgcaagttgcaacattaatcaaattgacttaaattttatttctacacgatcaccaaaagttcttggaagttaccctatcaggaatctgagaactcagtaatgaagcaataacaccagtgattttttcaatccaatccatctggtccagcgcactctctgcctgcactgacaagcataattaaggaatgaaactataaagctttaatcagcatccttgtatgaataaaaaaaaatccaaaaagaaatttaaataacctgcaaagtgtagttctttgttggtgaaatgatccggaagcaaaacctcaaatctgattggtcagcatctactttaattgttgacgtaagcaagttcacagtgtggtgagcaacagatttctcatcatgtactccaccatgatgatgagaagacagccatcgacttaaaagtccagaaccaagctcagaactattcctctggccagaatgttgactactagacccctacacatgaaaataaccacaaacatgaggtgaaatttgttataaagaagcaattattttaggctttaagtccttcaaaaaaccaacttatttttcacagtacacttcttacagatgatttgctgcactgtttacggtagtaatacagcattccccgactatcaagaacaaaaaacctccttttccagtccccccttaagtttgaggaacgctttgagagatagccttgtcgaatagtttgaacctaaaatgatgaaaagacaagaatattataaaaaacaaccactaggagaaagtaattgttaataacttcaaccaacaatttccaggcctcaattccacctttcccttggcagcagattgcataactgcctctatcatcttatgtgaacttctaccaatggcttgtataccatctccattaggagacccattagaaccatttgaagcccacctactctcccgatcaatctgtcgtttgtactcttgcattctttcatttagggctgcctgctcataattggacctttctcttgattgctgagcataagtcaagacctgcaaaacaactagcctggagtgaatcaatttattttcaccgactcaaatgtctgccaattaatcaccctcaatgtaccagttgataaatgtttttataaatgacatgtacttccagaaaccaaaatatgagtgtataaagacaaagttgattccaaacctggttaatatatggctccatttggtgcaacaattcatacccctacaagtgaagtaaatttaagatgagcaagttgagacagaatgtggaaaagaataatttaagcaatatgtctacctgtttgaagtaacgaagatgtgcatccatggtcccactgactgcttccaaaaattcaaatctcttctttgcttcaacatttgacaaggcagtaacctggacaaaagactctttgagttttgtgaaaacatatgtcatggtaacagcaattatttatgtacttccgatcaaatgaatttactaaccagattaaaccgagcttgctcaaatgtagatcttgcactatgaagctcctgaaacatctccaaacatttgaaggattaaagaatcacatataccagagtgaatctaagctgaacaaacacataagacacacaagggcctacctcttctagggcagtagctacaccagtttttgtgccttttcttagtgacagaaacctttcacgagtctgcaagaatagcatatttgccaatcattagagaaactttattttgcagcttctaacactgttggctccaaaacaggttactataggtgtattttaaaagctttggttcatcttagtagtcaattcaaattgttaaattcattatatatccattgatttcattctacttgaatggatcattatcataggcagtatgcttagcatccatattgttcaaagcaagaggaatttacatgggaaattagaaataatttgtgattgagaatgcacctggtcataaataaggctagccttgtcaaagcgtttccgtgcttcctgcattaagagaggataccttaggacagaaactaagtgcaaaaattgctcacagaaattttaatgttggaagtaaatatcaactatcctcattattaggtgatatttagagtcaatattaccaaaataaaaccataaatagcctataaagtttaaaatgcttcctataatacactaacaaaatcataacatggaaaatgcaacctaaatatttacctcatatttaaagtggaaaatcttaaaatattgagagttgggagagaaatttagctcatatgtaggatcatgctgttttgttaaaagaaccaaatatttgacaagcttctacaggagtgacatctgtccaattttttttatagaatctagaacaaaaatagacaatactactattcttttcacaagggcttcaagagaattccggctcgaatcctaaacctgtgcatgtttggattagcttattttttttggcagctccctggccagtctgctttgcaggcttattaaccgtagaaatcagtgaaagtaaagaacctgagaaaataaaggggagagaaagaagcggcgcgggggaatcagacctataggctgcagctcaccaccaaatgacacgtcaataacaaaaatgggtacaggacagatgttaaagatatatcgataaggcggttaattcttataatttaaactctcccaaacatcctagtaactaaccaaagaaacgaaaaccaattaagagcaaagcagattctaaatagaacaaagtcactcaaaagagcctattacttcacaggtttacacactcatactagaaaggtatatcaattctcacatcagttttgtacacatctaactgacagggtaaacaaaaaatattacaataatttttttctttagaacagaaacaagaaaagaaaaacagtaccttgacttcttgtaaatcaatattgacaaactgaagcaatctgtcatttaacatatgctcaacctgacaggaagaaaacaatctatgttaacagtgtagcagacattgtgttaccaaaaactgatggataatggccaaaaaatccaggatgaaacttccaaatagccaactgctaaacttcataatgggaaacagcttccaagttgtattctttacaatttgacgtatgtattggaaatagatcataattattgataactaatttttccccttcttggaaaggaagaaattcattaagataaaaaaatgttacagagagattggagtaaaagatcatccactttacattttctctctttaaaaatgcatcattaggagtcagtaacaactagagaagtattaaaaaagcacttacaagtacaacacaatggtttacctgtgatcgaaggacttccttgtatgtcccaatttcccttaaggctatggtgaatttggtcataacagggcctggaatagaaactcaatcataaatcattgcatcatcattagacttttagagttaaaggtaacatacagacttaaaatcaaattatgaagtcaggtagtcccaagcacagtcagtagtcactaaattatagagaaaaactgcaagcaaattatctcagtaagaattaaaattattagaatgaaagtattaaaagtcatcgtttttatgattgacagcttatctgcggtgctaaaaatggaaacataatcaactaccaggaggaacagagaacctttcatcaaccatcgtaagattgatgtaaaaagggagcatacctccaaaagccacactgattgggtcattatgcccaccaccaaaagtttccaatgcacttgcaaatgcaatatctccatcataggcctccccaagtccttcactggaaagtacaaaggtaaagcaattaaggtctataaagaaaatacatatctaacatcttcaaaatcaatattgaatgtcatgataagctgtgagaaactcctaacaattcataagaacagggagaaaaaagcactaaaattttcctttggatgattgacaatgattgttgtataaaaaaataagggacatccaccatagaggatataatagtgtaacccaaaaactattaagtagttggatataaatgttctggaagataaaaaatacgggatgcttttgaaaggagaggttcaatacaataggctctagcttgaaaataaaatgccatttatttttacacggcccattagccacttttatatagaaattcttgtgtttaattccaaaggtttggcacaaatatgacagttaaaatgttgcattaccatgcagcttatgctgttttttggttgaaagggaatgcacctatatacacaaatacttttctgctcttaaacatgctgccacatatgatagttttcatgctactctttggtgttctgttatcttgattgcttttgctgtgatttatttagagcctttctcaaggacatctcaccctcttcttttatctcctctgcattctcattataaaaactattttttctatccaaacgacagtatatttgaagctgatttcatctagtcatgaagaaaacaaaccataaaaactgacctagaaaataacagataaaagagctaagctaatccagaactaaacatttgaaaagaaaaaaacatgatacttaaagaataattaaaaactgcgatttgcatgccagagatgctttcatgaaaacaaggataagagatattatgtgagcaattcatcatgttctcaaaggttcatggctttttagtaataggagttaataatgataagatccaaagacaaggaaatacatacgtgtatttctacatcctttgtaaaattttaaacttctctctcttaaagattcagcactttcctccatgcattgtatctgttcatcataaaattcaagaataaacaatcttaggatacatcaaattggttaagggagaacctaccaatttgtattatatgaaacttatgaaacaaaaggaaggaagtgaaaagacccacatctatgttgaatgtggcacagcaaacaacaaattatcacacatgctatgcaaaaataacaacaacctcagagaagaaccactaaatttctatatttacagtgaactccagttatcatatcattcaatcaaaaagcaatacactatatttcagaatcacaccctcaaatggtttattagagcataaaatattattacatttcagaatcttcaacagaacccaataatagaaaacaatggattgtttaataaaagaagaccaatatgacttaacatagtaacagggaagaaattgttaagctggtgaagtaactggagcaatgcactaaacaatctatataagaatttcacataaggataagtttagtttgcaggtagcagggggggacagatttttcaaggagtaaattttaagaatatacttatgtttggcatatcagtagaagatgaggaagctttcttggagcaatttctccctaattagggtttatgttgcttgacagttgatgcctctctcactctcactgctcacccaagctctacgtaaatcccacccatgatgcctgatcaagtgtgccaaccatccctgactaacctcatagaccagcaaaccgtaaattaattcactgagattctctttcagatactggaaccttccctctccatgtgtggcagtagtacataccataaatctatgaagggaatcaccatgccataacccattactagaaaacagagaatcccatgaagggaactacttgtttcccttatctgggatttcccagaattacaaaaagaacccttaggattccaagcataaaccaagcttgaaacgccattcaaatttcagaatattcacattccacttgaaaagaccacaacatgcacaaaatcaagcttccatttccttctatgttactcaataaaccactacaaccacccgatcaagctcaaaaataaacaaaaccctgccttatgcatacattacacacaccatcaaaattatttttcaacaaatccaaaaaaaaaaaaaagtttctagaaaaaacaagagcgcgtgacctgcttgcggaacataggagagtcatcgagcttagcgaattgcatttttgattcgaaccgaggattcgcacgttgttcgtgttggtgttggtctaagagtaggtatggtttagcattatcacgccatgaatgttcgatctcggaatcgaagtctcaaacagcaacaagaccatttgcagcggcctcaagctcacttcgatttggtcgcgaacccaaaaccctagcgcagagacaaccttggagttcgaggttgcatatgatttgattttgatgtgtgttgggtattatcacttcactatttgtgtgttggtgtcactgcttcttcttcttctcacttctcatcaacggaaatgaaatgaagaaagaaagaaagtaaaaatatattgggaattgtttaacgaaaattttcactaatccaaccaaaattctcgaatcgcatgtgtaacagacactcacttggactaaagtcacacccattgagttccttttcatgcacctttccctttcttgcccccttctttttctttttttatctttcccttttcatttttttcgtattttaatctcaatactataataccctagtaataattatcatcaccttgaagaaccagcttagtaagtgctgtcaaacttgagtttttgggtacaaaactttattgaaaatctggataaagaatattattttctatccaatttgaataagctttttgttttagaaatattataatatgtttgaatgagaaaaaaatcactatgataattaaactaaaataaattttacaatctcattgtgtcgatcaattgatcaatgtataaggtggtgagctaaattatttctatacttttcatactcaagacaataattctaagcttcacaatctcttgtttcaattgatcgatatattaagtgatgaggaggattatttttccatttttgcactaaagacaatagatccaagtatttaacagagataataacccccacaatcataaaacatcaagtgttcaacatactcaattatgagcaatattatctttctatttttgcaataattttaaatatttaacagttatatatcttattatttaaaattatttatgattaaattataattaattttggatcaatataggtgtgtgatgaacaaaattatttctttactcaaataaaatcatttctcacaaaatgtttttatccgctgaaataagattatctgcagaaataaaaaatatatgtaactccgtaccaaaagaaattaacatggcatattagttaatatatatatatatattatatccgcaatatgaattggattccttattgcaactttttactaggagttaaaactgataattgaaatattcctgtaaagaaaaaacaacgttgtacgctgtcgtacgagacgagaagtgaacggcgttattattctaattctaacctaatctaaacctcttgtcgtaccaaaccaacaaggaggccttgtttgatgggttgtgttggagcacgcgctacagcggagcgtggaatgattaattatttcagtgaactatgaaagagggaatggtttgtggggtgcggaagtgtccaaaactcagtttccctccatttcctcgaccgtggatggggcccactctcccaggctcaacaacaataatattcttctttttttaaataaaactgtttttctctttcttttttgcattgtgttattgcttattcttattttgggtatgcaagaaaactgagaaataatattgaagaataatttgatatttgttttgtgggattcatatattttatattgtattttaatttaattttttatttttattctctatatcaaacatgctcgagatttgtgtcgcttgagatcagaatgtattatttacataagtaattataattaatgcaattaatttataagtttatttaattgaaagaaaagtatttgatgattggctttattttaatatttttaagtttcttttagacattttttaaagtggtatttgaattttcaatttatatttataatttataatgttttatttttattttaggtattttgatagaatttcctatttactgttttttaattttcaataaaatatttgatctataaaccaaaaatagttcaaaattaaataaaaaaactaaacttataattacctaaaagtatatttatccaaaaattttataaaaataatttttataatatgtttttagtttaattagttagcttagcaacattttgtttttaattaaaaatattttttttaactttcaatttatttttcaattaacttctcaattgttttttctacatataacaaagtacattacttacgatttattgagaatcaatctttaatcgtcagttttgtaaatgattgaaataatttaaattaaagtttactcttcttttgccctttaaatataacgttatgtgttattgtgtgcaatttaaaaaaaaatattaaatactagtagttcatcaagattattttccttagacatattagttcctctctcagtgtaacctcgtttaacataacgaaaatatctaagttggcacattaattatttcacacgttaattacaactctatttgcctataaaaaaaggttaattacaactccagttctccccagtttccattgagtaaaatgtttttaaaatgtcgaataaagactaaatcttgttgatacggttgcacatggtttcttaaatgatactattagctttgtgcttaaaatggaaaccatgactctttatatgttgaaaaagtactataatcaaaagtagttctgattttctcatgcaagaaattcaccttttgctgtatattattacattaaatagagttttgtgaattcactccttgagcataaaagataatcaagtctttcttgtacctcattacgagtgtcatacttgcataaaaaaaaaatacgagtgccatacaaattattcaaaaatattcacatcaaagcattttctcagagcccaagcaatgaaagaaatttaatttattatactcgtgaatttgagttccaatggataattgattatccctaagctatcttgataatcgccaaccaggtcttaatcaggataacctgtgatataatcagtgaagaaatgtcaatatccacccttgagattattgttgtttcaaatatggtgtacaacttcttttacaagaactcaatattatatagagagtgcataattgattagcattcaaaagactcctatcttgtaaaaaagggaacacctatagtcatcagccatcaggcaacaattcataaaccaaatggtattctatgcctatgtgtggaaaaaaaattatgaatttgttaatagactggtccgtgatcaaatcaccttttgggtttcaccaagagcaagattttggtgcctaatagggtgttgggaaggtttcagggcatagtgatgattatggaaaagtgacagagtggcaatagagaatgtgggaaagacattggaggattataaaaacaaaaacatttttagatatgagagattaaattatattgagtaatttcttttaaggaccaaattgagtccatattaagatctaaaaaatatatattttatgcgttaaaatttatgagatatcctctcaatttctcaactagctaacacagataaatactttaataaagttaaacaaatttcaactgacgagaggttaatgtgttcaagtgaaacaatattaaaaaaaacttatttgggaattttcttcaaagaccaaattaatgcttatgttatttttttataacgtaagtttaccatttacgaaatcaaataaattgttttacaaattcactgcttgcgaaaaataaattgtcaaatctagtttgatacctaagctgagattcaagacataagggattggttgttctggcagagcctaacttaaataacaatagtttatcaaaaaaaaaaaaaaacttaaataacaatagaatagcttgctaaaaaaaagatatgaaaaataataatatatgaacacatttaaaatctatttatttctatctttatttttttatcacattatattattttttatatttatattttttctcttttgtttttttctctctcactgtcaaatagcatagaatatatatgcattattgttcagtattcatccataaatttgtagaaagatgacggtgtacaagagaagcaaaatattataagagcacacaaacaagagacaactaataaaaacaccttaatttataatatcacccaagatatgcacaggtgacaggttctaaggtgctaaagatgtatccttttttctaattaaaagagaaaaacttccctcaacttagttaaagccatgaatctagacagaacatgtcacccaaagatccaaaataaataaaattaacttaaggttaacctggtctgttccactttttgcctttggtgctatatccgtgaataccagggaaagtaaaacggactaattcgatgaacttgacttctttttctaaatagtaaggttaactcaactaaaaaaaattgtggaaagatgacttatacgagaggcaacatattgcatgagcacgcaaagagataccactaataaaaatgtaccttaattagtaatagtaacttcatctgtacaaccgctttattgaccggggaaagattcatataacctcactgaaagaagaaaataaataaaatgcagtaacctccaaatttgtgtataaaatgccttagtgcagtagtaaaccacaaaaaagtggcataatgcagacagaagattaaaaaaaaagggtaactagtatgatgttcatcttctagaaactatcctgagataaattatgggaaccactattgttgactccaaattgttatgtacactattctattcggatcctccttgctctacaatttatcagcaattctccctagagcatctgcaagcttatcaagtacagcaactatgttacttgcagtgtctttctgctgttggcgatccaactggaaattcaggttctgagcttcaagttgatcatgtagcattttgccattcttttctaagacatcaattaattggctttgcaaagtttcctcctctcggtcggctgctaaccgcttcctcttccgttccccttgagatatagaacccatttctggatttggggttgcccgtttctcattggtagtacctacaaaatcaaggaatgtcaacattgaatttgcaataatatcatcagttaagtccttgacactgtgattgtcaaagtagaagctttgatcctattcttatacctattataggaagctacagcctagctagagctcataagtttgggtaatagcataatgaaagctcgtgcctaagacccagcttgccatttattattagagaataactttctttctgagacatgaattgtgaaagatagttgttaatactattagggtaggcttaggatgtggaacgttaaaagaaaaagtgacaatgagacctagagcgcactacaataacttccccagagatgtgcaaacgtaagcatgtgtattgtgtaagcagcactactcgggcaaatatatgactatacatcattcaattcaatgaatgcaaattccaatcagattcctgagcatccaaaatagcttttttacacatgcatccaagataattttaagtaaacaatcatacattcatacattagatgatccaaaagtagaagggtaggcttattgcaagcctattaccattttcatcttcaaataacccatcattttgtttgtactagagtggacaaatttgatatgcaagaatcggatttagattccagcaaaagcaacatggtacaagaaatatggataataaaggaatgaaaaaaaaaattgtcctggcattactgaaattccaaatgtaataacaaatttatgacagaaaataggtaattttacatgcagttagaaattagaatgcagcagcaacacaaacatgggaaacaaacacatcggacaaggtggcaagctgtcacaaatgagtttttagcttgctttgtttagcactgaattcatgatattttaaagacatggaaaggacactgaagtagcttccacatttttgtttggctatcctatcattgacattggatgccctttaacaaacataggtattaggtttagggcctactacatcatgttggtcatatcaaaatgaccatgggcctaagcttttatgccaaaatatcaaggctgtctccagaacacaacaagaagccatttcgtaaacaaatattaaggtttcaactttcaattgagaatgatgtcagtgctaatactacagctaatcatatcattccagtcttaaaactaaactgtaggagatataaggttggtccagggattggaaaagggtgaagggaaaaaaagggggggagaggttgcaagttcaaatctccccaattgacatttatagcaaaactaacaaagtaacatttgcctgtaaaaaataaggatagagaacaatattaccttgagggtcgccttcccctttgcagccttggagatgcggctgatattgcttctctgtaaatcaaaacaaaaaaaaaatcaagaaaaagaaaatatatagaattgaagaatgccacttgggaatcccagtatcctcccctccacattccactgcctccaactttacaacaaacaacatcattgctagaatcaaaaaataaaattaagaaaagataaacactaaaaattagtctttcataaaaaaagaaaagggtcccaaaagcaatgaaagccagtaacattcctagacactttccaactttacgttagacaacacaacaacattagtatataccaaaaaacaccagacattaccaacaacaacaataatatcaaccaaatctttttccaccaagttgaaaccgttacataaatcaaataataatgccataatatttaactttgatctctaagtgtgtttgagtgagcatttgcaaaattgattttgcaagattaagtttggttgaaattgatttaaactgaattgagttatgttcaaaaagctaacgcatccccatgttcaaaggctccttgccaagcaatagagtaatttataaatgttttaactctaaaacctattcgtaggaaaactctatataaaaaaaatatctattgcaaaagtttgtaaaagttatttactcaaaatcaattacaaacccagaatcaattcctcaacataaaacatattcagtgaatatattcctaaaatcacattagttgtatttcaatgtaactaaagataatttaatgcgaatccaaacacattctaaattcctcttagtgcctgtttgtaattccgttgaaatgaatgcgatgctaattgcttctatgtgttttgccttggaaagtgtgaaatgtctgatgaatgtggttcataccgttattcaaaactcttaagatatgtttggaaaaccgttagaaattccattgcacgctttccaaaacaatttctcaccttcctagacattgaacgtgagagcaagaaaatgttccatatccattcagcgtaactcaaagtttatacaaacatagtcttagtagtttcaaaattttctgagtcaccatcctctaatactcttcttactagaagatcaatagattttctctacacatgaccccaatcataagacgagtttctaccatcaatttcaccaacataatttttctacaatgcaatcattcttgacaaataaacaatacaaaaagtgggggcaaaaaaaagagagaaaaccctaatattaaaataatagtagtccagaaaatcagagtgtccaaaattgaacctgagataggaacaggtgcaggaacatccttggcagcggctaaaagtaaaccctcgtccttctcagaatccgagaacaacccatcctcactcccaaccctccgattactatcatagaggtgcacctcctcatcccccgccgccgcctcctccgccaccgccaccggagtctccgccgccgtggacgacggagaatcgagaatattataaacctccctgtcaaaatacccaggcaatttcctctccctcctcaaatcgttcctcatgagccaaaacgactccgtttcgtccctcacctgcgactcccactccttgatttttttgtaatctccggcgaggttgctccaccgcttccggcactgtaccggttcccggttcacgccgtgcttcttgcagtacgacgacaccaacgcccatttcggttcgctcgaaccaaacgccgaaccgctcccccgacccggcctgaaccggctttccgcgtcgctctttccctgaatcagcaccagaatctcctgtcgcgtccaccgcggcagcctcgccgccgtcctcccgtcctcgccgccgtatgcggcggagcacggcgtcgcgccgttaccggcgccatcgacggcgttgggattcgaaggctggtccagagccatgggaaagagaattgacaaaaacacgtgactcgcacgtgagggtttgtgacggtgcctttgggaatgccagttacggcgttaagaaaaagagagggttaggtttattgtgtttttctctcccaagaatgaagagagggagagaaagaaagagttgtggcttttgatagtgaaattggggttttgtttttaatttttttactactacactaaacaaacttttgacccttaactccttaataagggttttttaattaatttttttaataataattattaattactatttattggggtcatatccttatctttaattctcaattaatgagattttctttgtttgcaaaggttacttgttgggttggtttgacatcaaattcctcaaacagcactttcatttcgctgtccatccttttagtaattttctaattcctgtttttggtcattttctaaagggtatgagatgtgaaataatggttatggtggatttcccttcctgtttgggggttctatatacgtgtacaataccactttcaacctcttgatgttactatgggcaattgcaaatttaccacatcccataatacccttgttttttatttattaagattttagagattttgatgaaggcttgaaaatcttccatcaatcaaaggggaataataccgaatccccttttaaatagtagttattcattgatatattcacagaaaagcattagtctatggcaatgtatgatgtgtggaccatgagttgacaagggcatgctaccctaccactcagtaatcctttccttcctttctcaacctcccttatcttatcgaataatttccctctaatctttgcttaatgcttaatgtttgtgcttatggatggccccctccaataaagccactttcttctttttctttgtttgcactttgacataaccttgagggcccatgaatagctactgttagggtttcttttaatcctatttatattccccttgtaaaccgagtgacttgtaacgagtggcggtgaggagattatagtacagacaagctggacgtagcctacattggatgaaccagggtaaaatactgtgtcatatttctcttccctattctcttttctgttttatcgatttgtgtgtgattgtcgatttccaacagattaaggtagctgcactgataggcactactctcacactttggagtaaatcaaatataatttatcacccacctattacgtaaggtgcaatatatatattaaaagaaaatcattgtttattacctagcagaaaaaaattattactttttcttatgataatactggtcatttatagatcgaatgattatagattttgataaaaattaatttggccaaaatatattctaagtatctccaaaatatgattttttctagttttagtctgtaaaaaaatgttacttttaaaatttttaacattttcttgcagtaatttttttgacattttcttagtgttctttttaatccttattattaattatagttaatgtaatattcacatggctaacgaaataaaaaaatgttaattgacataattaaggtaacaaataatatttttaaattaagataattgcattattttaagttatgtaattcaattaagtaacgtatttattattttatataaataagataattacatataatttattttaaattttaataattaagaacaatgacttttattgtttttaacattgttcttgtttttcgattcactaaattgctttttaacagctaacttgtaaaaaatatatataatttacttaatgcgtttacaatacataattttttaaattgattatttatcttaatttcgtagttcctataatattacaaagattttagagcatttaatataagtgtttaacttaattttccttatttttatgcaaattcttttatttgaaaatacatttttatcaataaaatttgtttagcagcatcatttttgtaaacagcaatacttgtaaaacaaacaaccccaacaatgatccaataatccattttgtgaagtgatgtttcttatttttaagtaactcgcataagcaatcgtattatataaactttttttggtttagaatttattttaatatattacttttgaaattacttatacattttcaattcattaattttgactgtttgtaatatgatttatttttctaatatttcacaaacaattattgtgtgtcccaaaacatatattgtacttttctatcattttttactctatcattttttattttattttatttattatttttaaaaaatagagggagatggaatgcctctctttcccagtaataataataataataataataataataataataataataataataataataataataataataaattccttttgaaaaaataatactacacatagggtggttatcccttgaatctgtacacaacataggagtggctattgacttgcatcccattttttgcttttcacacctccaaaattttcaatacccccgcttatccttctcctctctcccctcgctcatcctctccagcatggacatcaccactcctttctcgtgttaggccacaacctcgtgcttctcattttcaatttgtgttctggattactcaatctaaaatggttatctggtttaggatcctgataaagactctctccaagtttccgatgaccttctccaacaaattgacaaaggggggaggtggaagaaaagaaggagaatgaggttgcttgggtggcacataaggaagaagaggtgctaaggttgtgggggcatttttgtccattcaaatctttttactttcttatggagtatggaggacagaagaagaaaatagggtgtaggaagcagtagtccataggagtgatcttactggaccataggccattgaaataatatggtctgcgtggtattagtaagttttcttatttgaattttgtgggtaaatataacgtgattgaaaagaaaaaatatcattaaagataatctccacaacaataatcatcaacaaaatcaataattttatgcccaggccttgtgtgaaaaaggacacggacggaaagcaccaaatagaaaaggaaaaattacgttgaacatctgaatttttaatttctttttaatttctccaaattgatagaattatggaaaagttgattttttttgttttgttttaacattaaaaaaaaaactttgactaattcaaaattcaattacaagataaataaaatttaactgagaatcattttcatgattcaatcttaatttcgataccctaaacacttgtgccgaatcatttaatttgaaagttgatttttgtaattaaataacaaacattcctttattttttaattaagcttaaaaatctactttttattcacatatgttacgcaatttttatctctcaaataattttattacatatttaattagtaatgtttccaaaatttaataatatgccgtttacaagtgtgtatgtgtaatttcccagaaattggtatgtctctcggaaagtccacgtcctagtcattaaaaaatactaatagccaacccatgaacatcttatgtaatatgttacgcaattttaatctctcaagtaatcttataacatatttaattagcaatgtttccaaaatttaataatctgccgtttacaagtgtgtatgtgtaatttcccggaaattggtatgtctcttggaaagtccacgtcctggtcattaaaaaataccaataaccaacccatgaacattttatgtaattgaccatctattccccaaattcagtttcagaggccaggaagagagggagcaagttcgagtactcatcactggttttggaaagcaaatcttaaacaagaaactttgagatattcaaagagagcactcttcggtaatttcattttttctcttcgattttctctaatgaaaattactggttcatgattgcaataacacttgtaatagctgagattttctttcaattgtttttattttattttactttatttatctaattttgcatctgataatcgttggatactcgctaagtagtttggaaatcaaagttatttggtgctgtgaatggttttaactgtttaaatgaaatttaatttaattaactccttacagatacaatttcgtttcatttatttcttgaaaagtatagaggaatttattaatagagttgtaataataaagcttaactatctcaagaatcctatcttgggacaacttccacacaaaaaagaacatttttagagatgcttttcatccacatcttttcgaagaactcctcattcaccctcaaaatttttaacagcatactgaaagattttgtaattttttgtacaagtttctagtggcaattttaatattccatttatctttatatataggataccgaaattatgaattggaaaaagtagaaagaggaacagtgcattttaacttatacttgaaagataggcacatattaaaatgattttctgtttaggaaataaagaatggatggagcgtgtagtcgtaaaagaaaaagggagggtcgaccgacaagtaaatactggaatgaagctgaaaaaataggaaaagataagtggaagtgcaaccattgtgaagaggagttcgctggaggtgctacaagaattcaagagcatctcactggcgaaggaaataatattagaaaatgtcccaaatatcgtgccaatcaaggacctcacaatgcttcaagcagtccacaagaagcattgaatcaattacaaggtaactaatatgtttaacatttctttcttgattttattgaagtttataaatgatgactgattttttttttatctatatcttttattgtcttgaatgttgaaaaactttaaaccttaaagattaaatttatgattcttcttatttatatagtgtttaattttacatttttatgtaatatatgatttgtcttcatacatatactttgaatttaatgtgcgtgattgaaaagggcaataaaataatttccttttaacagaaaaagatcatatatgtaataagaagactataatgtaattacaacaaaacgatccccacaagaaccttcaaaataagctagcataagaagtcagttactaatactaccgactactagaattccaggggacaatgaagtgattgttgatggttcaattaaccctacaaacagtacacgatcaacagctttattaggaggaacgcattttagttaccattccagtgtgtttcttctcattctttatttttaatttataaaaataaaattattgttattcaaatcatgagatgtggaaagttgtaaactatgttttataataatcaagtctatcataagttaatgaaaacttggtggtttttcaagaactggacttaatctcgatgatagaaatgaaccaatataaatttttatccattattttttactatttttctttgtgtttgattgacaaagagtttgaacatgtttttagatgttatatatatttttagatcctttatttgttttctgtaaaatttgtatgagatgataaaggtgtttttggttaaagaaaaagtttaaaatttctgaaaatataattcaatccaacttcttttattatttgcttttacaatatgttttccatcaatcataaatatgaaatatttagaattcattattacaaaaaattttatcttattttttgtacttacaaaattgaaatgtatcaaattggaagttaggttccaatatatccaaacctaccacatctctaatgactatgcacatatgcaatctaataggcaattggacgttgtcacttgttaaacagtaaccctatctttatattgaatgaccattcagtcccaaatccttctcctactccctacaatcccctccctttggcggcaaaggtttggttgaaggaccctctagctgtcatggttggtgcagaggatggcggtggcgttgagggtctcggtatgatgcttccacagctaatatttcattattgtacaaaaaaaattgcccaatggatccaaaacgactatagatcccactctaaggctagggcgcgacatttcatttgagaagtccagcaaaatattttattgtcatcgatttgattgctcaccaaatgaactgcgttatcttatttcatgtattcacccaaaataaaatattatttcatacaggccatataaaagctagaagcttcatgggatggaaactcttaagtttttgtttaattttagagacccaagacttcgtccataatcacaatagtctttttcctcagttctcatggcttttccatcaggttccttttccataaactacgaggtcttcatcagcttcagaggcttagacacacgtcatggttttactggccatctccacaaagctcttaatgacaggggaatctacgctttccgtgatgatgaggagcttcagaaaggagaggaaataacaccagcaattgtgaaggcaattcaagagtccaagattgccatcattgtgctctctgaaaactatgctgcttcttcattttgtttagatgaacttgtaactatccttgagtgcgcaaagaggaaggatctgttcattttgccagttttttataaattggaaccgactgatgtgcgccatcagaaaggtagttatgtagaggcattggctaagcacggaaaaaggttccagcatagtccccagacccagaggttgaggaaatggatatcggcaatcgatcaagtaacttatttgtctggctatcatttcaatgggtacccttcctcgccaatcttttcatttatttgttttcattccagtaattatttatcacttgcctaatgatattttaatcttaaaatttaaagagatataaaatatttattaaccttggaaaacatacatatcaatacatgatatgagccaggagtttagttttactcacacaagtttctctgattgaacagggaagaatatgaataccagtttattaagaggatagttgatctggtctctagcatgattaatcgtgcttctttacatgtcgaggatttcccagttagactaaactcaccttcagatgcattcagctatgatgtgttcctcagcttcagaagcgtagacacacgtcatagttttactggccatctccacaaagctcttaatgacaggggaatctacgctgtccttgatgatgagaagcttcagaaaggagaggaaatacaaccagcaattgtgaaggcaattcaagagtccaagattgccatcattgtgctctctgaaaactatgctgcttcttcattttgtttagatgaacttgcaactatccttgaatgcgcaaagaggaagggtctgttcattttgccagttttttataatgtggaaccgactgatgtgcgccatcagaaaggtagttatggagaagcattggctgagcacgaaaaaaggttgaagcataatttggagaagttgaagaaatgggagaaggctctgcgtcaagtagctaacttgtctggcttttatgtcaaacatgggtaccccaccttaccaatctttttactttataattttcgttggaccaatttcacctgctcaatgatttgatgttaaaatttaaagacaaaagaaatgtttgttagccatgacaacatatgtatcaatacatggataccaggcttttagtttaacttcgctaaaacgtttttttgtttgaaacagagatggatatgaatatgagtgtattggagagattcttgagtgggtctctagcaggattagttctgctcattacccaggtggactagggtcacaagtgctagaagtaaagaaacttttggattttgtatctgatgagaacatatatggtgttcacattatagggatccacggaattgatggggtagggaaatcaacacttgctcgagaagtttacaataatttgattgctgaccattttgatgcttcgtgttttattgaaaatgttagagaaaaatcaaagaaacatggggtaaaacacctccaaataatacttctttcgaatatacttggagtgaaggatgtcaacttaacaagtgtgcaacaaggaatttcaatgatacaacgtaggctccagcgaaagaaggttcttttgattctagatgatgttgacaaagacgagcaattacaagcagttgttggaaaaccagattggtttggtcctggcagcagagtcataatcacgacgcaggacaaacaactgctagcatctcatcacattaatcgaacatatgaggtgaaggaattgaacaggaacgagtctcttctattgcttacatggaaagcttttaaaacagaatactatgatccaaggtatgagcagctcttgaatcgtgttgtagattatgcttttggccttccgttggccttggaaataataggttccaacttgtttggaaaaagtgtagaagaatgggtgaatgctatccatcaacatgaaaaaagtcatgataatccaatccaagtgatatttaaagcaagctttgatgctttggaggaaaaagaaaggagtgtttttcttgacatcgcttgttgcttcaaaggatatgaagtggcagaggttcaaaatatacttcatgctcattatggtgaatgcgtgaaagatcatattgacgtattggttgacaaatctctagtaaaacttagttatgctacaaagccttgttataatagagttacattgcatgacttgattgaggacatgggtaaagaaattgaccgccaggaatcactgacaaagccaggtgagcgcagaagattatggttaccggaggatataagagaagttttgggaaacgataaggtgagtgaaactcatgaatggtttagtttcgtttcttatctttatttatcttttctggctatcatattttcacatcatagttgttctttttttcttttataatagttttctctaaatatatgcattgaagtcttttagatatacttgtattgtggttgattcatgccttttgcattaacagggaactaacaaaattgaaatcatatgtttggatttacccatatttgatgaagaagtagtcgaatgggatggaaaggccttccggaatatgcaaaacctcaaaacacttattattaaaaatggtaatttttcccaaggtccggaatatcttcctaatagtttgagagtacttgaatggtggagatatccgtcacattgtttaccatctgattttcatccaaaggaccttgtcatatgcaagttacccgacagtcatatttcaaaagttgagttgactgacttattgaaggcaagtttaatagtaagtacatttttctcatcttgtaaattaattaatttacttttaaaaatattcatttgattttttttttctttttctttgcagaagcacgtgaatctaagagttttgaatttttcaagggcaactgtttaacaaagatatctgacatgtctggtttttaccaatttggagaaactttcatttcgttaaacctgtaaaacttttttaattactttttagttgttattgctgtaattatgtttctttgtctcagtaataatgctcagctaagtagatataggtttagtttaattttggacatatttgtactccaaaagatagtaggtgcattaactttttgctgactgcatgtatgggtattaaggcggactgtcatttctcttgtattttcccataagtatgaatgaaaccatagagaacagaatggacattcagtaaaaacgaaatttagtctgttctcccattttcttgtttctctgttaatggcttttatgttttatggttctgttgcaattgcatgttgttctaacacatttgaatattgtcagaatttaattacagttcacaatttgattggttttctagataaactttaaaatattgagcttttggttgcaccaagcttagaagttctcctcccattaagttgatctctcttgaaaactttcatgttgttatagtcttgagagtgtattccagtaggaaagagagaaaacacaaggaaacttcatttgcaatacattctcataaaataaatgtcattttcatttcaaaattttattggacttcaaaaattatgcatgtttgacagtggaatttttcagttactaagtagcaatacaactgactcttcttcacgtttcatgacggaaggggtgtggcaatggctaaaacaggaagatggtgaagaaaaaaagtgggttcaacagtaccttcaaaaggtagaatggctttgagcatcaagatgcaacttgtgatgaattttttcaataggtttcacgcggtttcctcatgtgagccagtggaggcaattttttttaagatcatggcttgccttttctcactttatagcaggagcacatgtatctcttagttcaccaagaaacaacataaatttcttctttctgatataatattagctaaatgttaataaataatatttttactccaaatttaagaagctctagacaagaaaagctgattttgaaattcactttttaatttaagaagagatcagccaatatgatatttaccatgcttaaataattgaggtcatattttaagacaaactggaattcgataactcatacatctaaaaacaaccagctatcatgccaccgtcaatccttatcaagaaaatgaagaagtcattcatctgaaagatatttcaattaagagagccatagaagtaaacacagatctattgatataccccaactcaagagtgaattaccatcatagttaagcactctgcttacgatataaaagaattttacgcacactaaataaaacgctaaaagaagcagatatagtagtatgataaaacctaagcagttataatttaacggctggcttatgtctttctccttcctgatcaaattgtttatcataacaagcagcctgatcatcctagcaattagtagaaggaaaaagttgaacctgaaaaaaaaaaaaaagtttagggtaatgtaaatgtgtattgactaaaatgttataaatgccttttcccataactactgaaatttcaaagcctatgccaaccaaattataaatgagaaatagacattgcaccagacggcagacgttgcagtgtctctttctcatttatccaattttaaaggagggaaaacaaattatgaatgttccaaacaatcaacaaattgctgtctctaatgattataggagctttattactcagttttgcgtatgctccgaaaatatttttgaacaataaataacattttgttagtacaaaacagaatgagtacagaccgtaatgtacaaaaagtaagatttttgtagtctacaacaatcattttgataaaataattagggatcttaaactctttctcccatagaattccagttcctaacctaacagtttacttttaatgctttgagaaaagaaaagagaagttcacaactcacaaacttcttgcaacaatatttttgtaaatggaaatctcaaattaagttgtagaaaaaggaatcaaaagtcttccaagaaaagaaaactaaatcaagatggcaaaaaaattaaaacactgtttccttcattggagttgaacacacaagactcaccttgcaataccagaattgaagcaagcaaccccctagaagacctatacaaaccaaaatggaattactcttaaccaagaggaaaattaaaccatggaaagcctgttacaaattctcgccaacatctcatttacatgcagtactgtatttgtacaaaaagattgagtcacagttctatcattcattcaatccgtcacttgatgggtaaaaaaaatcccaagtttgcagcaagcaacaacactcattattttaagtttatccagaaaaccaattgagcagtacctgaaatgtaataaaattctcatagtattcaaatgaaagttccttcaaatttgagagaccagatacatcagtccggaacgtgagtaaaacattgcacatacaaaattcaaaacagttagattaatgaacttctgcaaaaagaaaataaagggggaaaaaagaaataagatccaaatgaaaaatcttacagtgaatttattaatttacaagatgaggaaaatatattctttaaacatcccttcaataagcctccaaaattcaatgacctgatggaactattgggcagcttgcatatggctagttctttggttgaaaatcagaggatacctccgcctgccattccagtactctcaaactttcaggtagataatttggaccttgggaaaacttgcaatttctaataataagtattttaaggtttttcatctccttgaaggcgtttccatcccattcgattatttgttcttcatcagataaagggggatccagacatataatttcaatttcaccagttccctgttaatgcaaaagacacagttcaaccacaatacaagtagatgtaagacaacaatccaagtatttagagaagattacaaattgtaaagaacaaaaaaatcaactaggttgagaagatatgatagatgaaaaaagatgaatcaagataagaaaccaaaccattcatgtgtctgactcaccgagttgtcttttaaaacttgaactatatcttttggtaaccataatctcctgcgcttccctggccttttcaatgatttctgccggtcaatttctttacccaagtcctcaatcaagtcatgcattgtaactctatcatcactaatatgtatgagagacttttcaaccaacactgcaatatgatatttcatgcagttatcatagagatgatgaagtatatcttcaacctctgtacattggtaccctttcaagcaacaagcaatgtcaagaaaaacactcttctcttcttcccccaaagcatcaaagcttactttaagtatctctaggatttgattattaggaattctattgtattgtttgatagcagattcccattcttttatactttttccaaacaaatcggaacctattacttccaaagccaatggaaggccagaagcataagttacagcatcttccaagacttccgtgtaacttggatcagctccttctgatttaaaagctttccatgtaagcaattgaagagcatctttcttgttcatttctttcacctcatatgttcttttgacctcatgaaattccagcagttgtttgttccgagtggtgatgatgactctgctgccagaccaaaccaatcaggttttccaacaattgattgtaattgcttgtgctcgtctacatcatctagaatcaagagcaccttctttcgccggagcctattgtgtatcatggaagtaccttgttgctcgctggctaagttgatttccttctttcgaagtatttgtgaaagaagaatgttttgtatgtgttttaacccatgtttgtttgattcttctctcacgttttgaagaaaacacgaaccatcaaaatgatcggtaatcaaattataaacagctcgagcaagtgttgattttcctaccccacctattccgtggatccctatcatgtggacaacatcaacagattccagctctaaaagcttccttattttttcacttgtgaccctagtccaacaggcgaatcggcgagatgaatacttgcttcacggtgattaatctctctgaagatgcgccccacaatcttctcaatacagtcgtgttcatattcagctctgtttcaaacaaacaaaaaaagttgaagttaaactaaaatccttctatggatctcttggcacgtgtgctgtctaggtaaaaaaacagatatttcttttctcaaaaaaatttaagagtcgaaacaaatcattaatccaacaaaatttacagagtaaaagattggtatggtggggttacccattttggtaatcatagccacgcaattcagctacttgatccagagccttcttccatttacgcaacttctccagttaagatccaagctcttctggtcagctttgaaccattcttcatgctgagctaatgcgtctctataacaacctttgttctcgtgtcgccgcacatcagaagttttgacgttataaaataccggataaaccaaccgatcttttcccttaaggcacttaaggatgtaggaaagttcttctaaacaaaatgaggaagaagcatagttttagagagtacagtgatggcaatcctggacttttcaattgccttcataagtgctggcgttatttcctctccattccgaaggtcctcatcgtcaaggaaagcgtagattccactttcacgaagagttttgtggagatagccggtaaaaccatgacgtgtgtctgggcctctgaaactgaggaacacatcgtaggtgaattcatgggaacgcgacgttgcagccattagaagaagaaaaaattgtgtgattatgcttggttgctgggagttgggactctagaaccaaacttaaagatgaaattgattgagcaaagtggtagactgagtacctgcagatatatatttttctgacatagtaccaagcagaaattattatatccacttggtctaacagtgaagagtttacataattaacagaaaattgccttcatttaaacaagacaaaaaagaaaataaataaatagtcgtggaaggtttctcatgctatagtgaataaaactaaaaattcgttggcttaataatttcaaaagtcaaaagtgatgtgcttaactttaaagtgaatttgccaacaaaaaaaactttaaagtgaagaagatagctggtcccactgttagtattattatacaattttttttaatcactattatcatacgaaattatcattcattatcattagatagaaaacgcgaataaaacaaacgcattagtttttcttgaacagcaaaaaagattcttattaaacccagctaagcacaagatgttccaaagctataaacaaacagacccattagtttaattgtgaaaattaagaaatgtccttgcttactttatgtacctattaaataaactgaagaagacacgcattctgcctccactattattattttgttgttaatttgtcatacaaaattgtccgtggatccactgacccaacacgccaatcctaatgatattaagctttcttctcatgactgtgtatgatcatgttcccatgcattattcactttgttaatttgagccgcatgattgttttgggatgatgggtctatggtggaagaaggaaagagaatagaattgaatagtaattttgctagtatttttactatatattttaaaggactaaaataataaaattacaattaaaatatactcatgtgaattttttaaaaagtgttagccaaaagttaaattgcaaacaaaatgggctgaagacccaattccagtagtgctaggcaattatttaacgtattcaattttttacttgatacacctcgaaagtttgtaatgtctcttttttatccttcatcatctttctcaccacctccttcctgaactacactactgtgaccaccaccactcaccccctctttcctcctcatgttgccaccccatcaccacccaaacgcttctcactcaaacatagatttgcacgcccctctttcttttgcatagttcgccaccaaagagagtcttcaagtgaagtgtacgaacatgaatgtgaggagagtctagaaactgagatgagtgaagtgtgcattagtgcggtgttgagttttggtcaagaaaatgaaggttagggaagaaagggtaagtgtggcactgaattatggtaccttcgatctcgttacagattgatcaatctataatacaaatttattatagattgctcaatccataatgtatttttttgtattacagaacactcaattataatacaaaaaaatatacattgcgaattgttcagttcatagtacaaatgcattatgaattgctcaatccataacgtattttttgtattatggattgttcaatctgtaatacaaaaaaatacatcacggatgattcaatttgtagtacaaatgcattacagattgagtaatatgtaatacaaatgcattacagatataacaatccataatgcatttggtgggtgggtgtcgatgatggtgaggcctgggtgggtttcacctgtggctgtgaggagacgacaaaatgaagtcacgcatatgcgatgcacaaatttggtgatgatggtgttgtgtttggtcacatagatgcaagagtaatggtggcccagtgaaggttcatagaggtggtggtggcagagaggaagaagggtagaaagggcatactagaatttttggaggtgcaccaaaaaaaaggggtatgttaagtaatagcgactaattaggaatggtaagtgattatggaccacgtgggtaaaactgaagggataagctttatacacccagaaaaagtctaattcaccattccaatatagtgaattttggttaatgcccctccttataaggttaagtaaggcactattcattttcagcttcgtgcacctggttcgtcttttgctcttctccatcgcacctcgttcctcttctcctcttttccttctccgtcgcagtagattgcgttcgttggtgatgatttttctgtcgtcatggttgctggtgttgctccctgtcttcgtttgctgcctccgttcgctgtgagtgggtcttgattttttccctttaatacggagtggatatcacggattggcagatccgtaaagttcgtaaggattgataatccatatacctcctacggatcactcaatttgtacgacttttttttttaaattattcaatataatgagatttaatttttaattaatggttacataatttattgtttattggttattttacatattctagcccttaagaaagttcatgaaattagattatataattatatgttgtatcatgataatagtagtgatttttggcttgacaaaaatttaatttttttcctatacattctatgaaatagaaatagagaacaaagtaattagaaaaagatataggagctttataatattgttcttgtatagggatcatataaaaaacaagatgttttaaattcatgaagagaaagatattgaaggcttagaccttaggaactattattagctggttgtttgggccttatgaatagaggtacatagtacacctatgtatatatatacatgtagaactgctaagttatcagtgaattactagatactattgagacacgctgatgttttaacttgtgacccacattggttttttttaattataagcacatcatcatcatcaacaacatcatatatggtcactgcctcgtagtgtaatgctggtaactagttatttttacactttaccacttaacgcttatgatggataatgatgaaactcgttggccataggattgtatcatctcaattaaaaaaccttatggactgcaaggtttgttaataatataataaaacactgtccatactccaagtaggacattgatagacggtagattgacatagcttatacctgtcagcatttatatgcacaacatcattgaaggatgaaaacataaagtgtataagtaacaaaaaagttatagttaagttgattacagagttgttatattgacttaaggaaatttatttgttgttcttagatgtatgtcgttaagtttttcaagtttcatgtttattaagtagtttgcttttattttcattgttggttggtttgaagtgtgacacaattaagcaaatggtaccacagattatggttaaaacaataggattgcatcggacattagggcgagatataaacaaagacatttgtgggaatgaagagctagcccctaaatgtcgtaggcctacgacatctgccaaaagacaacaggcaggggtaactgttgatgaggatcctccggctccgaaccaacatgcaggggctactattgatgaggatcctcctgttcaggacctacgtgtggaccatgatattcctgtcatggatgatgcaggtgatgaaatacaatcttttccaggtgggttggaagactgtttagtgttgacagagtatgttaaacatgtggattcaaccatgtgtgtgggaaggacatgcaattatatgtttcattacaaacaaaatgcaattattttccaatgccaatgactgtcattgatgtaatctgtttgcatgaatgtcctgagttaaaattggcgtctcacggaagaaaagttcataaatttggaaggcctgcactcgagattgaaggattagttgttggtacgggcttaggccctttgatttcatgctcagtcgagactggagataggggattgccctcggcttttgtggaaagatggcactctaagaccagcaactttaatttacccgtaggggagttgagtatcactttggatgatgtcgcttccctgttgcatctcccaatcgtaggagctttcttgtcatatgaggtgattgatgttggacaggcagtaacgatgcttgttgaattgcttgatgtatctatagaagaagctggagcagagatggagcaatgccatgggacatatgttcgactgtcttggctgcgagatatatatgctgtgagctgtcagtcgatgaagtggattctagcaaccagagcctacttgcttcatttggtcatgtgcacactctttgccaacacgagggctacacatatccgtttggtattcttggaggcatttcgcgatctggaccaatcagtaggatatgcttggggtgcggctgctctggttctcatgtatgttaatgcttaatgtttgtgcttatggatggccccctccaataaagccactttcttctttttctttgtttgcactttgacataaccttgattaaggtagctgcactgataggcactagtctcacactttggagtaaatcaaatataatttatcagccacctattacgtaaggtgcgataaatatattaaaagaaaatcattgcttattacctagcacaaaaaaattattactttttttttatgataatactggtcatttagatcgaatgattatagattttgataaaaattaatttggcccaaatatattctaagtctctccaaattatgattttgtctagttttggtctgtaaaaaaatgttacttttaaaattttaacattttcttgtagtaatttttttgacattttcttagtgttctttttaatccttattattaattatagttaatttaatattcacatggctaacgaaataaaaaatatgttaattgacataattaaggtaacaaataatatttttaaattaagataattgcattattttaagttatgtaattcaattaagtaatgtatttattattttatataaataagataattacatataatttattttaaattttaataattaagaacaatgacttttattgtttttaatattgttcttgtttttcgattcactaaattgctttttaacagctagcttgtaaaaatatatataatttacttaatgcgtttacaatacataattttttaaattgattatttatcttaatttcgtagttcctataatattacaaagattttagagcatttaatataagtgtttaacttaattttccttatttttatgcaaattcttttatttgaaaatacatttttatcaataaaatttgttaagcagcatcatttttgtaaacagcaatacttgtaaaacaaacaaccccaacaatgctccaataatccattttgttaagtgatgtttcttatttttaagtaactcgcataagcaatcgtattatataaacttttttcggtttaaaatttattttaatatattacttttgaaattacttatacattttcaattcattaattttgactgtttgtaatatgatttatttttctaatatttcacgaacaattattgtgtgtcccaaaagatatattgtacttttctatcattttttattatattttattttatttattatttaaaaaaatagagggagatggaatgcctctctttcccagtaataataataataataataataaattccttttgaaaaaataatactacacatagggtggttatcccttgaatctgtacacaacataggagtggttattgacttgcatcccattttttgctttttacacctccaaaattttcaatacccccgcttatccttctcctctctctcctcgctcaagcatggacatcaccactcctttctcgtgttaggccacaacctcgtgcttctcattttcaatttgtgttctggattactcaatctaaaatggttatctggtttaggatcctgataaagactctctccaagtttccgatggccttctccaacaaattgacaaaggggggaggtggaagaaaagaaggagaatgagggttgcttgggtggcacataaggaagaagaggtgctaaggttgtgggggcatttttgtccattcaaatctttttactttcctatggagtatggaggacagaagaagaaaataggggtgtaggaagcagtagcccataggagtgatcttactggaccataggccattaaaataatgtggtctgcgtggtattagtaagaaagttttcttatttgaattttgtgggtaaatataacgtgattgaaaagaaaaaatatcattaaagataatctccacaaaaataatcatcaacaaaatcaataattttatgcccaggccaattgtgtgaaaaaggacacgaacggaaagcaccaaatagaaaaggaaaaattatgttggatcatctgaatttttaatttctccaaatcgatagaattatggaaaagttgattttttttttgttttaacataaaaaaaagaaactttgactaattcaaaattcaattagaagataaataaaatttgactgagaatcattttcattaataattcaatcctaatttcgataccctaaacacttgtgccgaatcatttaatttgaaagttgatttttgtaattaaataacaaacattcctttattttttaattaaacttaaaaatctactttttattcacatatgttacgcaatttttatctctcaaataattttattacatatttaattagtaatgtttccaaaatttaataatctgccgtttacaagtgtgtatgcgtaatttccgggaaattggtatgtctctcggaaagtccacgtcctagtcattaaaaaatactaatagccaacccatgaacatcttatgtaatatgttacgcaattttaatctctcaagtaattttattacatatttaattagcaatgtttccaaaatttaataatctgtcgtttacaagtgtgtatgtgtaatttcccggaaattggtatgtctctcggaaagtccacgtcctggtcattaaaaaataccaataaccaacccatgaacattttatgtaattgaccatctattccccaaattcagtttcagaggcgaggaagagagggagcaagttcgagtactcatcacaagttttggaaagcaaatcttaaacaagaaactttgagatattcaaagagagcactcttcggtaatttcatttttctctttgattttctctaatgaaaattattggttcatgattgcaataacacttgtaatacctgagattttctttcaattgtttttattttattttactttatttatctaattttgcatctgataatcattggatactcgctaagtagtttggaaatcaaagttatttggtgcttgtgaatggttttaactgcttaaatgacatttaatttaattaactccttgcagatacaatttcgtttcatttatttcttgaaaagtatagagaaatttattaatagagttgtaataataaagcttaaccatctcaagaatcctatttgggacaacttccacacaaaaaagaacatttttagagatgcttttcatccacatcttttcaaagaactcctcattcaccctcaaaatttttaacagcatactgaaagattttgtgattttttggacaagtttctggtggcaattttaatattccatttatctttataggataccaaaattatgaattggaaaaagtagaaagaggaacagtgcattttaacttatacttgaaagataggcacatattaaaatgattttgtgtttaggaaataaagaatggatggagcgtctagtagtaaaagaaaaaggggggtcgaccgaaaagtaaatactggaatgaagctgaaaaaataggaaaagataagtggaagtgcaaccattgtgaagaggagttcgctggaggtgctacaagaattcaagagcatctcactggcgaaggaaataatattagaaaatgtcccaaatatcgtgccaatcaaggacctcacaatgcttcaagcagtccacaagaagcattgaatcaattacaaggtaactaatatactattattgaacatttttgagatagcaatgaaagttgccacctttacttttatataatgctttcttaaactctaaagataaattttcatattttttattctatttaaatgttaaatattttacatttctttcttcattttgttgaagtttataaatgatgactgattttttttatctatatctcttattgtcttgaatgttgaaaaaccttaaaccttaaagattaaatttatgattcttcttatttatatagtgtttaatttacatttttatgtaatatatgatttctcttcatacatatactttacctttaatgtgattgaaaagacaataaaataatttctttttaacagaaaaagatcatatatgtaataagaaggctatcatgtgattacaacaaaacgatccccacaagaaccttcaaaataagctagcataagaagtcagttactaatactaccgactactagaattccaggggacaatgaagtgattgttgattgttcaattaaccctacaaacagtacacaatcaacagctttattaggaggaacgcattctagttaccattccagtgtgtttcttctcattctttacacacgtgctttattttttaatgtcgtttttatgtagtagttccttatgttttatttgtttcttccctcatcaaaaaaaaaaaaaaaaaatcaagtctaacatttcctttgatttctacttcaacttaaaatccctcagaagatgaatttaagttgggagatcagatagtggagcatgattctgctgcatttgaaagcaaggacatagaaagggagtttttttatccaaagggggaccctgatgctgtttgtattagaaagacagatattgagcttttacagcctgagaaatgcattaatgataatatcattgacttttatatcaagtatttgaaaaatgaactcccaactgataaacaggacatgtttcactttttcaattgctttttctttcctaagcttgttgatttaggcaaagataatccatcaattgcttgtgatgctaaagcagcatttcagcgtgtaagcaattggacaagaaaagtgaacctctttgaaaaggattatatcttcattcccataaactatgataatcactggagtttgattgtcatttgtcatcttgctgaagtgatgaaatcccacagagatgaagaaattaaggaatctcccaaagaaccttgcatcttgcacatggattcccgaaaaggaattcatgaagatctccgctatgttttccaaagttatctatgtgaagaatggaaagagaggcacaacaacaatgtgagggatgatgtttctaaatttttacatcttccattcgtgacacttgatgagctgcctcagcaacaaaatgcatacgattgtggcatctttttgctccactatgtggaatggtttctgaaaatggctccaatcgactttaacttttccatgataaccatgttcagttgtttgttccctcaacctgatgcttctctgaaacgatctcacatacagacactattaagaggtatgaatctggttacttaccaacaggttgatggatgaagtaatcggaatgacaaatgattacggttgcggaaaccggataaagtcgggaacgttttgttcatttcctgctctgtatactcgtgttttttttttatttcttaggtgacaaaacaaagtttgatttttattttaaaatcctcaattttatagtttgtgtatgtgagagaaagatttgtcctgacaattgtgaaactttccttaattgttagcgttactataagtactctatcatctttaagatattaagttggtattagtagtattatggcctgtttggatacaaggttagaagtacttttgggagcttctctactggaaatatagtgtttttttcggtagagaagctctcaaaagtacttctagccttgtattcaaacaggccctttgacatattttttattgattttctgttagaagtttgaaaatggtgactatattttgttttatctaatatctcttgttgcattgaagcgcttgaaggagacaacaaaatgattgttggtggttcagttaaccctcaaaacaatacacaattgtcagctttatcaggaggtacgcattctagttgtcatttcaatgtgttcttatatcttattcaccaaccctcaccaattccattatgttattttccttcttcacacggatgcgctttttattttatttttttatttaggtgatacaacatatatggatttgttttcaattctcaataatcaatttttaatttagcctgatatgaaaaagtaaatttattacattccaatatatattggtgctataaagcactttcatatatgattagttacatttttttttaacttagattccaccttcattgaaaaaagtttaaacacatgaaaaattaattatttcagttagattaatccctctcactttttaaatatattctttatttgggtaaaataaatcctttttgttatgtgtgtgtttcaaattctttttaatttaatctatttctcaataaattattttgatgtagaagattaaaaaatgtagcataaccaaaacaatgaaacaggtgatgtagaagatcatgttgtgagcggaggtagcaatgctaatgatgcttttactataaataagttgttatcttatctaacaagcaaagaagatgagactgatagacaattacagtggctggagttccaaggcaaaaagcgcaagagacaagaagttgacgattggttggataaactaaaggacttgaaaaaaatagctattgatgtgaagaactcactacatcagtctggctcgactaacgaattgcccaagccttataaattgaatgctgagttgcaagatttattgtttatggagaagccttgggggcggttaggtgaaaatgttaaaaagatgtggaatcttctggaggatgaagaagttttcattattggcatagatggaatggggggagttggaaaacattcctagcaactcatatcaagaatgagattaaaagaaatgggactttcaaggatgtcttctgggtcactatttcccatgatttcaccattttcaaattgcaacatcacattgcagaaacaatacaggttaagctttacggagatgagatgactagagcaacaattttgacatcggagttggagaaaagagaaaaaacactacttattttggatgatgtttgggaatatattgatctgcaaaaggtggggattcctcttaaagtgaatggcattaaattgattatcacaactcgtttgaaacatgtgtgtcgacagatggattgcctaccttataataccataacaatgcaccctctctctcatgtagaaggagaagcttgggagttatttttgctaaaacttggacaccgtggaacacctgcaagagtttcttgtgaagtactagagtatgcaagatctattgtaatgaaatgtgatggtttaccatttggaatcagtgtgatggctcgaaacatgaaagggaaaaatgacatccattggtggagacatgcattgaataaacttgacaaattcgaaatcggaaaagaggtcttaagcatactcaaatgtagctatgacaatttaattgaaaaggacgttaaaaaatgtttcttacattgtgcactgtttcctaatgatattagcaaagagctatgggttatgatgcttcttcagagtgggttgttaaatggaaagaggagtttgcaggaaataaatgatgagggacgtgtcatagtggataaactcataaaccattctttattgttgttggatgatgggaaattacgaatgaatggtctggtgaggaacatggcgtgccatatcttgaatgagaatcaaacttacatgataaaatgtaatgaaaatttgacaaagatacctcacatgagggaatggacagctgatttggagggagtttctttggcgagtaacaatatggaagaaatcgcagagggcacatcacctaattgtccacacttgtccatcttcatcttatcttgcaattccatcagtcatattccagagtgttttttcacacacatgaattctctaacactacttgatttatcatataatgatgaattaacatatttgccaaagtcgctatctaagttgaggtctcttacttctttagtgctccgtaaatgttgtaaattgatatatatacctccactgggagatctacaagcattgtcaagattggacatttcatgttgtgattcgatcctccaagtaccggaaggcttgcaaaatctaataaacttgaaatggcttgatctgttccaaaataagaattcaatgatgaaattgataccaggatacatactgcccggtttgactaatatgcaatatctggatcttcgcagtgtgtcaggtataaaagtagaagatgtaaaagggatgactatgcttgaatgttttgcaggaagctttctcgatcaggataactacaatcgttatgtgcaagaaatccaggacagtggttatggacctcaattctatattatctattttggaaaatttaagaatgcgacgcctgatttttttaaggattctatttatgttgaattcaagcgtcgaagtgtatggtttggagattgcaatggattgccctattcactgccaagagatctttcgaaattatctgtaattggcaataatcaatgggaatgcttatgtgctgctctgtcatctaatggttctctatctttagaggacattaacattcgaaagtgcaaaaaattggagagtttattctgtgtatcttgttccttgtgcactaatatccaaaacctcaaatctttgtatctttattatttggatagtttaagtgtcatttgcaaggaagatgttgctggtagaggggtgttttctcatctcaaggaatttcgtgtcgagagatgccataaaatagagacgttgctgacgccagggttagttacacaacttcaaaacctgcagtctatatctgtaactgactgtgctttaatgaaggagatatttgcaggagatagtccacaacttcaaaacctacagtctatatctgtaagtttatgtgattcaatggagaagatatttgcaggagatagtccacaacttcaaaacctgcagtctatatctgtaagtgtctgtgcttcaatgaaggagatatttgcaggagatagtccacaacttcaaaacctgcagtctatatttgtaagtaggtgtgcttcaatggagaagatatttgcaggagatagtccacaacttcaaaacctgcagtctatatctataattggctgtgcttcaatgaaggagatatttgcaggagatagtccacaacttcaaaacctgcagtctatatttgtaagtagctgtgcttcaatggagaagatatttgcaggagatagtccacaacttcaaaacctgcagtctatagatgtaagcttctgtgcttcaatgaaggagatatttgtaggagatagtccacaacttcaaaacctgcagtctatatctgtaagtgtctgtgattcaatgaaggagatatttgcaggagatagtccacaacttcaaaacctgcagtctatatatgtaagtggttgtgcttcaatgaaggagatatttgcaggagatagtccacaacttcaaaacctgcagtctatatgtgtaaatgactgtgcttcaatgaagaagatatttgcgggagatagtccacaacttcaaaacctgcagtctatatttgtaagtttctgtgcttcaatgaaggagatatttgcaggagatagtccacaacttcaaaacctacagtctatatctgtaattttctgtgatttaatggagaagatatttgcaggacatagtcccgaaaacattgcacttcccaagttaaccaaattgaaactgcagaatttaccaaaattagagacagtgtgcaaagaaattttaatctgtaactttgaggatatattggacatctccaattgtcccaattatgaaaaacccagaattcgtgtgtatgattgattctgttgattcagattatgttacttattttatgtcgcttagcctttgtattcataattcttgtaaagacaaaacaaaatcataatttactttttgaaatagtatacttgcttttgttggtactagtcataatcgtttcggggaagaatgtatttctacgcatttcaatgtcggataaaaaaaatgttgttttgtcaagtagatgaccattctttgaaatgaaaaaaaaaaattaatattaatatatttaatcaaccaaagtgttacgaagccttttgaaacattcatgcatagttgacacgttgggaatactacatataatggaggaaggtttgacaagatccaacacctccctctccgatctccactgctcttattcgacaacaatatatatattctccgtcatctcttcatccttcattgagtaacattagcatttgttgatgcacaaaactcagcatctccatcataacagcagaaataataatttagatctttcattgcctactggaaagatatatttcaattatcataacattgactcattccctcgttaatttactcattttaccattacctatttataggctaacatttccgttggggtaagtaaggttatagacagtttaaaagggagattagaaagtgggttggggacataattttatagtctttagatcatgtggggatcctgcacattggtgcggtgcttttttgtagcttctcgatcacatgctttggtctgtttgcatggctcactacctctggttagttttatttattgttgcacataggcgataaatattgcataagcagggatttctttcttgtactttctttcggtacctctggtacctttataatactcattttatacaccctgcatcaaactacattacacaaatcctgcattttgtaagaaatcttattttctgaaattctttgagaggcattcaatcaattttcctgcattccatcttcccccgcgatatagtgcaaatgctatctccacagcacacattgaggagtgtatctcgtttgacaatgacacaataacacccaacctgccttacgaaatcttgggccactacagaaatgcaaatactactaattccacataccactgtaccaaacaagtctataaatattgaaatgtttcaaccctgactgccacattcaagggcaatggtgcctgctacgtacacaatatcaaattaagctttatcttctctttttgaaacacaaacaactatgacacgtataaatttaagacaaccttttatacataatgtagtttagtacacttggggaagagtcatagcaagggttactttcacctaataaagcatccacttagagttaattggaaaagacatgtataaatttagtttagtgcacccttttgtaatccttggttctgctctaatttgtcagcttttctttccataaattattacttttctctcattcatctgctgacagtgctatctatgaccctttctacttggtgcatcttcccatgaccttcatgcaccgtagcccagccataacaactaacaatgcatttattgtttttggggtgagtttcaattccaatcaatgcgaccaatgttttccaacgcaaagaagttcttattagaacaaacatgaacaaaaaatcctataatctccaatgagaggtttgcaaagccagcgacgaatgttggcgtgtcctcaactgttgtactcaattatgaaaaaaagaaaattttagagttacaagaactctgtcatatacagaagaagaaaaaaaagttacaagccttacttgtgttacctagcacttctataatcaatgtcagccgcaccaccatttgtaattttgtatcatgaatctgcgtaactctgtattatgttataactaaataattagtgtgctcagttggaattacccactccttgactcgcccaactcgcaaacccaaattgccacccgtagtaattcacacaacgggatacacaagcaccctcattaaattcaaacaatcacatttagcaggagatacaaacatttggattcaatcaatttccaaggggaggtagctaaaatccaatatctaaactttagctacactatcgaatgcctaaaactatcaacaaataccagaggttccattcgaatatcaaaaaaaaaaaaaaactagagaaattcaatcacctctcctaagtactacccctagtggttataatttagagattacttccaattgttaatacaaaataacttccgacatcatccctaaaattgatgaggtcaagacacagcttcattttcaagaagcttgtggtgttatgttgtaaaaaaattccaaagcttcttccctattgaagcttcaccgggttgcaggtaatcttcgtcgtcctcattgtcaactccaccagtagcatcttccccatgggattcactcctatactcagcatcattctcctccgcatcatctgtttttccgttcacctcctcactcaaggccatattgttgacaaaggtccccatggtatcaccaccataaccgtcccttttctccgcaccttaattgttagcattactataagtactctatcatctttaagatattaagttggtattagtagtattagtatgttactatttgacatatttcttattgattttctgttgaagtttgaaaatggtgactatattttgttttatctaatatctcttgttgcattgaagcgcttgaaggagacaacaaaatgattgttggtggttcagttaaccctcaaaacaatacacaattgtcagctttatcaggaggtacgcattctagttgccatttcaatatgttcttatatcttattcaccaaccctcaccaattccatcatgttcttttccttcttcacacggatgcgcttttttattttatttaggtgatacaacatatatagatttgtttttatttctcaataatcaatttttttatttcacacaagaaagctatttgtgcttaacattcctctaaatattaaactaagttcaatttttatttcttaccattagcgtgacatgaaaaaaataaatttattacattccaatatatatttttcatatatgaaacaggtgatgtagaagctgtgaacctgtgaacggatgtagcaatgatgatgatgctttgactataaatgagttgctgtccgatctaacaaggaaagaagaagagactgatagacaattacagtggctggattttcagggaaaaaaagagcaagagacaagttgaggattggttggataaactaaaggacatgaaaaaagagctattgatgcaaaaaactcactgcatgtgtttggcttgactaatgaattgcaattgaaatacaggatagtggtcatggacctcactcctattttatccattttggaatatttagcagcttgatgaatgaggagcgtcttatatatgttgaattgtatcatggtgaattcacacctagaagtgtcaggtttggagattgcgatgatgaattgccctattcactactaagagaccttctggaattatctgtaactgacaatcatcaatgggaatgcttttgtgctgctgtgtcatctaatggttctctatctttaaaggacattatcattggaaattgcacaaaattgaagagtttattctgtgtatcttgttccatatgcactaatatccaaaacctcaaatctttgtttctttttggcttgccaagtttaagtgtcatctgcaaggaagatgttgctggtttaacacaatctttatcttggagggggatgttttctcttctcaaggaatttcgtattaggggatgccatcgaatagagaagttgctgacgccagggttagtgccacaacttcaaaacctggagtctatatctgtaagttgatgtgagtcaatgaaggagatatttgcaggagatagttctgacaacattgcacttcccaagttaaccaaattgcaactactccattcaccagaattaaagacagtgtgcaaaggaattttagtatgtaactatgaggatatattggacatcttcgactgtcccaattatgaaaaacccagaattcgtgtgtatgattgattctgttgattcagattatggtacttattttatatagcttagtctttgtattcataattctttgtaaagacaaaacaaaatcataatttactttttgaaatagtatactggcttttattggtaccagtcattattgtttcggggaagaatgtatttctgggcattgcaatttcggattaaaaacatgttgtcttgacaaatagatgaccattcgttgaaatgaaaaacaaaaaaagaaattgatattaatatatttgatcaaccaaagtgttatgcagtccccactgctcttattcgacaacaaaaacagtggcatgattgagagcacaaaactcagcatctccatcataacagcataaataatactatagatctttcattaatattgcctaatggaaagatatatttcaattatcataacattggctcattccctcgttaatttactcattttaatcaccattacctatttataggctaacatttccgttccatgattgagagcagctaggtgcaagcctctgatctataaagtgctgactgatacatatagttgaaaatttccaaacccaagaattgatacttcatacatgatatcatatacagctagaactagataattaaactttaatattataagtcacaaaaatcttggttagagtaaatattctccaaacactagaggtaaccagagttccaaacttagtatgcaaaataaaaccttgcagtataataaaaatatacaaatattatagaaataaggataacttgtaacttttgttcctaaaagtgtagtacaatatcaatttaattcttaaaaaagcaaattttataattagtctttaaatatctaaaaagtgcaataaatacatcatgttttatatttattgtcaaactgattttaaatattataaattaatgtcaaattgatcatctaaaaatacatttaatattaaattatgtttttagatattttaacttaataataaaatgataaaaaaatttaacatcaggacatattgttgcattttcctgaagttcgttggctgccaccagaagctgattacatcaaatgcaacatatggaggcagctatatttaaagaagataactcttttggtgttggcatctgcatcggagatgagcatggcacatttctgaaggcaaaaacatctttgttcctatcaccagctgaagcggagagcatggctttattacaagcaatattcaatgggtatctcagttggcttatcaaaaggttattttcgaaagcgattgtaagatggttgttgactacaccaatcatgtttctactgctatatcttgcttgcatgttcttctacaaaatgtagcatatttttttattagggcttcaccattttatacttgtaactgagtctttgactatgttcccttcttttattccatctttgattctgaatgatatatcataaatgtattttccattaaaaaaacacgagtctaattaaataacctataatatctacaactaaataacaaaattacatattttgctttcgataaaataaagaaaaagtcccacaacacactttgtaccccccaatttaacgaatttattagcataatcagatgggtcaaattaaaacaactataatatctacatttaacaaaattacatattatgcttttgaattggaaaaaaaaatctcacacagttcgtagtttgtaccccacaaattatgacaaagatcggtcttgctaattaattaatgtctttaggtatttattggttgaaaaattttaaaaaaatttattgtattaattataggaaaatgtaaaagattttgggcaacaataatttttaatttcctaataaaaatatttttactttaaatttttaaccaaaaatatttttttataggcaaaacaaaatcatatatatatataaggaatatcctatagtttagaaaagccagctatgttcccatccaatctgtcctcatataaggttacaccatatttaagtaaaaacaaccatccaaatattatgtttgacgacacgaggaggaattccatcaattaaaaagataaaacttgattaaagccaagtcatctagctttcacatagataatggccctttaaaaaaatattatcaactactatattcataattgaaaagtggattaagtagtcttctagaatagtttttgtaacaccccatgtgcacccggtgtattaacattatacaatatcagagtaacgcagcaagcatggaaataacagtaaaggaagcataaatccaatataatatacatactttttacatatatggtgaattaactgtcatatacaagtatttcagtctccagctatacaactgcctaggcctcaaaatacagacaaaatgaacaaaatctgagctcacaagctcaatcatctaagcctagggtgatcttcacactatcccagtgcagacctcttgccttgggatctctcagtgacctcggttccagctcctgcaacatgagccccaaacaggggtgagataattatctcagtaaactcagggttctcagaggtttccctccccctggttcacttcccaatataacaatgaatatatatatatatatatatcacataattaaacagaattttcatcagttaaacagccttctcggctgaccagaatttgccacatgcaaataacagcacaatgcaagcatatacataatcaacacacattgcctgaataggatcatccactgaagggcacatctattcaggaattcacactgagtacttgaataggatcatccactgaaggacaaatctattcaggactcgctcctcacatgcccaggtaggatcatctactgaaaggcacatctacccaggacttgccgcccaatacctgaataggatcatctacttaaaggcacatctactcaggatttacatggacgcctatggattatcccaggggagatcatccacttaagggcacattcccaaggggtccatagtacctcatactactggccagtagatttcaagcaatcacatcacaatcagctcataacataatccatgcaataatacactatactagtgtaagcacattatcataataagcaacataatgtatactttctcagtgtaatcaaatcacacacacaccctatctcagggttgagctagcactcaattgccagaaatcatcaaaccatcttatcaatattcaatacatattcagtatcacaacctcatagaacatcagaacacaaaccatatcaagcaattacccatgttgggtgcagtgaaacacaagcagggaaacaatccctgaaaccactgagcttacctggtcgtagctcagaatcagctcccctagtctctgggtgatctctaccagcagtatgcacgtcacaccctacagtaggcatgaatcaaaccatcagaaacgacattcaaccgtttatatggaaggaaacacccttccactcataaccaattcaaagtcctctaacttaaggtttatcttagtccggcttctattaggccatacattgaccctcaagggtctgcctcaatcgcaccaagacctcagagtttctttagaactctgtacaacttaattcagagctgtaccagaatcaagaacccacattagttcaactcagccaaaacacatatataatcacgttttcaccgtggccttatgaataacttttgtaaaggtatttaagttaattcaggccataacacctcttatttagacacacttcctccttcccagagtcaaactcaaacttcatcacaattctagtttcaaggttccatatttctcagaacaacctcctaactatccttttctaaagaacttaagcctaattccagccccataatcaattggttactattcacccaatttcccattccaagaattaaacggttaggacgtgaatttcttacctcaaatcaatagaggaaggctggagaagtctttctcctagctctggcgtccttggaccagcttctttgcccctccagagctcagctctctctctcaagaactcaatggaatggggtttctctctagccaggctgaaattggcccccaagtggttcaattcaagattaaggatgattagaaggtgttttatgggtgtatgatgaaggtatgaagctcctaaggtgcatcaatggtggtctaggctcaaggaggaagagaaacagtgttttggggccaaaatttcgtaaaatggcctttaaatactgggtctgccgacgttcccgcgctaatcgcgccatatatggcactattcgcgtcaaattagcgcaacaaaaagtttcctgggcacttatggcgctaattgcgccattacggcgctaaccgcgccaattgggcgcgtttgtggcgctaatcgcgccaaactgacgctatttgcgccataagaccgcatgaaatggccttctggtgcaatctcacgctactggcgccatatcccatactactggcgccgcatcccacgctgttagcatggaatttttttttttttgaatctaggttattatagttttactactatatgtcactcatgcatgaatcactactacaacaacagttttttatatcgattatttgtctcattcaaagacgatgtaactaacatttttgaaagctaagacttttaacgatgattatttaatcgtctttgtattattaaagcattctaagacagttttatctgaaaatcgatttagaatcagtgttaaatttttttaaggcttttataggttaaaattgtcttagattgtcaccattctaagacggttttgggatcgtcttaaaatcagtgttaaatttttttaaaagccttctaaggcgattttaacctataacattcttaaatcattctaagataactttagtccaaaaccgtcttaaaattagtgttaatttttttttttaaggttctaagatggttatacactagaatcgtcttagattgtcacctttctaagatggtttaaccataaaaccgtcttagaagcctcttttcctaaagtttataattttataaaatgatcacaaatcaaaacacacgtaaatcgcatactataccagaaaaatagtcattattaattgtttctctaaccatcattgttagtacagttaaaacttatttgtcacaaatacaattgttttttgtttcaataacattcatcatcaaacatgttattcaatgatagggcattccactgcatcaaatacatgacaaggtattactgtttgtattatagcataactaccccaccgatgacaaagggttaatgaaagacctagaaaatttgtcttacatattgtgtcatctcactgtgacaaatactgcattcaaaacttaaattaaaattattcactatggcgcattatatttgcctagtcaagttgtccaaccttaatgacaaaatgcaatcaaacctgatatgcatgataaccctgtacattttctatttgatcatggttattttgtagactaatgtcttcaacatcttaatgtttttcagctacatttgtattccttgattcttcattagcttgaatctttttgttcatgtaaatggtccttctcctcagccttatgtatttattcattatgatctgtgatggaagcaaaatgaatttgtcaaacccatgaagaatttgaaggaaagaaaatagcaacacaagcaaaatattgccatgatgaaaattccatatatttgttgccactgaacagcccattctaaggtgaaacaatgagcattaattcaatacaacattttgtgaaattaatttgttagcaacacaggtgatttgcacaaagagcaacatgaggatggatcatagtgccacctggtcaacccaaacagccacactagtgtaccatagaggatcacaagcaaattaaccatgttgatcaagtgcataacaaaaatactattcacaacaaataagaatgaatgacaactttctattaaggtggatgtgtagttatacgaaaatgaataagataagaaatgaggatattcgacgaaaggtagcattgataccggtgtgtgaaaaaaatgaaggaacatagattgaggtgattttgacacgttatgagacgaccactggatgcttccgtaagaacaagagtttgttatcaagagctcaacacaaagagaagtagaggtcgaccaaaacttacctggggaaaggtagttaaataagacctaatggagtgagatatagattggcggacgatatgtcttaggatggagtggaggaaagttacaagcttggtgaagggttaaactcattagtatttctatgtttcagtcgttccttttttttaattcttttccgcttaatttctccctctttctttcacccctcttttattttagcttatttttttctcctcttttgtcttatttccactttttttccctctccctttctctttatttgtcttatttctgatctatcattgggttcatctacaccgaccccaattaacttgggttaaaggtgctattgatgttgatgttgaaaaaaatcattgaactctgtgtagtatatatgggaaacaacctatttttttatgatacatataaaaatattcaattcatcatattttctcctcctttcccagtttttaaatcctctggtagtggaagatgccatcttcctggtcatcattacaaatggagcaactcctatcagcctcctggaacaatgtggccaaattcaccttcacattttgatggagtttgtgcagctcctaatctgccaagattgcatggttttcctaggtcaccatcacatatgatggccactgttttacccataaatggccagcatgtgccttcagctcctttttgggacagaagagatacctatgcaggggaatatcttgggaatatgcaattttctggcaacacagcagcacactgtgttgattttgtttcttataatatctttccacattttgggggaaattgtgttgaccttagaatcctccccaagaatcttggagtcaattttcataaccaaggggacctaatgtttcctagaagaaaccatatgattaaatttgagattcacaaacaacgtaccagaagccgccgaaatgaaggcttgtcaaacttggatgacaagaaacagtatgaacttgatattgaccgcataaagaagggagaagataaccgaacaacactaatgataaagaacattcctaacaagtagcattgtatatactaaattaaatattagccttttgtatttaatttttcatttttggtgatgcaaacagttgtatattcatttggtattaaaagaaaatggtacattttgggttgtgcttttacttttcaagaaattttggagttttcagccaagcctgttagcataggatagatgattcgttaagccagtgatgatatgggaaaaagtcgcaccacaacttgaaactcttgtatgaacttgaagcttaagcaaatttactcttagtctcttagtttgcatttgtcttggctctaaaatgtcttcttttatgatactagctttctgtggaaacttcttttggaagaatcacttttagaaaaatcaattttggtatgtcatcaaagaagttctttaggtttagccttgtaaaattttggttgaagctgtttttgtcaacttcgttgttttcttagattttttttgttagacttggaagtagacaagcttctatttcctgccttttctcaacaatagtaaaatagatcctgatgtcatatgaaaatgattcgattgtggtaaaacatatctttacttgaaagtacttttatgttatattcacatcatagccaaacaaactttagtagggcttgagatttgacaaactgtttcctaattattttttccctttcagctggtggttactgatcagtttagcagaatacataaaaaatctataattttttcttttgctatcatttacttgctttgccaatgttggaattaggatgggcgattggtgaatggctgtgaatataagcacaaaattgaacttgtgattcttttcattggttttaagcatatctgaaacctttgtcatttatcttaaatagttttcgctgaaaatgaagaattctatttcagttctacacttcatttacatcaatttttcttaaacttctcattttcctggactgatttgttatcttgcaggtatacatccaagatgctgttagctgcaattgatgagcgccatagaggaacttataattttgtttatctgccaattgatttcagggcaagtgcttttctctttttaaatacttggagtttatggtccatttgttgtatagagaataactttctagaaaatatttgtactttctctgttttgtgctacagtagaaggaaaaaatgattcgcttcaagaaatggagtgtcattttcctgaacaatttaagaaagtttaagaaaatgcataattttttttgttaaaaatgctctcatctgatttttttctgtaggaaaatatctatgcttgcatgaaaatgtgttccttttattgaacatttccacaatgaaatttatttttaccttagtattcctttctcgcttttgcttaattattcacacggaatcaacattaattgcagaacaaatgtaatgtgggatatgcattcatcaacatgatcaatcctggcttgattataccattctatcaggtatgctatacaaaatgatgatgacaatgaaaatgattgctgttaaacttataatcacataacattcacacgcacgcccacactgtactaatagactaacttatgatgcaattctggcaggtgttcaatgggaagaaatgggagaaattcaacagtgaggaagtggcatcactagcatatgctcgcatacaagggaaagcagctctcattgctcacttccaaaattcaagcttgatgaatgagaataagcattgcagacctatcctcttcaacaccgatggccctaatgccggtgatcaggtataaatttcctctaaaatccatttatcagtgacactgctagtatttttgtctgcttcaagcataatatagaatcttggcaagccatttgaaatttgcacttctcttttagcaagagatgaagctacaaaatgggtactaactttgctaggaacacaggttcctttcccagttggcattaacattcgcaacaaagttggaagagtgagaaacaatattcaggaggataaccagcaaggaagtcttccaaatttttcaaactgtaagctctcatctgatggagatagtcattcattggagtcagactaaggaagccatctctctctcttcttccatgccattaattttagtgggtgctaacctttggaaaccaaatgatctagtcacaataaagctgctaatgcttggagcacataagtaccaacactaaccttaagacgagaaattttctagttcttttggcttttgatgccaaatccaaacatggttgaagtatgagattcaagaggggctgtcagaaattttcacgtgcaagagtactacataaaaaaattacatgcacaggagtttcactttggagagtggagagagaggcttgtaaagtggtttgaggggaacttaattggcaaaaaaattaatatattgtttttttttaaaaattatgaatttggggtacttttaaaaagtatttacagttttatggtagttagttacgcccacacaaaacgcactcagacacgttcccagcaggcgcgacaggtgcttgaacgcgtcgccagaaagcgtgactagtcgcgccccaggaaggcgcgactccctcccctgttgcgccccatataggcgtgacccagcaccctgttgcgcctccaccaggcgcgaccctgcaccccgtttcacccactataaatgcccaaaaatcactatttactttcactttttcaccgttatccagaaagtactccaaattcgtaatttttttttaaaaatataataaattcatttttttgccgaagttaattagtatgtatcaattttatcctttggttcccctcttcctctccatgttttttcttcaggcattttgtcttttgtaaattgttaaattttggagtccatctcatcccaaactcatgaaaattttgatgaactatttatgtgatgtgccgaagccgtttttggtggttcatcattgttaatgtttggtgtgcaagcatactctagtattcaccttttccttgtaaatattacgatttgaataatataattgacgtttctcgtcgtttgagtgtctctactttctattgtcacttgtaaatatataactggatttctaaaccactactacatctccagttatgctacttgaggagactcaatatagaaggtttcatgtcaaatatgatttatcaaaactggcaatttctgattttgacacactattttttgctttaatgacaatcttatatgtaaatagaaaactgatattatccttcaatattttctccaatagacattaacaagtaacagcagaaagcacttgagaatgttttaaaatcaaaatcatgtagaaaaatctctcaaaattaaaaaggaaatgaacaaaatgtccattgccctctttgacccgaagatcctaatgaaccccaattaccataggcttagaaatgtttttttttcttacatgagaaaataagagagaaaccaaagcatagaaatagattgaatgggattaaactttacgccattttaatttgacttatttctcaagtttaacgttcttatttatatatgtccttttttcatataaaaattgatttggttgtttaaagacttgaaaacttatttaagagtttactttatgaatcaacaaactcatttctaaacgaattaataaacttaaatttatttattaatattaagaaattaagaaaatttgagaaattaagatgccttttaagatatgggtatatacttataatattcttgtcaagtgaatgcatatacagcatgttgtattttttatttatttatttcactattggtctctaattttattttttggttttaatttggttttttaagtttaaacttttttacattggtccttgtagtgttttgttaagctaaatttgtcagcctttgtcagattttctttattagctatgtaatgttaatttcagcttacatgataaacgctgtctcacataacatctatcacaatttgtatgtaaaaccaaattgacaaagttaatataattaaggaaagtgaagatcaaactaaaactaaaagaattaagatgataagagacaaaaatatattttagtccttttattttaggttgagaaagaaagagctgaataaaactatatttagaggctatgacatgcttcaataaaaaaatcatatatatgaatacctctatgctacaaatatatttctttgtcttctaattacatcatcttatataaatatgtatttttttttatctctccatatattattggattgagcttattcctttaatgttggcctaggtccattgaggatcctaaaaccgtaaacctaattcacctctttaaatacattagttgagggtgaggtgatagattagaattagagaacatgatatagcatagacagttttgatgcctcaagtgacatttttaagagcacatttgagcaaaccttattctttgcatttgagagatctctagagagagtttggatgaaacactctaggaagtttgattatcatcattattggagaggttaagtgaaccaccaacttggtgtattttgattctctataacccattattgttatagtgaaagtttgattctggattagtgtcccgtggatttttattctttacattgaagaaggtttttccacgttaaacaaattgattgtgtttttctctatttctcttgtctcacatttttgttccgcttccacaatccatctgagggttagatgatagaacccaacatatctgattcgatcccttcatatcatttcttagttactgctaaaattgggtgtctatcaagtgaggaattgtttcgaggggaaaaaaaggaagaagaaagaaaacaacgactttttttacactacctagcttacatatctaaaaggagaataaagagtgtccgtggtcgaaatagatatgtcagactaataggccaaactaggtttgaattgacaagtattggcgtattgctatagacaaaatagcttccaaatagttaataaaaaaatattactaacatatttttaatgtataaatttaattatatttttatttacacataattttaataattaaattcttattattatatttattttcttaatttataataactaaaatcaagtcttttaccttaaatttagtctaataatttttaaaaatataattaagaaatttgacattaatttatacatgttgatagttttattttaaccaatatatgtttataaacaaaaaatatatagtagacataaaaaaatgacattataagtactgtttctgagcatatttttatttaaatattttatgaatttcttttattgatttatataaatcaatattatattaaacttttattgtattctggttaattattaaataaaatttaggtatttcttttattgacttaattgtaataattgaaaatttgtaaggactaaatgctaacagttaacatagaatgatcaaaattacacataaataaaaaaaatacaattcaatctaacacatatagcttttttttatatccattttacaaaataacttaaaacctactatttatttctaaatcggacataaaacttcatttgatactaaaatgttgaaaatatgttaaaaatttgggtaactaatactacaaaatacatccttgataaagggtgagaattttcaagtatacatgattattagtcttataggggaatgcgtcggtttgcctaaatttgtgacattaaatttggatgaaaggtttctaaatttgggtctctcatccgaactaactcagactaaaattaaattgatttgaattgagttattagatttttattaaaataaatataaaaaaaattgattgtgaaagatgaaaaaaaattaaatgaacttggctaaagtcttaatctctaaaaaataatatataaaaatattatgtcatgaccagattagtttggattctcaaaatcaaaatttgacacttgaactgaaaaattagatttgtatttttttataattgaatccaaaccaatgattaaagttaatatgtatttttttgtttgaattcatcaagttgtagaattgatcgggatatgtgatcactcctaattaattagtctcatagttagccaagaatcgaaactcacgagattacctcaaagttctatgaagaagtaaaaaatccaaataaaagaaatgttataggaacacatttttcaacaaaatttttctaggacacacttttgtattagttaaaatttgtcacaattacatataaaaaattaaataacatatcatactcattaaattttaattaataagagaatatttgtttaagagagagtaattgaatgtatatttgtaacatgtctcctactctaattacaatagttaaaaagaaaattgtgtaacaccaacattttttaaaattttggtggtagtgtgagatcttggaagcatgcatgtgagagtgatgttgacataaaatgtataattaaggtgtgaatcggcacatgaaaggacggccatagcatgcgagctagcaaattggaaggtaaaggggagaacaatcctgtcatcacgctcacatgcaaatgcatgcgcacattgcatcatctatatctatataattgttttttttattattttatttttattttaaaaaatttaaaaattttattttattatttttctctcactttttttttttctctaaaaaattgtacattgcaggggttccaaccgctacatttctgtatctcatgcaacttgcccctttgctttgcggctcacatgttatgcaatttggatcaatatcaatcaatcatcactcacgccgacaccttttttatttttcctctttcaaatcttttctttttgtcatcaaacttgttttgctttattcctggatttcttattagtttgatgtgcccttcacaaattcgttcattgaatgttacttgaaaaacatgtaagcaccgtctaatttttgtgcgcgcttacgcgatctgcttccattattttaatttactcataaagcaatatatataggttgtgtctcaactaaagtattaaagtaagatcagcaatcattatttgggatacgattacgagtgaaaagttcacgtactagtttgtgctgattactcactgaagatgtgacccattaagctatagggatgttggttcggtttggatcgatgctagtgttagaatcagaaacgaattgcaccatcatatatagttggatttggattgaaaacgaactgcaccatatacagttataaatccacaacatactggattgtctagcttacttctaatgaaaatgatgtttgtttaacttattcatatttttatttggggtataaaccccctccacatacatatgttaaggatacaattttatataatatttgtgtatatttttctaaaaataagagggagagagagaagtatgaaataaaatacaggtgatagatagaagaaaaaaatattgtgtatatttttgtataagaatttgttgtatgaataatatttatttgttaaagttaaatttacaatttaattgaaatgttaatttttatgaatatttaggtgcatgtttgaataaatattgatagaattgatttggaataaaattgatttttgttaaaattgatttgaaagtaatgtaatttatttttgaatatttttattgtagaatcaaattatgaataaaattaaaattatttcaactcattatacaacttaaaatcaaaatataaaaatatatataattaaactagcattaaataaattacactaaatcttttataatttattatttattttattgtaaaggttagtcattgatgttaatttctttacatactgacacagttgactaagacatggctagccaagtaggtagcgtagcggtatctgtaggttggcaaaggctccccataaagcacccaaatactagccacataacacgcaaaacaacttcatatttgtcagcctctgtcaagtgataagattcaaaccagattttattccaacaacaaaggtcctagaaccttcaccacaatttccaaccctaaaattttgaactaacacaatgcaaattacctacgccaaaatttcatcattagttaaactcttgttctagtaaactgacgtattattttgtgagccgtagaaatcacaaatatatttcaacgatgcaatgttgtttgaggtgatagaattaattataatgatttttctcatgaatatttattataattacatactcgatctaaatttgaactcacacacatgaggttaattactagtaaatatataatatctttttaatttgcttcgggttttcttttgttgcttcggagtaaatatataatatctaacaagtcatgcgtagaaatatgatttagtttgatatataatataactgaggtttttttgtttttgccagcagtaattaaatatatttatatgttaaaaattaacggacatcagaaatgcctataactgaggtatgatatacaattatataaaataatattttgtattttaccacataagatataatatataattacatataatattcataattcattaatcataaatcaagccattaatattgtaatattatataaagcactggttttgttaaaatataaaacaaaattatttgcacatcttttttttaataatttaacttttcatgaatgttttttgtttgatgaaatatttgtctagatctttataaccaaataatctagcgtttaattgatccttttcatttttaattaaaaaacatttattgctcgaagataaatttgtgtattgcctatttgtaagtaaaattttcttgtataaagagacatatttaaaatataatatataaaattatttatgaatatatatatatatatatatatatatatatatatatatatatataacacttaagcttgtcaaatatatatagttggattgataacacatctttttcttctttaagaaaaccacactagctattatattaaccacatttcctcacttgtacttatctctcttttctgttttttttttttccacttactatttgaatgaaagaaacagctgtcacaaaacatggctcagattgttttaggattgatgaaaatgaaatgaatgaatatcgtacatatatataaagataggaattcaatcatgggatgacgctgaaagaagattatattgcatgtgatggaaggacttaagatcatgcgtgaattcaatcagggaagaatgaggacaattaatggtactatatatgcatgcctgcggcgtacaaattaaaacttagggtggtacatgcgtgcctttcatctacgactcaactttgtggattaatattgaaatgaaattaaacttattaatggaattataatggatatagaccagtgaattgaaatgatcaatccttgaaaattgaaagcaaataattcttaagtcacgctgcactattaggagacaaacaattatcaacattcaatgaaatttgattctagctggttgtatatccattgagaaaccacgccagtgtgtgaagattgcattaccaacttaagtctataaatggtgactggtgttgtcaacaaacgtcattgacaaacttctaattatttaaaatttattaaaattgatatggatatatatgtaagggagtgtgtgtcaagtctatatcatgcatatataaatggatatgtatgtaaagatcatatatatcaggtaggcctatggccaaaataaaagtcaatgaaaacactttatttatttattttatttataaaatagaaaatttcacagctatcccaaaatgcacggattattatttatcaaattttgtttttactaaaaacatgctgaaatttttcaaagaaaaaacaccctcaaagactaatcccacacatcaatgaaggtgttgaaaaaatttctaatttattaaaaagaaaaataacctataataattaaagagatgtgtctttcttttagccacttataatcgtgtcactgtcattattctttaaacgttatgaagccacttgttccaaagacaattggtgtagaagaatatggcaagagatatggacttcgtctagcaattgatgagatgtgagagctgtaaaggaatgtgaattatatacatgcatagtactaccgtaaagtgaacattccagttgtaattttccctctttttcacttaaaaatatataaattcctaactacggtaagcttgcactcattcctaatgccgttaacattaagagaggaataaaaaattaaacaggtattttaacaaaataagaagatcgactttactacatgctgagtgtgtatggaaccactttaaataaaaattcaaatgagtcgatcatagttaattatgaaggaaaaaaaagttgaaagagaggaagaaaagaaaaagaaaacttgaattaatatttttgagtaattatgtgttattaatataaaatctttatcaattttattaataattaatttttataaaaactttgattgatattctaaatgaaatattttcttctaatcatatttattttataataaattcgaattcaaaatcttaatttagaatcctccaaacctgacaacttgaattaatatatatatatatatatatatatatatatatatataagaataacagcttaacatttatttttagcttggtttctcagcccttaaatttacatggtataaatgggttatataccagcactgacatgaccacaacaagatcacatttcataacataaagagtatagagcagcaaacgtaaaagtggatccaagaaggctatatggcaagcttccactatcttcacaagcatcagaggagaaagaggagacagtagaagagtttgatgcttataataattatgcatcttggtcttcagaaactgacatgtctgaaatggtttctgctcttgctcaagttatgggaactaccaatcggaacccaaacatgtcacaatcaacctcctttcctttctcaacttccgtggtcaaagatgaacctcaaccatacccatctcaacctcctccagatcaaggtttgctagccatcttaatttattttaatttagcatgttttttttttctttcttttttttgtgtttaccctcagttcatcggagaaaaaagccttgattaattcaaaatttggtcaaagtaagtaaagttgaatattactcaatgattcaattttaattttgacacatttgtatataattacttaattagttattaattagcatgttttaatttccaaaaattgataaaatttgtatgtttttatataatgagaatccctcattgtttggttttctaaaaaagaaacactttaatttctgtatctttaaattccaattaatggaaatggtggatgcgtggatgtcatcgtatacagaatcaatttgttttcgataaaaaaaataaaaacaaaaacataatccattgtttttctgaatttgagatacctcattcttgttgtatactctgatctatcattccttgttaaattcaaacaagtaaaacggtcataaatttatgaaaatgttctagactccaagccacaaacaacgataatctatgatctttattgtcaataaatataaggtaaaatacatgtttattcaaagttactcaaattacactatttttatccccaaaaagttacactgtttttctctcatgaattttgaaaaacattatattttaatgtaaataatttttttatagtattgaataattaggatgagtctttatatatatgactgcttgctagtattattagtagctaattgtaaatataaattattaattttaacttttaagaatatataattttaaattaacaaaacctatcaactttgagattttatttctgcaaaaaatacttttgagattttatcaataaaaatctccgtctcattttctaacatttcaaagttaataattgaagttcaaaatttcctataaataacattgagattcatatagccaaaaattaaccttaaaaatcataactcatttaaataaaaaggaattaataaataagataagtcacataatttcaagtaagaaagaacatgtaacacatttaatttgcctttattttgatccctgcgtctgtatataaatatcacgttatatattggatgatccacatagtaccacgtaaatgatgcacaaaatttatctcatacgaaataatttatatgttgctttatcactttcaggaaagaaaaaataagctattttcataaaagaaatgttttaaaagaattataattaagtcaagctagtcacttttcactgaaataaaatataatttattttgtctctcatcacatcttgtttaggaaaaatcaaaaccaaagaatgccaatatatataagttgcatgaggacaactaggtaaataaataaattcaatgcatgcgtctgtcttttattcaagttgtcgtgacatttcttctttcttcttatctatgcatttctcatctttgaccaatgccgaacatcaaggggagctaaaacatgagaatttcttcacgtaacagaataaaatataaaataagtacttctcctattctccagctgcatacgtcacatatatttttctacataatacaccattttttttttttatatatttacatgcatgctatccctaatctacttatctgttactcccatcggattatttactccctcacattctagttactactctctttttacagtggtaaatgcagtccaataaatgtcctatgatcatttttgtactttgtatgcatgatgcatggtatgtgaatttgggaattattatttatatgttaatctagagtttaatttctcatgccgtgaccatatatatacatatatatatatatatatatataatttttttctgttaattatgtagatcagtagcatagcgaggatatatataagtaaatgtaaggttgtcaaactcattttatttacgtaaaatcatgaaattgtaagagtgtatcagttaagtccaagtttgacgaccatggttttacgcactaggaaaacataaaatctgtacctacctttttttggacaaaaaatctgcaccgatctacctaaaccttgttaactcggtttttacatttacattcgatatgatctcctttattttagtttggacagtagcactttcatttctctatagtcaattacattattataaccactcgtgttttgaaatggatccgttttctggattgcattccccacatttataattgcatgttctgttctcatgagtcagtcttgtagaaataaataataacttaataaatttgactacagactgataggatttgaattcaaataccatgtaaattattcaaaccttcccactactaaggtaatcttaataaactagctgttcttcttaccatgacataaggagttaatacatttttagacactaattaatactatctcatatatcatatattttgttattgtactaatttttaagatgttataccatgatgaccaacaatgactttcaatcaatatttagacaattaaaacagttaaacttagttaaagatcgaatgtgtgagattattataaatctcttaacatttattttcgattcttacgaataaaaattaaataattctacatttagacaagtgtaaaatttacacataaaaataggcttatgtagaaaagcacattaaattgaaagaaccaatctcttattgatttgcatgtgttggtgtagaggtcacaaagaagcaacactacagaggagtgaggcagagaccatgggggaaatgggcagcagaaatccgtgacccaaaaaaagcagccagagtgtggctaggaacctttgaaacagctgaggatgcagcccttgcatatgacaaagcagcactcaagttcaaaggcacaaaagctaagctcaatttccctgaaagagttcatcaagatgttccctatatgcaacaacaccaacaacgttcatcaaacagaaacgtttttcccttccatgcaacttccaccactaatagtgctactgggtctgtttcttctgttgatgttgttgctcctccttcattgtccacacatgatcaacatggccaccaagttttcccaaatctgtatcaatatgcacagattctttcaagtgatgatgcacagttcccttattacacatcccatcttttcaatcaagaacaacaacagcaacaacctttcaattctcaattctctagcactttttcttcaacctcatcctacttctacaaccagcaacaacaacatgatcaacaaggacatgatcactcaaaccactagcaaggtaatattgatctgtgtgatttccaaccgtaacaataaagtttttcaagtcttaattaatttgtaatcacaatgttgtaactgcaatattgatagcatgcatgggcattaattagtcgtccacaattttccttttctcaaaatagtaagatttttgaggtatgtaactgtggcggcaatttaggggcaaagcaattttaaagcttgactagctagttagtatatgcatctgtcaattttgctgtagaatattgagtcagggattaatctgtttctttaagcgtgcacaagacatggatcccacatttaatttccaatttaattatggatatggataactttttgttggaaagtacatcgtgtcatgttttaattattaaattaatttgaatgctttttaattgtttgataatgtttaattaaaagttattaaattattattattattattttcattagattcgttactttgtatttattttttaaactttaaacttctaaattgttgaaaagttatcatcaaaataattggatcaaactggtgtgaaatagaattatctttactttattttatagtaattccatcttactcaaatagtattatctttcagaaagatgtctaaaaaaagaaaaaaaaaaccatttagtgtaaaatcattgaatttagctcagtcacgtttaggtgcatcacaacctatcatttatctctagtaaattcacagtgggtgttttccctctttttgaaagaaaaggtgtggaaagttttggttcgcgttgaacaaaggtctgcaaataccaatactatattacgaagtatgagtcgttcattagacggaactgagtctgtttcgattaattaaaggagcgagaggtggaaaagaagaaaagtagtgagaattgattgaagtatctttttgacctgttccttttgcatgcccccttaatcaattactgtttacgatgagaagaagtacgggagaggacattgaaatagaaattataacaagataaaattttcgtccattgttacacccgtttttcgcaaagcaagtcatgtcgcatgcttcatatagaaagttccatagtgcatatggctttacgtatttggagttccgacgtgccacctaccaacaactttttaatctttttttattattagtgagagatttttttttttttaagttatgttataaagtgtgaaatatttataataggatgagaaagactcaacatgtccacaaatttaatctgacccgaaattcatttggatgagtttgaattttaaaattaaactcaatatatttttcaggccaagtttggattatgcttattaaatccatcccaactcgatttagtgtaccctaaatctttttagaaatatacttttttataattatgtattaataataagcttttacccaataaataatgtttttgcataatatgatattgtatttagaataatattaaaatatcttactttaagtttatatttttattttattttatgatttaactatatttaatattaatattaatattgatatattatgttaaaatgtcggattgaccgatttcatctcatatattttaagtcttgatcagattagttctattttacataaatgatcaatcaaaatttcagatcaagcaagagtaaagataaacttgtcccaattgctcactcccaatcaagtgcatctgatataccacttttgtagtatgatttttggtggtagtcataaatgatggctgtttaagggtagcattatgggttagctttagtgtgagaactcgtagaaacaaaatggtatcattgtcataaagccttgaatcatgttagacataagtaggctttaggtttggccctcaaagaagttagataaggccgtaaaaattattataatatttcccaacttacttccctatatttttattattataatttctatttaattatagaaataactcatacataaatacttacataataaatatttattcaatacgtactagattatttaaccaaagaaatcagtttggttgtgttatgtcacaaacaaccaacacaatgagaaaagagccaaaattaaacaagtttaaagtcgtcatgaatcacttttttcgtttaaaaacaaatgatagcaattaaacattttaaaaattatggtttgtactctagagttcaagatctagagttgtttatgaatggctttacttcaaagtctcgagaaaaagagtgcagtttaatatcctaaaactacccataaaatattttagtgcgtgacaaggaactggtgaacttaaattaaaaaggatgacttgcttctccaaagttgggaataaacagaaaattctagcaaatatgcattcagcaagtggagtacaaataaaatggccactgagaacataattaactcattagttggacctacaagtcttgaagattgcagcaaacttaattaagacatcaggaaataaatcctctcttacgttacatacatagtatacaaggtttcaaaatttatgcttatttctctcaaataaatattgaacaagttgtattcaaaatttgaacacgaccttctcgtattgatacaagtcatttgacttttcatcccaaaaaaaagcttaacattgatcctaaagcatctgatgttttttctatatagatagtcatttcgcataaaggagttattctgcaaaaaattatacaataattgatatgcgtgattaatacaacagcaatatgcccaaggtgtttcctcaaaatacagaaccaaatcattctttaaatggtgcatcaccatgatcactctgcatgtggctctcgtatttatctgccatcataggcagagaagggtgcaactctgagcgcggaaataaaagtttcagacggaaagcatcaactccattcaaatagtagtgaaagagccgcttggccctaataaagccaaggcgaccatacagtgccagtgctcctttatttgtcacttccgcttctaatgtaacctatacaaataaataaccattaagtttggtctctaaagccaaattctaaacaatttaggcttaagctacgagcacaaatttatgctagtcttttcactaaatgaaatgaatcaaaatctttcatggcaccatggtagaaggattgattagttacttcaaaatgaattaatctcctagctagctgttggcactcaataaggaaaaatatgccactccaagagtgcttttaccaaacaaaatgaagatagcagaaaacaagaacaaaactgaagtgttagaggcaaacaaaaatgaggcacagacactatcaaaatcctggtttaattaatgaaggttgtagaatcagaaaatgcagggcacagttccagaacatggacctgttttcactgctatatctgattcaactttagaaacagaagttaaaataaacatctttccatttgcatataggtagaatttagtaaacctgtactttgaatctttcttctcaactaaatatttacacatattaaatcagcaaatagttttagtctcgtctttgagccatatactattatttaaagaggtgcatgcctgcatggagaaaactgcaaggaggaaaaggattttgatattctaatatacattcaaattatgggcatgtactgctctatatcacagtgcccataccttgttttctcatgtaaaacaacatctaagtaagcaaagttaaacaaaatcacacgtaacgtcttggtaccaatttcaatttcctatcagtttctacattttctctatttgcaatgatatatcataatgcaactgatagataaatgacataaaaccaggctgacagtaagattgtgagccattgacctgcgtatacacgaggaagggaagacatgggcctttaggtgtgtcaaagaagacgagaaaaagggggccaggatggaatttgatgaaagaagggagagaaggagtggagaaatcggttggaagagggaaatgctcaacagaaaacacagctggcaaaaggaaattgggaggagaaaattggagaatcataagagtaatgatgagggaaatcatataggggagggactggaatgtgaggggatgagcattgtgggtagtgaaggtggcctttggcttgaggaggagagtgcaatatcctatatggcattttggccgggttctgttctctagttcatcagagattgatatacaccataagaatccattctccattcctttaagctgaatattatccagattttacgttctatattcacaagattaaagttaaaggtaaaacaaatgaaaaggaaatgaagaaaagggagtgatagacaatcaaattgccaaaactaattctctgctccgcaggtgaaggaataaatgtgtcaatcatatttaggagtttaccattttcatcccatctaccgggtagtaattattcaatcagtagttcagtacaagagtcatatgataaatacataacaatcattcccaaatcccagtccactgaacttttattgtttaagatgaagcacggtgaaattcacatattcagttgtcagtttttcataccaaccaacaaggaaactcaatgctttctctatctatttctctcgatcttcactccttcccacattcttaaactacataacactgcaatacaaccacacatggttacacaaatacgcatacatacctcttcgcaacctgattccatcatcaccttgatagatctactaacaagctccgtagctgcagaaaaaattaaggaaaagtcaaaacccatacatttgtagcatttggcagcatagcaccaaccctttgttagaatatctaataataacatcacaaaacaggaaattaacaaataaattcgttaaaatttggtgcatgattgagaagtgcttattctcaaaagcccttccaggaagttgacaaaaataagtaaaacccaaatacacgcacattaaaagtttagatacttatttttccaaaaatatgggaattaccaatgcctcttcctctgtagggcttgatgacaaccagcatggcaatgtagcctctgaaagtgttacggtgttcccccatcttacataccacggtgcccacgcatttacccttgtggaacgcctaaaaccaatagggaaattataaaataaaaaaaaatcacaaatctttaatgaaatataagtagggaaaacgagaattagatgaaaaagtgaagagataaggaaccaggaaagaaagctgaggccagagatagacgaagtaacggtacgtgaaaatggaataaggttcgctgagttcttggtccaccaggttcattaccagaggaaggtgatgctcgccaccgtaactaacatactcaatctccgaatcatcgaattccacattctccatggtttctgcttcgtctctgtccattgctccctctcttctcttgcgcagcaccaaggaaaacgatgcgagttgcttgggtaattctagttgaggccttacttcaacactgtttcgctgaaaagaaggtgaccattgctatttgtacatctctttttattagtatggatgaatacccaaattggaggtcttcaaaagtatgactctatgaggtgttttcacttatcacttattctcctagaagtaacaaatttaaaataactcactatcctatcactttaatatctaaacttagttatttattgtcactttcacttttaaaaataggttaatattattcacacgattttttaattttgataaataaaatgagtgatagattgtacttttatgaatctttttttttttatagttttattacatttgtacaatcaatataaagaaaaaaaatgcatggtcaaacacttttttttccaaccatgattttggtacaaaatagccgtgtcatacataatgattaaatcttcataagtgtgttcaaggtaaatatttttctttcaacaccatttattccatacttaataactaatcgggattcaaacttgcaccactttattaagaaacacaaaccatttaccatttgtgttggttggtcaaacacttttttggtctatggtattttaatttaagaaataataaacaaaaatatttaataaatattgattttagatttttttgtataattacatatattggtcaaatttaaaattaatgttatgctacttaaaaaatatatttcatgtcttactttcataatagaaaaacatctattttaccatttttaatttttttttatttgatgaatagtatgtttatctttataatacataaaaagtataatgatttaaataatttaaaatataattttattttttattttcatttaaactataattttatgttaatatttaactttgaaaaataaataacaattattatttgataaaaacaaaacataattcatcgtgtcaaagaataaaattacttttttaggatatagaataataatatgaaattataaaaactgatccagaggcccggaggaacaaaaaggcccagcccaatgtgggaagctaagtgcactatatctaacgaaacaaagacaatgcaaactaaaccctagtggcagtctcactcgccgtcgtcatccctcttccgtctagggttcctcttcgcaacaatggttgccgccaagaaaaccgtaagctctgtctccctctctctgcaactagcgttgttgatttgttcatgtttcactagctttcagatttagggttttcaattccaattcgattttaatggtttctgttctgtttttctttttgaacaaatgcagaagaagacccatgaaagcatcaacaacaggctcgctcttgtcatgaagagcggtaaatacaccctcggttataagaccgttctcaaatctcttaggagctccaaaggtatcgcttttctacactttcgcattctctctttgtttattttgggggaccattgtttttctacacttggctcagatccgtaactgatgaaaaacggtgcattgcatttcatactggtaatggacccaggatattaaataagatcaacattagaaatttcccccaacaacagaaagtgtgttaaaaaagcatgttgcttgcattatagttacaaatgcatttgataatgttaaagttccttgcagccgcttgcctaatttattgactaatttgatctccaaggatgatgtaatttgttttaaattaatgtggatgtttgcctttgttaatattttggcagttgtttatgatgatgatttattgatattcttgaattctctgcagggaaattgattatcattgctaataactgcccccctttgagaaagtcagagattgaatactatgctatgttggcaaaggttggagttcatcattacaatgggagtaagttcttgatccgatgcttttcttccgatccccgtgttttttacaataattttaatgttaatttacattagatgagaggttgaaaaatcttctgtttttgatttgatagtttaagtaacatgcctcgcataactattttgatctatatggggtgtgatgtgggtctgcagacctcatatcatctaggtcgatttaattttattggatttgacttgggatattatgttaatggtacttgttttatctgttttttattaacctgttgtggtttttatcatgcgtatatgtgttggctatatgtgaactacttttttatgctgaactattctgtcaattcaagtcaatgtttggttacatctaaaattgtctatataaattttggagtcactgagagagcttgggtcggtcatatgtttgaatgtcctgcattaaaacatgaatggttttattggacttgttttttaagcatctggtgattaatttccttcattgattgaattttatatgatctgcatttatagaagctgatggaagtgtttagctattgctattttgataattacacatgatatggttgctgaccatatacatttttggatgttttgcctgtataaattattgcacaaacaactggattgtaattttaactatcgatgataattgttggatgctatgatacctggtagatattgtcatttaacaaaatatttgtctcattaacaaaatattttgttgtttttagacaatgtggatttgggcactgcatgcggcaaatattacagagtgtgctgccttagcattattgatcctggtatctgatgcctcctttcctatttcaatatttgaaagtagtgtttatttttgtttttctaatgctgttttttatttgttgtttacaggtgattcggatatcattaagacactgcctggcgaacagtaaagtagtgttgaagttacttgcttgttatcttctggagggttttagtggattcagactttgaaagaatatcttgttgaattgtagactttgttgtaatgtgcaaggtttttgtgtgttctagctgagcaaaaagtaattttgacttttcaaagttttccggatgtttctatgccatttctagagatataattatattttgatcgcgcgtgctggtaatgcctgtgttatcgacgttcgcttgcaaatggttcttgacattgaatttgcgtggtaaaccccataattaagaactctaaatgggtggaatttctgtcaagctcttaggcatcaaaataagacgcatccgttatatatatcaagccaactgaaacaaatgttatttagttttcccaacacaatttatgtgggcatattaaacgcaattatgttctactgacacaatttagtttgcacgaccggggttgatgcgcatgttgaggaatctgaggaggaagtgctgtgtgtgggttccacgtcagagatttcgtgtagagttgggtgacggaaatgctgattacgaggaagggttgtttaggtgatgagattaacattgtctaaactaaatcacttggccttaggcagtgcattatggagagaaatcgaaacatgaaaaccaaatcaaacaaatatatagcattgttgggtagactagacacttgagtttataactaaattaagcatatttaggggttgactaagatttatgtttgcaatgtctgtaagaattggtgaatgacatgatacttaatacgaaagtcgttaaaaaaagaaagaagttggaaaaccaatatgttacacatataaattaaaattaactatacattatttcacagcacaaactcaaccacaacatcattcaaaactgttagttatacattctctccttgaatgtcttacgtgtgatatttatatttttataagtacaaaacacggtcccatggaatgtagtttcgcaataattttgtgtccgctgtttaactagttcgaggatacacttcttcaatgtaattcaagattgctcatgttagaaaggctaaaaagaattgttcgaggggtagaaactttgagcatagtttacagacaattatgttttcttgtttgaatagtatgaatgaatgaataaagaaaagagttaaacagtttatatatgataatctcagaatctcctcatcaataattgttggtgtccttagtttatttttctacagttttctatagagctttgatagaatcagttataaccgagagtattgttagaaaaatagagaatatcaaattgcacagaactgaacaaggagaaaatggaaccaattgaaaactttgttgtgccgtggaaatagagaaaatcaaattgcacagaactgaacaaggagaaaatggaaccaattgaaaactttgttgtgccgtggaaaatcactgccctgaaagcaaaattcggctagacctcggtgcaatccaaaatgccgattgctccccaaggttaacacaacgagcctatgaacacgtgcactcgtggccttaggctatggatatcacagaacaattgtccaactctttgtaacttttaaaacagaaaaggaaaaatatgcaaaacagagcagcagagataggagtgtcaaaaatcagaactgcagagaaatgtttctgctcccttctatatcagctgtgtgtctccctattaaaatagagaaaataggctgaaagctgtcctttagaatttctgtaacagctccattactcccttaaactccactaaaagcattttaatgcatttaacaaatgttaataaagaagatgtttcaaaactgatttgatttgcaaataaaaagcatttaaagaaattaaaaagcacaaaagaaaggcttctgtttttccattttccaacaatcccccacaaatggtaaaacatgaagagaaaggaaaaaataattgggcaaagaaggattaacacttaagtaccaatatcataatgattgaattgatacatagtgaagtaaggtaacaattttgtctaggcagtgaattactcttgaactaccatgactccaattgagacccccacaacacatgtattgccttaaaatctgtgatatccgcgataatcataacaagcgctttaatggccatgcgcacaccttgggtactcatgagtgctctagaaaactgtccaagtctttcatagaaggcgacccaccttcacactcacgtaggtgaatccatcaagtgcgtctcaaaagcaccaccataatcggctatggattcattaagagcataaaaatgctcagcctcataatctaacaagtggtgagtccatcaagtccatctcataaggaccacccaacagttaaggctatgaactcattaaaagatcaagggcttcgtttcaccacaaaaggtatccatcatagtttcctcaacacaaaggcttaagccccatctcccttgatgtttcaagaactagtttccttgttagacctttagtaagaggatccgccaagttcctctcagatcttacaaattctaaagagatcacaccattcttcaacaattctttaattgaactgtgtctaatgcgtatgtgtctcctctttccattatacacactgttcatggcaattccaatagctgcctgagaatcacaatgaatagaaacaggtacagatcgttttccccacaatggcaaatctgtcaacaagttccttaaccattctgcttcttgtcctgctaaatcaagagcaatgaattctgattccatagtggagcgtgctatacaagtttgcttagtagacttccaagatacagcacctccacccaaagtaaaaacatacccacttgtagaactgacctcatcattatctgtaacccagtttgcatcacaaaatccctctaacacagcaggaaatttacaaaaatacaaacaccaatccatagttcccttaagatatttaagtaaacgacgaagtgcagtccaatgttcatttcctgggttatgagtatatctacttagtctactcactgcatatgctatgtcaggtctagtacaattcatgagaaacaaaacactacctatgattttagcatattcagcttgtgaaacactagaacctttgtttttcattagatgtatgctagaatcatagggagttttcacaggcaattcatcataacaattaaattttttcagtatcttttcaatataatgtgactgacacaaagagaaaccattatcaaatcttctcattttaacaccaataatcacatcagcttctcctatatctttcatatcaaaatgagaggacaaaaataattttgtttcatttaccacagttaagttggtcccaaaaattaacatgtcatcaacatataaacatattatcacacattccagtccaattaatttagagtaaacgcaagtatcagaagaattcacaacataaccattacttactaaagtttgatcaaatttctcataccattgtttaggagcttgtttaaggccatacaatgattttctcaatttacacactttgttctcttgaccctgaaccacaaacccctcgggttgttccacataaatttcttctttcaaatcaccatttagaaaagccgtttttacatccatttgatgtacaacaagtccatgaatagcagccaaggcaactagagaacgaattgtggcaatcttagtaacaggagaaaatgtatcaaaaaagtcaatgtctttcttttgtgtataaccgacaactaccagtctagccttaaatctgtcaatagttccatcagtccttaatttctttctaaagatccatttacatttaattgttttacttcccttaggcaaatcaaccaaatcccaggtatgattagacatgatagaatctaattcactattaattgcttctttccaaaagttagcatcaatagaagttactgcctcaaaataggttttaggatcttcctcaatcaagaaagctgatacaaaaacatcatttattttatcaatatcattgttttcaaccaagaacgtagtaacgaaatctggtccaaaactactttctgttctttgtcttttactccttctaggttcattaacatgttcatttagagtagaggaagaagcaggcaaagataaagtaactgaagtagtattagaagaaccaaccacttcattaacatgtttctttaaaggaaattcttgctcaaaaaattctgcagttctagattcacaaatagaattatcattcaaacacaagaatctataggcagcactattttgagcatatccaataaatacacaatcaaaagtttttgttcctatgtttgtcctcttataatctggtagacccaccttagctagacacccccacactttcaaaattaataagttaggtctaaaacccttccataattcataaggagtcttatctagccgtttatgaggaactctatttagtatataacaagcagacaaaacagcttcccccacatttggttagacataccagaacttaatagcatagtgttcatcatttcttttaatgttctattttttctttcagctacaccattttgttgaggagtataaggggcactagtctcatgaacaattccattcttttcacaaaaatccttaagaaaaatggtctcatattcaccacctctatcagacctaagccttttaattttacggtccaattggttttcaacttctgccttatattttaaaaacatttctccagcctcatcttttgacctcagaagataaactctggtatatctagaaaaatcatctataaaagttacataataccttttacctcctctactaacagtgtttttaaaatcagccaaatcagtgtgtattaattcaagtagtttagtagttctgtctgtgacaggtttaaaaggcttctttgcgtattttgcttccacacatataggacacttagaaaggttatttacatatggtacattaatcaaatgcatatttttaagtttcttaatagaagccatattcacatgtcctagcctaccatgccacaaatcaacagactcaacaatataagcacaaccagtcaaagtagtagcattagaaacaacagaaatggtgttcaatacaaacaatccatcagcaagatatcccttccccacaaaattcccattcttagttattactaccttatcagcttcaaaaaccaatttcagtccagccctattaagtaaactaccagaaattaggttcctacgtaaggagggaacatacaagacatcactcaaagataaagtttttccagaagtaagtttgaggagaatctttcctttaccaagcactccggctgtagcagaatttcccatgaagacacactctccatcagcagcatcctcaaagtgatgaaaaagctctttgttcgcacataggtgtttagaagcaccggtatccagaatccagtccaccttgttgtccaccaagtttgcctccactaccaccgcagctatcactttttcgttttctgctagatgtgcttgaggtgcaagtggtacattcatcgttgtttcctgttcaatgctcataaacaatttttgctttcagattgttagaaaaatagagaatatcaaattgcacagaactgaacaaggagaaaatggaaccaattgaaaactttgttgtgccgtggaaatagagaaaatcaaattgcacagaactgaacaaggagaaaatggaaccaattgaaaactttgttgtgccgtggaaaaccactgccctgaaagcaaaattcggctagacctcggtgcaatccaaaatgccgattgctccccaaggttaacacaacgagcctatgaacacgtgcactcgtggccttaggctatggatatcacagaacaattgtccaactctttgtaacttttaaaacagaaaaggaaaaatatgcaaaacagagcagcagagataggagtgtcaaaaatcagaactgcagagaaatgtttctgctcccttctatatcagctgtgtgtctccctattaaaatagagaaaataggctgaaagctgtcctttagaatttctgtaacagctccattactcccttaaactccactaaaagcattttaatgcatttaacaaatgttaataaagaagatgtttcaaaactgatttgatttgcaaataaaaagcatttaaagaaattaaaaagcacaaaagaaaggcttctgtttttccattttccaacaagtataactagttctcattttactgattttagcgatcaagttattcatccacatatcatcaatatcataatgactcaattaagtacacaaattctgttatttgattctttgtattacactatgagagcatgctataatcttgaatttactacatgatcttttgtgtgtatgaggttgtgaaagtgaaacttaacaaatgtatcgtaaattcaaaccaagactgaaattttagtctgtttggttccatgtccaataggcaaaaacgggcgcaagtgttatctgacgtaacggaagaccaaaccagctactagaattttcaggaatgaagtttcctttctaaaagtaaattttaaaacagataatgaacactagtttggcacttgccttttcctgctcatcatatttcagtttatagctactactacacaggcaaaatattttaaaaatggaagataagttctcaacggatacttatataaccaactatcaagaccaacaatgcgcagcaaaatcaactttaatacaaattgaaactatagccagtatactactcgacatccatatcctgattattcttcctagccttgctgattttaaaatcactgactgccttatcaaaagtgctcctaacatgctggcacataagcatcagatcttgacatgcatcttttaacacctcgcgtgatggatcgcctacagatgcagagaaatcgcacattcaacagcaaaatactgatgcaaatagacaaatttagagcataaaaatacaagaaacgtaatgcaaatacgcatatgggcattaattaagagtcatgctatacatgatgtaatttgaagatgatctacatcagtacatcctactatgttttcttttatattattatagaagaaaaataattttgtataatgtgtttggctgcttaattatttatagatgcactgtctaaactctaaaccttataatgtgtttatatctgaactctgataagaaaacttcttagttcaacagagaatgtgatgcaatgataagaaaagtttttagtaccacaatgtcgtgatagaatagttggcttacaaaagtttggctcctattcataacttcatatctaccaaaaagtaacaaatagtaagtggagaaactattcgagattgtctaacaaaacacgaatttggtaggtaagtatacactactcttgtgattttaatacaaaaatagattcatggcagtagattgaggaaacaaatttgcaaatcacagtcacaatcacattatatccaccacgatgctgcatagttagttacctgttgtctggactctgatattaacacggttatctgaaggatgagggatgctgtaaccagaaaatgacactcttgggctgcaggacaacattaatgcaaaatccttcaaactccatttaaatggattaattaatcatgcacaacataaggaaaaaaaaaatacatatgaagagggagggggtctgtcaataaaaaaggagaaagctgaactcaattaggttttggtgagcatggattcctattcctagagagttaaaggaagttaggttaggaactgagaaagtaaaggacatactcttgatttaaggtgaatctaacagcgtttgcaaaagtatgatcctcatctacgagagaaaacgttgatttactctgatcagtgtatgagccgtgttccatcgctccacaccaacgatcaaaggaattcggatgctgcggcggcgagggtgggctgtgggaaaggaacaacaatatatatcatggaccaagaaaccgacgtcgttttatacaaacaaatttaaattcttcttctacctcttataaaattctcgcgtaattattttactttttacagcaagtaatttatgatgggtaaattagaactttatatattatattatacatcaacgcaattatttttaatatcacgtatcattgaaacgtattccttccaccaatcacaacctaccacacctcatccttaatttcattccacctattatattatgaaaattataagaaccaattaattcatatttgaagtaaaaaaaattataaatataataaaaattatgtgagaaataagttttatgattaaaaataattagtatcatttttaattttctgattattcatgagacttatttcataatttttttatcgtttatgtttcttttttatctgaatattaattgaatctcataattttatataaataaatttaataagataaattttatatattaaatcaataaaatagttataatctcaagtaacgtatggcttttatcacacacatattgttcatagatgtgttaataaatcggagaaaaaacaacattttaaaatttgaaatgaatgtagaaatcgaaaagaaaaaattgaatttattaacgtttacattttattccgtctttacttttgtctttattatcttttcaacacaataaatatacaaataatcttttgaaatttaaaattttcctttataccatacgggataaatgtacggacaaccacgtcaataatttttggtgcaaatgttcatataaccccatcacatatatttattatattttcatatttatttcttcaagagatatattctttgtctcacatgtatcatccgatcctttgaatacaaatatatagaaattttataacatgaaaaaaataatgatatacataaatttgtattaaggggtataatcccattagttgaaccagaataactaaatagcgtattaattttttaatgtatatttttatttcttagggatacaaaattacataaatttgtaggaataattctcatattatcaattacgtattgatgaaaaatttagctatgaaaattagtttttcatcattaattcaagcatcacaaaaatttagttacgaaatttaaaaaattacatgtaaattaatttttcactaatatatttttttatgtagtgaatgttcataagatggatccgtccttgttcgaacttgggaaatagttctattcaaaacattgtcgaacactaaatatgaaaagctctattttcatagtgatttattcaggagctatatatctggatatagtattttaaatttttaattatattatgaatattatcattgatgaattttgcatcaataaactagtaaatatcctgactagttgtttaagaattgacctgtaagaccaaaagggataagaacctacggattcaaaatgcagaaacaaagcatgcatgcacgtgaagcccaacactgcaagctgtcagagtcaaatttcaccacaagaacacaacatgccatcacttaccattttacataaaacacaaaaaaatggaccacgagagatatatatatagagagagagcgacacacacaccatagtctatcccttcataattgcaatttgcaatttgccattgctcttaactattctattttcagtaaagcactgtaaaaattgcttgtgtgtgtgtgtgaaagagaatctcaaccagcatgcacgtacaccctttatcattttttcagcctctttatcttttgctacctttgaagtgagtgagaaagatgttattccttctttgtctttctttctctctctctctgccttttttttttctcatccacgaaaagcacccactttgtttgcaaagttgctcctcttgcttcctccacaccttcttttctctttctgtttcttttgtctcccatgtttctttatctttctcttccacctgcacatgcatttgccactctcacatcaatgtcatgctttaaatttgtatatatgatgtgcttctcaaccccattaatcagttcggaatgttgctaatttaggaaacattaatcaacatcagttcaatcatgtgtcatcttttgtgggaaaatattcgttcatgaattttttacatgaaagttacaaacccaaaggtttattcaagtttgttacatttggtatcatgctcagtaaattggtataatctatatgttacatatgtaagccaatcttagatactggctacgggtgttgtagtacaatgcagattcgtccatacttaagcatatatatatatatatatatatatatatatatacttttatgaaccttttcctaagatcaagtgcagttcatttaagcatacacataaatcaattgaattgtaattttatgaaatttttaaaattttaattatagctgtaattttttttactcaattgatttcttattttaattgaaggaattttttattttgatctggaatatagcttttcttaagtagctattattttaacaaaacacaaaaatcgaagataatgttacactgccacttttaattaaagccaaacaaattagtaaaactgatttataatcaaaccaagttttgattgacgatacgtctagaaggaaaacacctagtttcaagtaatccctttctattttcaaaattaatattctcaaagtaatgttttttaaaaagtttttcttcattttaatcttaaaacaaagaaaataaaatgaaagaaaaaacaatttagaatatgagtgggtcatttgagtacgacttttcatcttaaagagaattcatttcttttcaattattctctcatccctttttgaatttaatttgtctttattttatatatatatatatatatatatatatatatcccttctattttgaaaacataaacttccatgtctgtgaaggtttactaaaaaattacaaaaaaaataatcataacaactggatcaattcattaatcttatcaggtttccccacaccctattgtgaaactatatattaattacagtcccggtaagcacagtggtaattattatgtttatcaattttttatatgttaatatttgcatatacattaaggatggaattgaaccggtgcaaacacagtaaatagtaaaccaattagccaaaccagatgaataatatttctaaatcaaaccaaatccaccgtcggtaataactcaacaatttgatttaattgtaactacaaaatatctatagtgaaccaattatgcttagatttagaactaatcctatcttaattaatatcaatgttttgaaggttaaattggaaaaatgtaaaatgaattatttatttattttttggtgtagaaaatagttttgatttaatgcacctgtgcagtgtttctacctgatatgccaattttgtttggatgttacgaaccgacattttcttctgacacagagagaggtagaccaacttatggattgcaaaatttatataaatttaaactgaagcaagagatgttccatttgaatatgtaaaagacaaaagatcattatttatgatcactagcttaaatatggaatgataattcaatctctaacaactttgttgactatatcatgttcatgtgtgtgacatctgcaaaaactattaaaatattgtagcatacttagtacagcagttacgggaactattgcattatccttaattgaaatacgtatcagcagttaccgtttcccgtgccatatttccttaatgtgactattctatgatgttattatttagtctacattatttactctattcctttgtatgtaatcctaatgaaggattggtacgtaggatgacagtgagtagacattttgtttaagtacccaaggagataaaatagtgtactttggatttcagaatctttagtgccttcgtatgagacaaagggaagagctatatatgttcaaaaagaaccacattgttgccatatatgtttaaatcattcaagaaaggagaacaaggtttgattgaagagttatgaaaaatttgacacttgcatctgaggaaacactttcatgagtggaaaattgattcccaaaatcacatacaagtgcaactgtatgagtagtagagagcagcctcctaggggggaaagtaagtagggaccaaaaacaagagatacgcttaaaacatgaaatacagtgggacaatataactatcactgccccacattcgaaggttataatctagacaacagatttgattctttaatcttggaaaccgcactttattgttctctttcctttcctttcgatttgaataattttgaaaaattgaaatgaacctgacttctgtatctcattttttggatacttctttagatacttggatatttatacatgatttgtataaattttaaattaattattataaaaatcaataaatttattacacgttattatatttgattttggattatattatagtgcatgcacagtttactcaaagttttacaatttctattttgcaaacaagggaaaaacaacaaattaagtacaataaaagaggcacaaacaattacaatattttaaaaaactggcaattttttgtgtcctagtgtttttttctcttcacttaaaatgacattcataattgaggaccaaagaaaagggaaatattaattgaatctaaagtgtttgaggtcttaattagaacgtatataataagattctgaatttctgataaactcattaaaggaatatacagtgaaaaatttgtggcacatacctcttcttcggattttgtttttgcatttgagttaggcgagtcagaaactcgaggttttgaactctctgtgatggatggagttgaagcagggctgggactggttgaactaatataaggaggtgtgctttgagtaccaacatctcttgtcattccctctttcttcttttctgcatagagagatacagtgtagaattgggaagtaacttgaactatgtccttccaagcaaaaaggaaataaagaacatggcttgctaattaagtgtgtgaacctggattgggaaattgaagagccacttcttcttgtgtgaaagttgctggctttgttgaaatgtgctttgaggaataaactagaggagcagacatggcaattctgtttattgagtttctaaaagatcttccactaagagtttttgcagataaacactccaatggtacctcccctgagagtgggttgcatatatacctttctgcttcattccactttgaatttaaagcaaaaccatctggagataagcattcccaactgttatagcttgaccttgcttgcaatgctacaattgaccaccaccatcatttaattgattcagaaaatttaagcacaaaaaaaatcacaaaccatgctaattatcaatgtgcttcattattattcacttgtagttgtacctttaagagcagtagtgaaagaatatgttgaagggtctatttcatctgcaacaaatgagagaatttgaggtgaaaaagaaattaagactttaaacaatgaactcctttgaattggagtgagaaaaaaaaaaaaaaaaaactaccttttaaagggtatccgggtgaagaagcagtgctagaaatggttatgtttgatctaaatgaccttgtgtcttctctaaagcttctcatgtaagatcccgagtaccttctggagttggttccctcacggctgattcgagctttcacagcccactctctcaaattgaactccgactcatctcttcttcttgagctataaggaagtggttcagctgttgaggccatgaattttagtcagaaaataattcagcagagtggaatgttgttgtaaatgttggttcaagtcactctcactccaactcaaactagcataggtttgaaagtgggtgctgcaggttcagacatggcaaaaaaagagtgttctgaagttgaagctttttgtctaggtaaggtataggtaggtggaatgtgcctttggtttggtatcaattcaaagaccaggcatgcctaagtaattctgtgaggagtgtttgtctctcctaaattttgctctttcactttttgaatctccatggtgcaacgacatagcctcaaatattatcattctatatttgctagtatgttatttctttttttggcctctgcattaaactcattggactctctcggtaacttttattattctttgacccctaatatcctagaccagtaggtgacttttaatcctcaagtgaatcatgggacattaacattagtccctattttttatgtggttatttgctgaagaaagacaaatggaaatttgtccatctttaatttcctttctagttccataaattaggatgctgtaattaaggccaaaatgtcgtgatatcacaatccatccagcacacatttccacatggagacaattttaaaaggttataaaaaagaatggatttctcatttgttagacatttcatggtgaattttcattttactcacattgcagaaaacaacacgaaataatgcatttgccccatgtatttgcatcaacatcacctttgggtgatgatggctcctcatattttctgtaggggattgtcacagcagcacctacttggcataccaaaatctaaactctgaaggaaggattattttgaccaaagaaaggaaagaacaaaacgatactctaacaatcatgatgagactcataaaaatttaacaactaatccatccttttaagaagccagattcaaagagcaatttgaacttaaaaatatttaaaactagataaaagttaaaaccaaagaaaactagataaatcaataaaagtatgtgtaaagtcacgagacaggcaatattttttaattaaataattttaagcctaaacttatattgcaagttgcaacttctaattttgattgccagaaaagttatccttttagcttttcaacttaatgttcatattaaatgattaagtataattgattaatatattaaatttaagattaaatcgtttaagtattatctaattaaatttaattcttgtcaaaaataatttttaggaaaactttatttatatcctaattaaactcggatatcttttttcgtatcaatcaaagtattgggaataatccaagtcccacatcggctagaaatagtgtcaagtcagagtatataagtggagaacaatcctcaccctatgagctagcttttgggattgagttaggtctaaacccacattctaagatggtatgagagaacttccatatcaaataaatgaacattgatgtgaccttcactttgttgatgtggattgtgcataactgcatatcattttcatataagttagtaattaagtgctgcataaccaaattacatgtcttgctcacaaatatgcaaagttcctcaattaagacaacactgaattgatgtgtgaacttaattgcgtcgacttaaaaattcttaatttttttttttaatatagctaatattgtatatcaggccaggggatataaaattgtgtagcgtactgcaataaacccttctgtttacaagcttccttttctatttttttgagcatgaaattaattactaagtattaattgttactccattattcgttcctctgatataattgaaaaaagaaatataaataattcgttgttctatttaagcagccaaatgtgatatagataaaagttttcatataccaataggttgaattgggggtggtcagaacctccattagtctttatcggatccacctttaatgatctcgttttatatttaatttaaatggtcaaagtaggtgtaatttggattgaattttcaattcattataataatttcctctccaaatagggttggatgcttgaaattaattatttgctcattgtcaatatatttggttacaataacacacgaggacgaggttaataacatgaatgattaggttaggtgaggatttaaacttttttctttttgtcgaggatttaaacaagaaaggttaaagtcgatacaacaactccttaattatgttaccctaaggtacaaaagaaaataacaattcgttcggtacatatataaataaaaaatgataatacattgtacccaagatcaagaaaagagaatgaccataatttagcaggccaacatttatattgtaattatggcaatttgattgagagaggctgacactgatgatgcaccaggctcaacaaatcactgatttctgcttgataaaatacaaattttttatcctgatacccaacccaattcaggaaactcctccattgaggtgcaaatgcaatcagataaattatatgctttttcaataaaaaaaaaacgcataggaaaaaacaagaaggaaagtatccgggaagcttctaaatcaaagacagaagaagaatgcgtaattgaatgctttactctgttaaagtttattttattggaaacttgaagagataaattaggggtacattctttaaattttaataacaactggctaggaaggctaaagatacaggttagtcatataatattgtataatttttttaataaatacttattttcgtaatttgttggacattgatgtttggatgcttaaaagatggaacaataaaatattgtttctaaatttaaaaaaatatgacaaatttatctcaaccttaactctcatccttttatccatttatttattttaaatttgaaagagtataattctagtataaaataaagtgacggttttaaattatgattgtgattgtattataatgaataaaaaaatctttatattataaataaatataaaaaatgtaactgatgttatcctgattaaatcataatatgattgtgaaatattaaaatacttttatcattacatacataatttagaatcatgaatgaagtgaatgaattagttttattttttttcctcccaagacttctccaaatttgagctagttgtaacgtagtgaaagcccaatgggggtgatcgcatatcagattttcactgttgggttgttttcagtgtagggtggatgtggagatcaaaagagtggttgtcagcgcatgcaatattggagtgtgagtgagaatgtctttgttacgggttccgcatgtgcatgtcacacattcttgtcgtgaccctgtgacaatgagtgaggttggggccctcacattatggaaaccaggactagggtcccacactggacctcatcatagccgtcagttttgtctgatgtgtatgcaaggtaggtatcaagaaagagagaggctctgttacccccctcagctctgggccccatttacttcatttattttataaagtttttctacctttctattctacttctaggagatatattttgtccccactacctgcttcccagtgaaatgtgttattgtctcatcttaatgccactggaactacattttcatagccaatgcaaatttccaaggactcttttgggaaacaattaacatttaattgcacatcaagttaggccattgaagataacaggtttgtttagtgtgtatttagatgaattttgaaaaaattgaatttttgaaattgatttggttaaaattgatttaaaagagaattgtttcttataaaagatatactcagtctttgcccaaaaagaaagtagaggtgccttgtctcaatatctcaaaaaccaaaataatagtatagtggctagaacgaggaaaattgcaatttcaaagacactatgttgcaacaaagagagtagtacagtttgctgagattgccgcttttctatctaacatgggggagtcaaacaagttaacgaaaagccaacatattcatatatttgaaatcatgaaggcctattcttgcaggttgtgatagaccttattcatgaggtcttaagcttttgtaaaagctgatgagctctacaaatacccatgatcgtgtcaatgtcacacatagtgacaatatatagcattagtagaattagctatatatttaactatacccatcgaatgaagttgtgtattgtagttgtatatctcaaataaaagaaccgtaaaaaattcaattcgatgtttcaccaaaaagtgtggcaaagtggaggaggccacaaataaatcaacttatataaaaaattccaattaaaaactgaactttgaaccatgtttgaaacattacaatgagtgggagacaaaataatcgtctgattgtgttatttttgtcgtgatatctttctgaaataacgtcaaattatatcattgataacttgatgttcacgtccaagaacccgttgttacctgtacatatccctagtagccatacacatatctccaaaataacttcaaaagaaatgagtgtcagtgccacaaaggttagatcggagatggaaaatgatttacatatgttcctagagaattatgtgttatttgagggcaaaataaatctaatctgatttttttaaaaaaatgagtaacttacttttatatttaatgttttacacaacttttataagaatctagacacgattatgtcgaaatactccatgacaattaatttttgccaacgatatttttagaaaaacacaatccaaaaaagtagggtgggggagagaagaaaaaaaaaataaaaaaaataataaaataggagggaaaaagaaatcatggaccggttttgttttgcatctagttttcaagaaatctaagatctaataacaagcccaactatacttttcgtgggtctcatgttttaatcttctccacaaactttttatgcctcaggtattatcgattactttacgtgattttgatatctttagttcatgtttggatattttataaaattaaattaaaatagaaattcatatgtttagagtcaatatttacatgtttagttttgtgtaaaagaattgatgttgagttaaataaaaaaattatattaaattttattagtggtttatttttaaaataaaatcattcacttcatttcaaaaatattttttacaaagataatttaatttaaaatcaattttataaacattcatctaaatatacacttgtaagatttggctgtagtgattttaacttattcatgaatttttaacattagttcgactcaaaaatgaaaatacatggacaaccaaaaatctttacgtggtggataatttttttcttattttataattatgtaaatatctatcttttaacaaattatttaataaatactgacttttacaaattagttttacacatgaaattaaaaataaaaaaggaactttggagtggctgttttaattgtttaaaatttgacattatttggagacggttataacttgaaccgctctctgaccataaattgtatgtgtctaatcaaatgtattcaagaaaattcattagtttcttaagattttaaacgcatggtagttatttctaaatacattgaccgaaaagttgtatcctttgattttgtgttcagctgttcattgggatccatgcttggtaactttgtctaaaaattatgtcatataaattcccaaaggcccaagaagaaaaccagctgagaggattacaaaagggggtgagtgagagtgaaaaaacataaacttgttgcatggagagagcatattttggtagagggattacatatcatatattatatgagcatttacactactaatatatgccctacccccattaaatccgtccatgaagataaagaaatgtaactctagccattaatacaaacaaaaacatgtcatatgatatgagctatggctaacagtaggaacctgtggaatctagatatattcctttctcttgtaaaacaaaccggttcatagcagatgaaaacaggggagaagcagagcatgaaacagtgttgtaaaagatttcacatttatgcttttgaattagtaagtaaaaacaatcactctctcacatggctttcatatcaaaggacattccccctcacataacaccagcaaacatttctaacttgctctttcaatgactcctgcaatgcaagttctctgacctacacaacacaacacaacaacaacaaaaataagaattacaccaaatacttgtaagtcgaccaaatgtatgaactgcaaaagttattctttggtgcagagtatgctcttctttttttgtttgagccaagccaggcagcaatttctgatatacaaaggagaatgaaagtagtacctaattcaacatgaagatataagattgacttgatgggaaaaggtgaataacagatagtgagtttgaatccctcactaacaaaaaattaacaactaatatttgtcgataaaaaaaaaaaaaaaatctgattcaacctcaagtccactgcattgtttaattcacttcatctgagttttgttcttaaaaagggtctggaaggcttaaggaaagaggatgtatcaaaattcccgggtagactggaccatgttgtgatgagaatcaatggcagtaatggatttttatccttcaataccagttagcctaatgatatactatgagaagaagattgagagggaaaaataagtgtttataatgggattttttttttcttggtgtcactgctgccattgattcccatcacaacttgctgcagccaactcgaggattcatgacttgcctcaatgagatgcaaccattatattagctgggattggtagatccgttacatgcaatatattattatttattatacattgattgatatttgactattttggaaaatgcactcaatgtagtacaccaagctgcattgattggtagtacagttttgcttaacaaaaaacaacacccacacaacccgttgagattgtactggcttcatgtactggaatcctgtactacatcgtctccttggtaaatcaattgttctactaatcaatttattgccatatatgccactgtaactcagtctctgagcttcaaaaaataatttgaaggggctaaaataactagaataataatgtataaattactaccgtaaaaaataataggttatcatcataatacttcttttctgaataaattttttaatgctacagatattgattaaggtttgtcttttttaaaaattggttaaacatatttttattctctctaaattctataagaatcaatttataacttaaacaaaataagagttatgaatcaataaaaactgagaatattgattcacggaaaaataaatctaaatatttgaaaaaaaaaatagatatgagaaagacttcataatattgcaaatacttaaatttttcttaaaaataaatcttaatgattcattaagtgggatgacagaagaaatcaaaaagcaatccattctttaaatgtatcgtgactcatttttagtcgctcttgaaaatgctgacttttggtttttcatttttgaaaatatgtcatgataaacctttatcattgactctgtttgttgcaaccaacaatgatactaatttgtgataacttttgaccattacaaaatatccttaatgttgaattatgaatttatattctgtgacaattttcaaccataccatagaatacccctcaccctcaacaagaatttccatacaccatggctgcaaactgggtagtttttactttgctcaattaagctgctttggaatctttgaacccccatcgtctaaatttaagaaaagtagttgacatcagtccttgccaattgtttagtcacgtatatattccttgatcaggactacgcaaaatgaactgtatttttggaagatttgcacacttatctatgtcttatcattacgtgcaatatgtgtttgatattcattactttcaataataacaaattattatatactgtactactttatttgttgtttaaattatactactacctaaaacccatacaagatggctgacctaagagaagagaaaaatagggtccctagtctgattctccctcagaaatattgtctcttaacaaccagttccaagaacaaaaacactcatacaagaaacatttgttatgcccaattattttactgtgctgtcttttggagattaaaaattggatggtttatcaatgtacacagataataaaatcaaaatcttcaaacactaaataggctagccctttcacattccttttgaaagataatcaaacacttgaacacgttgaaaatcttgtttgatcatgcaaaatcttgaaaatcatatctgatcatgcaatatgcatcaaaacatccagaaatacacaattactgacaatttcagataaactactaatttagtcaatcattacaaattagtagtattaactaagcatttccccaaagacatgcataaaaaaatgtataaggccctacttatctaatagaaataagcaatcgagaagacaaggagttaatacaaaccatttgtggacaagtaacattgcatcctcgttggaacagaaccaaagagggtagagaaagatgagagaagaaaatgataaatactgcgatgttttattgacaaaagccgaatacaagaattctaagacatttcaagccgctggatacctaaatccctaagagtgtgtttggatagaaaattttaattggggaaagtaatttattaggggatttaaaattcttcaatttaaaattcactgtttggatatttttatacgagaaatttaaatttttggaattttaaaatagaattttaaacaactaaaaatgtggaatttgaatttccctctaaaaggtgagaaattgaaattctcttcttttttagaagctctaaatgcacaactttttactccgtctcaatcactgacatactccgaccttcgctactctcacgacaccacccaccttacgtgttttttccgtgaatgaggttcaaaattttaaaaatgaagaaattcaatttctttatccaaacacaaaattttgaaaataaaagaattttaattgatgcattttaatttctctgaattttaaatttcctgaaattttaaaatactccatccaaacatactctaaataaaatatcctacttatacctcattatttttctacctgttaggaccactattaatagtcctattttagtgccctacataactattccatttgtcaatggcagacaaaattatataaaactacataattttagtgccacagcatgtagaaacattcaaaattttaacatcaagtaaaaagattagtagaaggatgtataggagaattttaaattaatctttacaaactaaattgtccaaaataagaacatagagcacaaagatttagaatttttattatgccgaatatgtcaaatatttagaaatcagcacaaagattcaaccaagcaggaagataatgctttagaccgactgtcatttaccaaagctatggtttaagaagcacaaacaaataatcctgtttcaaagaataaagccatgggaaagaagagactttctcaaatccctttcaaatataagatatccctcataactcacgtcgttgcatatagcaaccatttttaatttctctccatagtaactatgaagaaagcaaggcagtgtatatatctaaccctggtaatatatacatgctccccacagcataaccaacgtgaatagcatacagcaaactgagcaacgagagcttgaacacatagtacaaaggagcattgcctcaagcaagaaactgccatagtcaaactcattcattaaaaaaaaaaaggactactgaccaatgaaatgataagtcaaaaatagagtttctagtttgatactctaagacaaactaatgacacgtccctaaacagccaaacccaaaacttagcaagaacacctatatataaacttgttctgagtgttaactgttacaaatttgaaaattttaattgcttgttgaagtaaacgaataatatatatatatatatatatatatatatatatatatatatatatatatcatcaaaaccttccaaaatacatgaacaggttagctcttttgcttacctccgggtaccattaaacatataaaaacatccagtttcgttagaagtttgacaacaagtactttgtaaacaaggcacttacaatattgcaagatataatttgctgtacaaaaagagcatttaagacaaggaggaaggtaagcataaaatagacaaaaactggatacttcttaaatataatttccatacttaaagaactaatagggatatagttccttttttttttcgcccgactctttgctcttaagaatactagtttttaaaaatgagggattgtccttctctcatttaaaaaggtgttatttttgaaaaaatatcaactttctaggccattggagtgttttgaagcaagtactccagtactgcattgactatcttgttagatattgttgcagatacctgctgcttcactatcaacagcaccaatctagcaaagctaggaggttgagctgtcattgaaataggatttgagagttcctgcacaatttggttagcacggagttcagatattgccaaactggaaagggtggaattagatatacaaaagacttgtgcatcatcatgcaccaccgtggatgctgactttcacttcagaacccggtttgaaaaccatttttaggatttcacggtgtgaattgtgtattgtacaaccaaattgtgattttgtagatacaaaaattaaaacacggaagggagagtgaaggagccaagagagtttcgaaatttggcccactctgtattaaaatgtggataaatttaaatatatattagtacatataaagattaaaaatcattaaaaaacttgaagtgaaactaaatgaagttgtatgcgtaatttgtaaagatcaaattatatgcataaaaaaccaatcatatgctttgagggagaactacacgtgtttatcaaatctagaggtcaccataatttgaatatgacatattacattaatttatagaggaaacgactgctaccataacatacacatggtacattataaaattacagcatacaagaatcaaattcgcattaatcttcactacaaaaaaaaaaaattgaaattttcaacggtcaaaatttgttggtaacatcataaatttgtctgtaaagtcaaattttcgatgaatttccgactgacaaggaaaagagattaaataaattatatttaatggttacactaaattcaaatgtaatagagttaaagggcctccaaaacaaagataagagaataaataaattatatttaatttcaggggcattttattattttattaatttcaggatgtgttatgcacggtcagattggatgctgaatccaattgcctgtttgggggaggggacgtggagtgctgtttggaataacagatgatgaggctttttaaggtggttcccaagatggatacgatttgtgatttatgcaaatgttaggcaacatatagcagaaaacgacaattctctgctgtcatggctgaaggtatttatcaatttatgtatgctggtttatggaatatatatgaagcaaatcagctcttgagaaatgatgaagcatataggacaatctgatatatgcacttttgtggctgaagtttgcaagtctaataaaaataaaggtttgcgatgcaatattggatacatgctaggaaggcctttatgcttctctatttgtatatggtctattgcatttgtttttatgttagcttgttgtgttacagggtggggattgtggcagaaatttgttactgtcatcgttttcgtatttctgttgtagggtacatcttgtactctttattttaataatactttgtttaaaaaaaaattaactgaacattacaatttagattaaatttgtaattttctcccaaattgagattcaatagccaactccacaatggtcagaacaacgaacccatttctttaataggacaaattaaaaaataaaaaaagcttacatatatttaaggtttctaatatcaaattttattttatatttttaataattttgtatttatttgagttatgatttatttaaaattttattttaagtttttatcataattaaatgaggatgataatgatataacatcattacaattattgataatattaaaaatatcattttataagatcacattgtgtgctgactaaaaaaataacatgcaagcgattcaaatttgctctctacatcaatctcataaataactaacttttttaataagtaaaaagtatgtgacaacaactaatcaaacttaaaaatgagaagctaatatgatgatatccaaaaaaaaatatataaaaaaaaaaccaaccatatgcgtcgacgtaaaaggcacgtgtttataaaatatacaacaaataataatattattattatattatacaaacacaaccacaattcgaaaagataataaaatggtggcaaacatacttcctttccttattcatatattttttgaaacacaactaactgaataatgtcaagcttttcattaaatagaaacttcacaactacaaaacccatcatactccccacttattattattattattcagtaacttaaatcatactactacaaaggccaaaaaaatacaaaaagagttgatcaattagtcggtgaagccagcaatggtagcattgggttcaagggccttagcagcaggggaaggttcaacagatggaattggctcaacagtcttgacaagaagctcctgaggcaaatccttgataccctttagataaaatgtgtacaaaatcttgaaaggatacacaatctgatgcagcttcacttgacctttaacaccctcaaatatgccagacccaccagtcacagccaaatatgtgtcctcataggtcaggtaaggtccctgcactgctatgtgaccatagtctccaaagtagaagctgaagattgcttcatacctgtcccctttcttttcagctttgttttggatcaaaatacagataccagatgttatcccaatgcgcttttgcaaatctccagtgtacaactgcatagtatcaaaccaacaattacatggaaaattgaacatttgcaactacatcattcgaatcataacaatttaacaacaggatatatgtacctttatagctaataaagttaaggtttgaacataatacaaaacaacaaatgattcaacataacataaaattcagaatattataattttataataaaattaccataacaaaagtaaatgcgttcagatgcagcaaaacattgaaggataaaacttatgtacagctcttctgaggattttattgttgttatctaattagaattgaagttacactttattaatttgcataataaaactttgcattaaagttcaatatagattatctagttaaaattccaatattcataggagatcaacacaagaaatactgatgaaattatatctaaattttgtccaagaatggaagaaagttaccttgttgctaaaggggactaaatcaccaagggaattgacacttttatagctcaatcgaagataaacagggcttccacggtcacgctcgttgatctcatacacactcagttcttggactttttctacaaattagtcaagcaaaaaaaacaaaagggtcaacgcatgatcaagccaaacccactttcattcagccaaaagaaaaaagtgaagcaaaaaaacaaaattgaaacttgggtatgtctaccagactcagcaggctcagcctggcttctacaagtgaaagatttcctgggaactgaagacaagcaaaagtgtggcaaagtggagttcagcttgagatgtttggtgtgagagtggtttgatgaggtgaagggtaagaaaggtttggtaggtgaaggtgtgaagaatgatgttggtttggcactaacaggcttcacgaaggaagaagaagggatggttttcaaagcatggcttgaataggttgccattcttgctgatcaatgtgtgcttactctcactaagttttcttagatgacaaaacaagaggttatgttatgtgtgatgtgatgaaggcaaaggtaatatatatataggaaatgaggaagtgattgtggatacaaagggagattactgggttaacgagtggacggtggaagagaggtgtgaatcatatggtgagaaatgtgatgacaatgggaaagacacacgtttgagaaggtcaaatgttcaataatggctagagggatagtggacggtctcagaatagtgcctcattttcttttgttgtaaatcagagtgacacttggttttggagggggaaattataatttaaggtactaaattaattaattaatgtgctcgtgaacaatgagcttgtgttctaaaatatactagtatttcattttttgtttctttttgtccagatttttttcttctgttttaatcatgtgttgttctattgcaatttagaattggacaatgcatgctgcatgcgtcagctttgcatctactaacgtggagcacattttgaagaatgggcatggaggaataatacagtactttttgaggaagatggttatgtcttgcgtgagtggcgttgtacaggggaaaatcccacttgaattacggacttgaactgagaagaattttggaggattattactcctcattcttctaggtttctagttatttttcttatttgtatttttattcatttttttcgtgtgtagtttttattacaatagttttagatatactttcactgtgtcaaagtttcttggtgcaacttatttaaaaaagaaaaaaagttttcttcgtgccactatgcctttgttactcacgttcctatcgtcgttgagtacaacaaaaatgcaagtaagcttattcaaatttactttgttattcattaatataagttatatttaagtgtttcccttaagctgactttaaatgtgttatcctcatcttctttccttaaactttatttaacaaatatagcttagcaacaagagtaaaatactgaaagttaaatatcatgaccattcttcatagctagtgtttctaattagctattcatctcaatccatcaaagttgttgtttttttttttttttttttttactttttcttttaagaatggaccaatcaaaacttgtaattgtagctgtgtttcttgcaaatacaactgagatgtaaacgaacgaggactatgcaacccaagaatcaaacatgagtgagtacccatctgctacatttcagtccatcactaacatatatatatatatatatatatatatatatatatatatatatatatatatatatatatagtatctacttgttacttcacaaaattggtatgctctatgcactagtgtgggaagatcatgagaaccaaaaaaatgggcatctggtgctgggcctaatcgaagagcaccaagttccaattgaataaaaagggaagttcaaacagcccaattaatgaaaatagaatagattgacccaatatccactagaaaaacttggtctaacagtatctctctttcccttttgggcttttctcttgtcagctaattgagatcatctttgggtcataaggtaactgcgttaataatctacatactctaaaataaatttacgaattcattaatttttttattaatatagataatttcccatgttatatatgacacttggtataaataaactatgaatttgaacctagacagttgtagaaagtagaaacatcaatagaaatataatatccgcgaacgtagaattgtaaccaatgatatcatttggattggcgaattttaaagtttttaatgaatataaaagtttttataggctaattgcattaacctctctggatgttaatactaattaaatttatatctttctagtggaaaagttacatctactttctcttatttatataaatttctcaaactatcatgttatttgtttaaaaagttatagatacatcagaatcaaaaaaattatagatacatttcttatttgtatttaaatattatacacacagtatccttaaaatactaaactaagtaaggaaattctatttttctagtcaaggaaatggtctaagtgtaattattattaacttcaaaagaaaacatgtaattgtcccatttttataagaatgctctcttaattcaaatttaaaagcatttttgcaaatatatcatagaaaaatgaacatgatatgatatgacataatacaatgtatattgaaagtaaaaaaataaagaaatcaaatcagatgtatgtataaaaaagtaaaaaacctacttccgagttccatatattgttgtgtttaatggctaaatgttattaagattcttaatcttaatcaaaggaatgagaaggactcaacgcaatgacagataattcagtaagctctcgaagccatatttaaatcaaattgctagctagcattcttcttgtacattgtcttgtatgtaatcaaggaaaccaagtacactgaaccgtaccaatgagatatatggttatatgtgcataatctttgattaaaccaagaaatttacaagatcagctattcatttgtttttattattttacctggaaaataatttcggaatgttaatggacaattaggattttatagaaacatgaagtggacaagagagttacaaatttgtgaacgccaagcaaaaaataaaggttttgtctacagtatcaaaggcagtaaccatacccactcacgagcatttcacgtgttggcatgtcttcttagtgcgttacagctttgcgttttggtccattaagatattcttagacgaaagcccgaaaggaacatggttcagacaaatttgatagtgaaggccttctagacatatttaaagttcccatgtcccttatggttagacccttcttcccacaccttggggttgagctaaccccatatatggatcaattcttcagcatgaaaatcacattttaaaatcacgcccatgctcatgaacacataccaacctcatattacaattttcaacctcttcattttgtttggtttcttcaaattttcaatgattttgtatccttaactttttttaacgtggccgaggataaataaatataaaagatccatgtttttataaggataaactatcttattatgcctttaactttctttaatctttatttcctaaaaggataagctattttaaacatgaacttattttttatcgtatataaaaaggaaaacaagatcattaatttgacattttgcatcttgcatgtcatcatgtaagagaagttcatgagttgaaggaaaatatagtgtttcgatgatgccacagcttaagggcataatagagcacgaccaaacttttctttatgtttccaaagaaaaaagaaataaaataaaatagataagcggaagctgcaattctaagtgatatgggtgaagcacaagacacaacatgtgggattatgcttgttgttaatttaagatgaagccctaaatatgtaagaattggtcgggtttgaagaagtctctcggattaatttcagattcagctagcagtattaattttctggcttttattacatacatttttcggcttcaaacttataggcgtgtagtacacggtagtagataaaaataaaaataaaaataaaggagtcatttaatatctttgattttttactatatttgtggacttacttatagagacagtgagagaatcttgctcattgccacacgattaagcacattaggccataactcgtggagccacagccattttacatttatactctaatgtcctttaagataaccttctctgacacacccttatctttatatcccatatttgaaatcacatgcctaactttgactattagcctgccattacagttttcggacgatctagtgtaagatagaagaactgaagaaggtggcatatctgttagttttgaacaaacaggaacatgggtaaagaccaaattaaattaacgctagaccattgtgcttttcacctaactgtatggtacaaccatgattttaaattacactcacaattgtattaagataaaaaaaataaaaaaaaaactatttattatagatatttgtgaaaaaatacaatcgcaattacagttacaattaagttacgataagtcaaaatacttcaacatttcatgcataatattaaggttgcataacactattgtttaaaaatatatcatgtgtacaacatactttacccgtgttaaaaaacaacaactataagctcaaacatagaaataataaaggtcataaatcattataaaacttaattataagttagaatgtattcaaataagttagaggttctttcaaatgtgtcattgattaaattttgaagagggaagtttcacacggatataggtgtcacaaataattggagaatatagtcaaaacgacatgacaaggaaacttcattgcttctaggcctcattatgaggttcttattattatcacgaaaccatggaatggaaagctaaaacatctaagaaaacattggctttttacttagcatcacctaaacattactattatttgttaattttgcttaattcaatggccgaccacttatcttggtggttgaggccacataaatgttggtgcagagagagagagaaggggagcatggaatctgaattggggggtcatatagacattttctttaggaaccatggaccacacatttcgctctataagaagccctttggagccccatttgtaacattgcttcaaggggtttcaagtttcaacacacacacactgtctctgtacactacaaagtgtaagttattacaaagaaaggaaggagcatagactcaaagatgagcaaagattccatgagaagttcaaagaagaaagtttcatgcagaaggcttggagggtacctcaaagagcagaaaggaagactatacataatcagaagatgtgtagtcatgcttctctgttggcatgactagaatcattctcatcaacaagcattgtttaacgttcttctttgcagctcatcatatcgtggatcagcacactctagagtcctcaaagccatagccaaggatcaaagttcaagcatgcagaaaaaaggataaatgttttgttagctctttattattattattcactatgtaaatagcagagaaagtaacgttagagacaattttccttcatatcatgcctaaaacatgtatgttctctacgtgcagaaagctaattggtgaaagtagtgaatcaaaatttccagtttctattctgcatttggtatagatccatttgtttcttttgattctgaatcaagctacaactctttaattagtttgaaagaattaattataattggcatattttgtttattttgtatggtttggtacgctacaaaaaccattgagaataagctaatgataataaggcgtttctacagtttttagtaagtttcaaggttttcatcttgtagtgattaaaaaaagaacactaaataattgaaggttttctcgattagatggaggagaatgttgcctttaaaggtcaaagtaaaaagttaaaaatgaaaagcgaggatgcataagacctatatttatatacctacaaaagaaggacacaaatgggtgcttatgagctcatgagcgtgttgtgtcttttacgtaggctctatttgttgaggtcttgtcaactcaaagttacattatattgcattgtgaagaagagtttgtgcatcacatgtgggtgccccgattatatgacccttatttccatttttctcttggttgctttgggcatgatttgtctttttttaccgttttatccacttattgatttgtctcctcagagtcactatttcataagactttctcattgcatttttttttctttgaaattccttctgaatagtttttatttgtttcggtatatatataggttcttctaatggtatgtttggactgacggttcggtgaatcaaatttgattttttttttttaaaatggtgtctttgtaaactacttataaatgcatcaaaaaattcatgtattctatacgattttgtttaattcatcacgattttggtaatattcaaacacacattagatgttgtaactgtagctgtttgaacacgaccaaacagtaaaaaaatgtacattctatacgtaacaaaatactaacttctgcgttaacatggcataaagatgctattccaaacaaaatactaactgttatttccacactttttgccagtgcaaattttgtcttccttaccgttgcatcatttacgtgtaggctctattgttaatctcttttcgatcccttgacaacaataattgagacaatcgtgagaacctaagaaatgtatagtatgaattattcctaaggaccagctgctacattatatgtgtgtgaatttagaaaaagaaacggatatgaactaagctctaatattcctatttgacactattcaaacatagagaacgtttgtgtctgtggcatgatagaagaaaaaaaaaaaaacagtcgataactatgtagttcaaacttttggagcctaagcaatcaatttatcaaagtattactgtgttatggtttgtttaaagggttatgtttctcgcctatatacacagatgatccattattgctgcttttactttcatttatatatagtgatgggtttatatatgatctatgatattttgctactcctgttagaattagaaaagaagactacctactcaagagtataggtggcaaaatgaggtatccatctaaggattgcgagctatattgaattaggccaaaaagtctaaatttaatttagacttaaatgatgaagctcaagagtcatgtaaaaatctaatttttacggtcttatttcttattggaccataattgggtcagcttaaaaggtttgcatttaatttggattaaaaaaattaaatcaaaatcctatgtttcatctttagagtcaattcagttagttcgaattaatttgtcacttctactataagttttctaattacaattcaattttttaatgttaaaatgtatttttcatcctcaaatatgaaaatgatcgaaattcatctatgcaaaaattttaatataatttttatcctcagaaaattgaaatatatcatttttagcttatactcatgtttagatataatgactttttgcatcaattatacatataaacaatgtaaatgtgatgctttttacatttgttatatttatattaattgtgtatataattaatgtaaaatatgaatttttttacatcaattatgcatataattattgtaaaaaaagcaatacacataggttcatatatctgaaacttactctatgccaaaaaataacatattttaattttatgaggacaaaaaatatactgaaaatttttcaacaacaaattttgatttttttttttttgtattttgtattacgaaaacacattttaatcttttttaactaatagttaagcttcccattttaatttacctagtaagaagtgtttttttttcctttcccatttcaatcgaacaatgataagtttgagagtagtcagttagagaattcaccatttctcatcattgaagagcttctatttaattatttatttcttgaagaaaatatttcttgaaataaaattatttttaattaatataattgtatattcaaaactcgaatttaagaccattcattaaattgaaaataatttcacatcatttaattcatgcatgcacttaaaattaataccttttgtcgttaaaagattatcttcttttttcatctttatataaatatattttgactagtatgtagttattttaacttaaccactgttatggtaaaaaaaaaaacaaaaaaaacttaaccactaatcttgagttcaaactttagatatgcagtcatattaatacaaaaagaactttaccatatatactgatcctataattttatatatctaacttgcacactattatcaacgacagatctctaccaaaaaatataaatataattcgatagaaattctagctaagatagtctaaaaatttaaatgttgaggatttttttatccccctcccttccttttgaagtgtatttaagctcattcaactacgaattaaaaaataactatataaaaataatggatttttatggatacatttaaattatatttttactttttgatatatgatatcagattttaagtataaatatatcatataatagtatattttttttagctgttgcttaaaaatgttaaatcacaaaaatacttcctttaacaagtttaatcgattagtggtgtgcgtggtgaatattatgagaatatgcttgatagatattgagctgaactagctgtttagtagcagctagagtttttccttcttttttttttttttcccattaattagtttccctgataccaattttgctttcggctaggagttcttgactacagatagaaaatattattttatataataaaaataattattaatatgatatattatttattaatataaatttttaatgtctatattaatagattaatttttgttaaaaataattatactatcgagagtcgtagtatcaatttctttaatatatatattaaaaatatctttcaccctcaaaattctcgtttaatgtgcaaaacatggaatcagtgagctccaaggtcgatgttgtagtctttcttcatgccatttcgaaaattgtccatttaaccaagctcgattatataagaaatttaaaacttatttttttattcttttggattcatagccgaataaactatatgaagtgactgattcattgaaaattttgtttagaatttctacttattatactatagatttccatctaatgtttggaactaatggagtatttaccaacatggttagctcttcagatttcagacattttatatatttgctattagtgccgaaagggtactgacagaatatcttcagcatttgaggttcattctttttgtgcacctttgtgcggacttggtgtctcttttctgaatacatgtttctgtatgaatatacttgttctctaagtctgatcagattatgtatgttgtatgtccatcaattcctgtccaaataaaataaacaaatgcaacatatgcaatgtgacttttatggttaagaggtacgcatagttgacaaataattttattttttaagtatatcatttgatatttgattacgaagtttatatatatgaaaaatatttatcgaaaaaaatcaatttcttaaatgaattttcataactttgataaattaatttatagtgtaagtggtacaaagttcagatagaataaatctcattaaagattattaattctccaacaaaaattaattatcaataatattttgtatataaaataattttatgatcactttttaaaaaaatttacttgatttttaaaaataattagttcataatcaataaatcaacaattaacttttaatttgtaaacaattaaaaataaatacatatctttattaatcattttgatattatgatagctttggcttgtcttttcacaagcactccaatcttgtctatagtctccgggctctacgccaaaggaagaaatgatgatatataaatatttatgtttttaaaaacctaacaaacacatatcttatttttaatgtcaaatcatattatttacagtagaattgcaggaatggaaaaaccgtatgcatcaatacacaaaaaatgttttctttctcaatagatgtttgtgagatattgagtgttaatgaataattttctataataaaaaaagctcccgttcttccaacttctttctttatcagcattcttccaacttctttctttatcagcattcttccaactttattaaacacgtaacgcgacaaggctctagagggaaagcaaagaattcatatagatatagcatcaaaattcaaacacaactctcttgcactcgtgcagtctagtgcagtgtgtgtagtatcagagatgggtcagatatcaaacaatattaaatttctctcactctttgctttattttatatactctttgaagaaaaatattttttttgaaataattactagtatgtttacatccacaatttaataaattatatatttttaattatatttatttgttcaaattaaaaataaacttatttttttatataaaaaatactatatctgtaaaaagagaaagaaaactcttgatctgatttagggcccaattgaatagagggaacctcatgattcagttaaccagtggaaaaaagtttcattggtcaaagtggcagctttatgatgcacacatgcaccctaaatccacatgcttactcacacctccacattgagccgtggtcgctttcatcataccacacccattactctctgttttgattctttcacaatacaaaaggatgggcccactacttcaagatataggccccatctcaacccaattcatttctctaaaataaaatcatggactcatgaatagcatcttactcatcaaaataactttttgtgcataggataaaacagggagagtaaaaaaaccatcaagacatagtaactaccagcatttaaaataaaatgataggacacaatcatcttgtcgtacaaaattagctgcacctaatataattgaaatgattttaattaaggatgttggttaacaaacgacttaaagtatattgaattggattttcattactaattactatactctctccctctcacacgtttaggtattaaccactaacagagtttaatgaaaaaaatgagaaattgatgatgaaagaagatccagtagaagaaaaatgaagtagaaaacaattttttgacctaaaacatgagaacaatattgtttccattcacatgtgcatccacatagcgacaaattaacatgtcacttgtgtaattttgttactattaattgatgttatgggacaattatcaatggattgatatttcaggaatctcaagaacaactttagcctctcaaccactaaaataatcaatacttgatctttcatggaataaaatgattattactattcatgttttgttatttgtttcttttttttttcctttctaaatacaactacttgaatttatttctgtgctcataattaaatttgaaattcattcacttacattgacacatcatatataattaatttacacaaattattttcataacttattcttcaatttcaagctatcttctacacaatttattcatgtataataaaataaaattttcaattttgactgtgaaaactttttttaatgaactttatttaagataaatagtttcaccactatttgacgatggtgatattttttttattaattatatgttaaactttaaaagtctatctaaatttaaaagtatactttcattgtacaaaaaaacttgtccgtacttatagacagtaagtattaaatattgtttgtctttatataataaaataatatcaagaagtttctattattttctttgcgaatgtttaaagaacacttgttaacattcttgtaattttaaatcctaccatccttttctgtaattctctcaattattaactaaaacatattgaatgtttttaatattttaaaatatggaatatatttatcttttgtttaatattttattcatagaatattaagtgaaatatttaggtggtattataaagtataagaccccttatacttgcatgaaaactaattgcaaacgattaattgtacccaaaatgatagctattcttttacatttgtatttgggtaaataacttaactaaatacttattcattaaattttaactacatgagagcttaataaagagggaaaaaatgaaccaaaggaacaaagataatgaaaaaaaaagagtctaatagttatcgttattcattggttaaaatagggtcttaaaagacaaataaatggtcgacatcaatggaggttagttgtcaagatacagctccctcttgaaataaaaatggaacacatgtgaaggcccaatagccctttgcctaccaacctccacctgtctcttctacgcgtgcaagttcactgatttgtataaacaagtacaatctatgatacaattatttagtattttattaatatatattaaaattgaccatttttatataaaaatgagcactctttaatcatatatttttagttgttgaattttgacaaaacaaacagtcaaataacaatatcattttaaatcaatgatggtaatagttaatgtaactcatagcaaagtaatttgatctcctttacacacacacacaaatgaaattactaaactgagaacaattcacgtaagaaaagagaatcagtctgcatgcttaacagccttccttgtctgaatgcctttgtaaatgtaaaaaaaagggaggctccctcatgaagctaggattgaagaagctggttcgataagaccaggaggagtctttttattaaaagaaaaattattaaaaaatctaagagttgtggacaatatttggttatgaaattacatacacacgcatacttgttctaatgggtacacttctactcctaaatcggagaattcaatgcaaaatatttacacgtcctacaactggagctccaaagtattattttattagtatgcattgcattccacaatattacctagaggaacctacctaactactatatatagttgtgactcactcatagccaagtactatgaataagccattggtaaaatacccagtacgtatatatattctaaacacagctacactattgggtcaaataccaaacttgagtatcaaaatatttcgcaagtatttcctatcatatcacttcatcttataccaaaagattcttcattattctcattttttcgaatggaatcttatcaccatcaaagttgagacacaacattactttggtttttcttaaatgcttatattattattcagtgaatacgtagttattatccaaaatatacaaactagctgctcattttagtacatgtcatatatgaaaccaacaactatttcgacttcactgtttcaaactgctccacttttgttggtacattgggccaaggccacttttagtttttactatttacatacccccctagcctctgtcaccttgggcctatggctatactgggacatactttgtttttttggtcaagatgcttggacacttgaaacatttactcatgataatccatggaacttccagatcatagattgatggcatggtaatgctattagcgctcccatttccactttctaaccccattttttctgtgcttttgtgaaatttatattctatccctccacatcccctctttctatccctctcttctattctattcctctttttaagaagcccaatttctggaccctttcccataacgcgataaattgacattcacatactctaaaataatgggtatatatgtaccaggacaccccaccccacaaagcggcccaaataataaggtatgtaccttgatttaatacatatatacacaaatcacttttaagttaagcctagttaataaaaagaaatagtgtaggaaccagataaaaaaaattgaatgtattaattaaacttggataaaaattttataaatgatcgtggtgtttgagttcaaaagctggaggagcttttattaaacttcagtatcgaaaattaaggaccctaccgcgcgtgcacgggcgcaccatcggtggaggcgtggggtttctaaagtaattgtgtctccaatctgcattcattatgtagagtttctatttctacggtgtttatggtaatttcaaaatttttgatacggttagtttcttaatcaatcaaattatatggtattttttattagtaatttcttttgttttttcaaacttgtacttaattattatttttaaaattgtaaacttttttttaaattagaaaatatgtttaaagataactctaaaaatctcaaccctaaaatctttttaattatttttaacacttttataaaaaatattttgggatttatgatttaatttttttattgtttcttaaacataggtttcataaaaaaaaattgaaaataattaaaaatattttaggattcagacttctaaagttactttcaatcgtatttttaattttaaaaaattataattttaaaattttaaaaataataatcaaggactaatttgaaaaaataataattaacattatcacatataatttgatcagttaaaaattaacaatatccaaactcgaaattgttgggggctatagaaactcgatcttattactactattatgattgagaatgtatctttgtacacaatatttaagagcacaccatttctaaaataatgaattcaagaggaaattataccgatttatttggtgtaagtgttaactactttatatgtttctcattttaaaaaatatattttctttgttttttagtattttctaggacactttatgtatagtgtaaataaaaaaataaaaaatagtattaactaaataaaatagtataattattcttaaatttaattttgttctacgctttttatttgaaattaagaaattgtgaactattttgtttttgtcatcgttactgtcaatattaagtcataatcactgttatcgatattgtgaagggtatgtttacactttctaaattaagattagtaaaatcatacttttaatatctgtttttttatcctatatagatttcctctcaatttgcattgtaaataataacatatatcctttgttaatgcgaaaactcccctttatttcttatgtctttacatgacttgaaagaggttattttagtaaaatatcaaatacactttacagacttcaatacaagcaaaattattttttccatacttaaaaaattagttaattactattttttagttcttatattaatcacatttaaaaaaatatttttttactaaagttattagatataaaatgtcaattaattaaaagatacttttggaatgacattattaaataaagtgaaaataattaaattttgttcatatttaaatctgtaaaacttttttttgcttcttataattaagtagtaagacatataattttattaaatttaaatatattggatattatttattaaatggttaactattgactattatttattattgcatcatttaattatcttaatcaactttaaaataactaataacggttttctttggaggtgatttggttaaagagagataattacagcataatttttttttaaaaaaaattcatttatttctttactttaatttaaatatattttttaattctcttctatattattttttcacaatcaaacacacttagtgaaggatggtatgttttagccaccaggcttagtctccttttcatctgacaattatcattatcaatgaaaatccaattgtctttgactatctgcatggagtaacgcaatgtcatgatcatgaccgccactgtatcttggagttgaaggccactgatctgccgtcatcttataatcattgctctttacatggaagaattatgtagttgatcaattttagatcactcattttttttataattaattaacatattctgtgttgtggggcttcaatgctctgataatttttgtcccagagataccattaaatgcttttcggaacagttctattttctattgtaatgatttttatatttatcttaattataattcttttcatcatcctatttattatatttttttcccattatcctgatttctaatcctttgatctcttacaaggtgtatatacatgtcatggactctttagaatttatcatcaattgactaatatattataataatgataatacaaattactttttattttaaaaattttattaatatttttttctatcacatcttaaatttttttatacttttttttctctctcctaatgttagatagcacatattaagtgtcatctatcaaacattttccattactagataagagattttatacttacaaatatgaagctaaactcattctacatattctttatactcttttaactttgacatcgaaatgtcttctgctaggccgttgccgcttggcagaattctctccacatctaccatgttcaaaaaataaaactgaagaatatatatatatatatatatatatattttttgaacatggtagatgtgatatatatatatatagaatgtaatgataagaccccattaaatgaatacttgatgcgagtctataagctggttattaattatgcagttagccaagccagctagcatgaatgcgatgaaacaacaacctgacactaaccaaaatccagatcatgagaaatgctttttcactgcacatgaatacttgtctgcggggtttctttcttggtgggggcatatgcatgcatggcagtggcaacaacaaacagatcaattagcagaagaagtttgggttatgggaccgctcaaagaaccaaataatcttagccataggcacatgacatgaaacgcacacaaaaccgtgcttctttggcttgtgctctgcagattctaagctagaaattaagaacttctttctttcccgttaacactgtctaccacttgttctcttcgttgcactccgaaggaccaaaaggtaccagtcgctttcaaccaatgtctccatagaccagtcgtgaatgacttgtgggacaactttcatttggcatggttaggattattattaatacaaatagttttcttacatctataaaaatgtcttaaaaatataagatatttaaagtgtgtatatatcaaatgtcaataattaattacttcgtccaacttgatatatacgttgtcgtcgtattatattgtttatatatatgagtatccttcaaaaaaaaaattatatgagtgactatagctagcagcgttgtttcaaattttcaatataccaaattgaatatatatgtttcatcataacaaatactcacgatccaaaagtccaaattgtagtaagtctagttcttgtcttttccgtatttgcatatgttttaggtggctgttggctttcctggttaaattcaaaaggttatcaacttaaaaacaaatattctaaaattttccaaacaataagcattcataattttttagtgggtattcataatttaagacatattattactttctttaatctcaataaattaagtaattgaatattataaatagaacaaataaagtatttactatatgtacataaagctaaagttaatgtttacatatatgtttattgagtaaattatattcatatttcttgatttttttttcttctaattgcacacaatattaatacttctccttttattatccctacacaaattctttaaatttttcgaaaaataatacactaacactcttttatatattacactaattaacccccttaattgtttgaaaattaagcattacattgtgtatcctcataacaaaggttgttgtaaacattaaaaaaaaaaaaaaaaagattatgtgaattctcataaaatcttaagagtgtcagtatagttcactttactatattttgccatagatataagaagaggttcccggggataagggaaaggtgattacctcatcctcactagaagtgagagatctggaaccaaacacatacaacttggtgagcttgccacataaacctaaaacatttgccaccaaagagatgcaaaagccactaaagcgtcatcatagagattttacaataccatctccacgacctcaagcaaggaccacctacaatgagcattaaaatgatgcccaatccaagtcaactttttttaaggtggaaatgaaatcaactcaataaggttatgttgagtttgaggatgagggaactgaaatagacaaggaggtagctcaagactgagaggaaaaagtaccttagcataaggaagaagtacttgagtaagatgaaaaactaccccagcgtgaagatgaagcaccttagcaggcaaggataactataccctaactcactcaaccctttacgggggcaagggtaaagaaagccaaagccacctcgactcgcttcattgttctacctaaggaaaacacaaaatgatcatctaaattcccacacaatacacgttgctaaccataggtgcgtgggtgacttttgttaaagcttgcgagtacgtaaaagcataattcgaagaatgccatctaccaaatgaaaagaatgcactttgtgtctaagaatggggtatcgtggtcatgttaacaaacctcatgagcggtatttgtacctatccttttataatttattatatatgtacatagattttattataatttgaatcaatgaagtttagtataatagaaaaagctagtcttttacaaagtgatggattatggtttgaagtagagatatttctatttattgttcaattgtgtatctaataaaattatatagaatacacttgcataaaaggacttcagttaaaaaaaaattttaaaaaaattgattacaactttaaagtaatatattttttaaaaattaaattaaaaatcataaattttttataatttcaatttaagaaaatcaaaaaatatataaataataattaatattacgacttctaactcaaaaattattatatctatttatatttattatttttatgtcggtaaaaatttaaaatacacactcaaataataataataaaaaaatccaaatctaagaagtaacccccaccccgctgtgcagcaaagcaatgtatgcgtgtcagacattgaaagagctttctagctagattgaaaatgacagtaggtgatactacgacccagtcaaaagaacacaaatttttacaattaccgattttcttttattaagaatgattttcaacacatttgacgttgattaagggaaaattgtacaagtaccgattgtataagtactagttgtaggactcgtgaaatgcacacttaatccatgactattgtgttaagctatatatttaataaaatttatttgcaactttttggaaaacatgttatcttttgcaatctgtggctcagctgtaatgtttatttgcatatttgtacaagtataatgtttatttgacatgtataatgcatctcctccaagtaaaataaataattaattaaaataacaaaactgataaaaaaaagatataataaaagtgaagggaaaacaaacttttactttgataataatattttatagcaatttttataattaagaaagagataggaaaagaaaaaaaatactagtataacagaaaaatataaataagtgttatataatatagagtttaaacttaatgaatgttagtgtcatgattgcttacgtaaatctatttttaaattaatttagactatatttgaatttttatttaaaatgcgatatatgaattctaagaaaaatttaatgattcacaaatttaatttcatttaaaaaagaatctaaatgtttttataaatctcattttactccaaaattctatttatgaaaataaaacaaacatgcatttaatctcatttcttcaaaagtgtctgcaaaccaagtttaaccctaaacccaacgcatcacacccatataatacgtatacacatatattaacgggctcaaaagcttaatgatttgaccctctcttgcttacgttgcttttacataatgatgcacacaatccaccaattatgtgtcttatcctatatgtgttactgttactctctctctctccagtccccacccctgtgagcatggtcctgcaccagcacacacaccctgataaataaatatagagctgtattcccagtataatggaaactgtgcaaagcaaaccacagttccatcattggcctaaacccatcatcgcttcctcaaaccactttcttttccctcctcggatgtgttctagtatatgttaatttagaaaaagtagttagtttcccttgcaaagaaaaaacattgtatatatatataaaaaaaaagtgtattcctagagctaaggaagcaaactaggaagatagctaagataccctcttcctgcgtttggtgtggtcctcgttatttaacagaacctgtctagggtttctgtccattggaaattgcaaaatctgcatatgtaaacatgttcccttccactaattacacctcctcaggctcttaccctcgtttcccttcatcttcttcttccacttcaccctatccttcttttactctccttcatcctgaaaattcttcttccagcaacaacacctttcttcatgatccacttgctcttacctacataccctctcattaccatgctccaatcccagaaacactagccaattgggcagtttcagattgtgcaatcctgaatcaggatcttggtggtgccctttatggcatcaccaagaaaccagtgaagaaagcaactaagaaagacaggcacagcaagattcacacttctcagggtttgagggacagaagggtgaggctttccattgagatcgcacgcaagttctttgatcttcaagacatgttagggtttgacaaagccagcaacacccttgactggctcttcacaaagtccaagaaggcaattaaggagcttactcgaagcaagcagagtgttgaaagcttcgaattctcctcatcttctgagggtgaagtggtttctaatatccaccaacaagacctacaacaacaacatggggtagatttggaaaatgggaagttgaaagaatctgcagcttattgtgttaaagcaaagatgaaggaatcaagggaaaaagcaagggcaagagcaagggaaaggactagtagcaaggtattgtgcaacacaagtggcgaagggaaggtgcaagagttgaagaaaaagtgccctgcaactgaaaaccctcaaatcctgaaccagttaaggtcaacccttcaacctcaacctcctcatcctcaagatgtgggtggagaagtaccaagagatgatgactttaacgttatcgaggaatccattgtcatcagaagaaagttgaaacacactttgatgtcttccaatattcatcaccaaaacgctgtgatccctaaggaagcaagtgtaaacaacagtgactaccactccttccccaatttgtctccaaattgggaagttaataatggtgccaatggacgctccaccttttgtgcaataaccagcatgaatctatctacaggtaagtgtttctttttcatgaacaagtagctgaatttattttccattgaaatcgctttgtgatatctttgtgatacttacaatcccatgtattgatttttagggcttcaaatttttggaaaatcttgggaggagtgcaccagtcctcatccaagctaatatgttagttttcagaattatccgatgattgtctctagtgttttgccaaggaatatcatggtcatgaaggcatctttctgtgtttttctacctgtaacttttttctgtcctatgtttcctttctacaatgtactgattttttttgttgctctagatcagccgagaagggcatgtgacagtttggcaaaaaaggatgctgcgtgtataatttctgaccaatatttttaatgtggctgatattataagggtcaaatatatttatcaggaaccgtcctttcttttgctagtagatttcaatttttatataatcagtttacgatcaatatatattgattaataattgttgaaaacctttaacttagctatatcctttggtcattgtaagagaaggatgtgcagaaaaaaattcaagatattttagctttgatttaagtacagaactatacatgttagaaatgcatctgctaatcatcctgtaagaaagtttccgttttcaaaattttcagacaataaattcatataaatatattcataatttcatatatagtataacactgaaatatacatgaaacacacatggaagaatgtaaattgtccaccttaaattttcacaactgatacaagaaaaatcgtacaggaatgtcgtccaaacctagagttattaatttgtacaatgtaagctgcttttttatatttctttaattttgtacaagatgctttttgcttaatccaaacacactcttttgttctaacagtttcaagttaagagcctctgataattcgttttgtttccctattgtaaatttattcatcttaatcattgtcaatttatataatatctgaaggcttggtggtataagataatttgctaaatgcatacaacagttaaagaaacagttaaagcaatagagaaacttcaatcctaatataattcttgagccttgctaacaagtatcataagtatatttttttaagaatcctttaatacgctctatcaaatgatttcaattacttagaaaacaagtattaaatgattttgatatttttaacataatttagttgttcctctaaaaaaaacataatttagttgtttttattataaaaaaaatatttccaccactgtcttacatgtgaatcatcatcttaaatccatgcaatttataagtctccattttattggcacactttcactaaaaaattgagaatatttgtctcttgcagagtccatacacaatagtaattttttattagctagaaatatctattgtgagagaaaatcgacaacaatatgtatttcttgatggccactttgagcagggtaaaggatgatcttataattatttatttaagtttgcattcgttttcatctttttgcagcttatgtaagacttggctgcatcaagtacataattattgtaacatctctttctcacagagtgaactgaatttatgaaccactatgatatattgtcagctacatattttgtattctaaccaaaaaatataattatataggttaggacttcggagtccatgcacacaagacttaacaatgactttgtcgatcagaacctttttaaacattatggattgatatccagcggtggacaaaataaatattcaatctgattaagtacactacacccttgactggctgttcacttataagtacaagaaaaaaattaagtagctaactcaagatgcaagtattcaatctttattttgttcacttttattacaacagcagcaattctgcttactttctttttgttatttaatttctcttccaatcattaataataggttggtaacttcaagaagtgaaatgtacttagattgctttagcagatatattactgatgtggtactataggcatttgtatttcatgttacaaagacaatttaattgtctgacaggtcagatagactactttttatattgctgattttctacctactggcagcaactggttcatgttttaattttcttatataaaagaaattataaccatccccctaactgaatctggatcacattcaagaactctcaatgtggactttaacatttcattgttaagtacttggcctagtgtaacaaactaaattgtgggtggttgatacattcataaaaatttctagccatctatctgggttttgtagatctaagtaaaataattatatcagtggaagccttatcgataaatttatttgccacaccaattttccctgcatggtagttgtagcactgagctaccatgtaatggaaactgcatagttctaacaagcaaaaccactctccaatcaagatttcctgtaatttaattagtatagtttgcgtttgatggacaaattagggcgtccaatgagctcacaggcagtgttcaaagggatgcctgtaacttttctagcctcatacaaaggtattctttaaattatttattttttacggcaaagatatattcacacatcagactaagaacatagaaagtggttggtttctgtaaggaaattataagagaaaaagaaaatgttcacacttaagagtcacgtaaacatgttctctagatatatcccagctaaaaaggtctaataaaatattttagacaaccctagaaagctatagaactttcactaggtggaaattaggtagaatagaatctagcataaatgttttttatataggtagaactcatgtcaatgtataacttccattgtttgtaactcagaattttaggctagtacacttcaaaactagatctgaaattttgctgaaatccaagagaaaagaaaatataaaggtttatagtggatacttctcaaaagaggaaatttccttcaataattaaaattttaaaacccaagagtgacttatcaataaattatattcatttttttagtaccacatcttaaaataaaatcttaaattatcgttaatttattatatgattctcactttatcaatacactttaaattgtttgatactacaaaaagtgtgtacaatcctgttagaaattaagaacaatataaaatatatatatataaatatatatatataaactatcagaggctctacgctatgcgcaagtaaggggaagagatattatatgcagtcttaccattacatatacaaagagattgttttcggattcgaacccatgaccaacaagtcagcaagacacaactttaccgttgtgccagggctcgccctcataaaaaggagtgtagtgtgtaaaaaaattagaatgcaaaaaggagtgtactcttacataatcttgaggcatgcattttactatttctttttgttactgatttatggtcatcatacttgcacactggtgcttatatacttatttttcacattatctcataaatcattaataacactcttggggtctaataagaaaccacatttttttataataaaagagaaatttgactattattattagagtagtacccaaagaagacacaaagaaggtattttctgtacataagctaaaaacatgaagggtacgtggatatattactactaatatatatagaaaagtacttttttttaacacgcgtacattttaatatctcattctgttataatatcgcagtttgagaagtattagcttgtttgtagacctttgtgaagtctatagttgtatacctctcacagcaaaactactttccattaccatcaagcgcttgtttctttacaaattacataactcaacttgcccctctttatattcttttttggtttagttccactagtctactggtatttctttttatgtctctatacatatttgtcaatccacttaatgataaagtagcatttaaggacttagtttctatcaaacgtttccatgtataagtactaattagagaagaaaataagaataaaataaaataaaattttcaaaaactaaaataagttcattaaagtataggtgtgaaagtaaaatctcatattaaataaaaatcaacaagttgaacaatagtaagaaaaattcaaaattttaatatcttaagattttttattaaaatatactgttaaagtgattgtgttcgggatctattagtatagatcttttcagttttctatcccctcaaatttaagcagagttatttcagcatgtctagctataattaatgcaagattgtcgactagatggaaataggacaacattaaacatgtcatgtatgatcaggatgtaacatctataaattctaattaacatatacctcaaaacatcgatattagtgacatgatcaacttaagatagatcctgtttaaggcaaagcaatcttacatgtgtaaaacggggtagggaagtgggaatgtgcttaccatgcatatataaccgggggcaatcttcatcagattattcataataagtactgtttttgttggtttgtcagtataaatatggctgaatgaggtgtacgttgccagaatgctgttttgaaaattataattcatgaatatagcttagtatggagagttgaaggcttgaagcaattgactgatttcactatatgaagatatatattcgtacttaacttttgcatatattaattggaacagggagattgccaaatattatgtttgcgacaatatagtgctattgaatgcatgtgaaattgttaggtactcaaaggtaaggatggtgattggaaagatcttatagtcaccgtaaatcattagattactattgctagctcctaatgtaagtaagattgcatcctacctaaccaccaccatcatctatatacaaaatgcacagttcgattgtacttttacaatataaaatcacactcacacagatggggaacgataaacagcaaacataaaacctatcacaagggtaaaaacaaggtcttaattaactgattaacctatattgtaatattataatgtaattaaaaatcgaaaatacaatttgatcacactgatttcaaattatgtaacattttattaagcaggaaaccgaagacagtgacagttaatcactagtaaaagcatacaactgtaccaaagtaactcctctgcacaactatcaaattatcaaatagctagtttcaacttttcttccatgtatgtgtgccgtttttaaatttaatcgtactaatagtttcaaagaaaaatattaatttgctcgtccaagtgtttaaaatagttttatatttcttatttaatacatgtatcatccttttttttaaatggattcttattcatataagggtttactcatactattaataaaaatcgaactaaaaatgagtatggaataaagtatttttagtaagtatggaataaagtatttttagttaagtaaaaaaataaaaaagataatcatgattgcttaccagatggcagtgatctttatacatggctcgcttccatgttgtctcctcgttctatcgtcaaaaagtcaatatcttcacctcaaaagtaagagacagatttgcagtttggctagtgacgaaaagtaagacaaaatcgtaataattagaagatctttaaataccatcaaaccataacagcatatataacagagtctgcgcagtgcctgataaattagaaggaaaattattgatggatactttggtttttgaatagatggatactttgggttaatctacatatataagaagagatgaaaagatagaagagaaaacaaaattgtagatttaaatataatgtaataagaagaaaatatagtgccaacgagatgaaaaatatactgtgttgatgtgcatatataattatctaaatttaaaatataaggttgagcaatacacacaaaccacacacatatacatatgggtagttataattaaaattagttaaatcacgtaactatttaaattaagtatatataatcattcaaacatataaattatttctaaatttgtaatttttatttttcatattaagatattcgtcatttctttatttttaataatgataaatatatattggcttaacaagtggtattgactattaaactcaagttttaaatatataattacgttaaatatttaaaaataaaattttatctctgataataatattatttggcttgacaagattgatcgaataggattgacttttgatgagagaaattattagatggtttgagattattatatatagtttcaattaattttcatatgatacataattaagtatttttaattaattattttttttatgaattggaaaacttgaatacgttatatgtacaaggaaattgcttgaggttataggcatgtggttacctagaactacctagaggatgtacatgtgggtttttttattaaaaaaataaaaataaaatgacaatgagcttgtcaatttcatggtgcaaatggtttattctttattttaatacaccagccaggttttaagaaacaacttgaaagggtttcaatctttcaggttatgaaatcaacaaagagtaaagactcgtacagaaagggagggtgggtgggggataactaacaatcctctggtaattttggatcccttatcatacacatcatactgaagaagaatgtttctaacttcatcgattaacacttcatacattataaacaaagaaacgaactgaatttttaatcaaatccccaaattgatgaaaataccctggtaaacccacatccataagtagaaaatgaggcaaaataaacaatgcaacacgattgaacaaccagtatgtagtacgtacattatctaactatagcctaaacaattaagtcttcacagtctcacacaaaacaaagtaagaaataaatttcttaaacaacaatatacacatattgaaacatagatcagctggtacaatttaacaaagaaaaacaaattaagcgaaaaagaagttaaaatgtacgtatgtagtagtttacctacaagaagaacttgttgaacagaagcagcataatattcagtatggaagcagctggtacagtacgtataaataacctcaagagaaactcctggaaaaaacagttaaaaagcagaacagtggcaataacctcgagagagttagagttagataaagatctaattaagcctcagcactagtgagagataaaacaaagagggtactaacagtaacaggtatatagcaaaagaggttgggttacttctatttgcagaagtgttcgattccagcatgttttcgtaatctcttctgcatgctactttaataataccattactagcttaggttctgccacaccctatatgatatataggaaaaaaaagtgagtgttgttaaagagagtgaacttgaggatgattcgcagtttattattattttatttatattataatattaatatgaaatatctaacttcaaatatgataattaatatatataagaaaatataagtgcataaaaaataaatttttttcaacacttatttcatattcaaaatcacaatttaaatcttgaagaacttaattaagatacataattcatcatcactacttatggtcttatgctaccaagtgttggtcttttgcaatttattattactaattcagaaaaatatatttatagctatcatcattcataatgatgatcagtgcatgtcatgaagataccccggtactgaacttgtacgtatgtctctctttctctctgggccgtatgtaacagcaataaaatataaattaatttgctgcaaaggtgttctgatgaacacagctatggcaaaacccattaatattatattggggtgaaaatcatcttcttagatattactctgactaaggttcttcagaaatttcgaaattggtacgtttacatatatgcagcactgtctcattggtttgtgtaagctagacgtacgtagttcatgacccatccctatcttcagctatttttctgggtctcatgtgaattaggagaatgtgaagatcactagctcagctaacgtaccccaccttatatatttatcactctttacctaatccagcttacctacctacacaccttggttaacttttacctagtgaatacagagttattgtcactatttattcgaattattacttggtaaatatgcatcccagaatcacctttacacacaaatttcctttgtttaccaagtttatatcaatggattttcaatccacataactttcgtatgggattgctaatattgagatttcgaaatcatatacaattgtaagtatttgttttttttttttttgtcttgaattgtgctataattcgaatccttaaattatacgaacgtgactagaaaattaagaaaagtgcatgatattcatatgtcccatttttggtgtagaggtagaaggacttatctctcaccaaaacgtattgtaagaatttgatatacatgtaactttgaccaaaaagaacctagctgctagccaccgtgcatatcctttatttaatttattatggacaccattttgtacattaattgacagcaattatatgctacatagtagcttattcttctttgactgtcagagagacaattttgaccaaatccttgcatacgttttggtgtacaatacaatcctttcatacgtttattaaatttagaaacattaactctagctatctatattggccatgatgaaaatttcctttaagattcactattaggaaagccaaaattaatttaaccaaaactactcgtctttttaacggttttgcatcggactctatatattgaccattggacccttcgttacaatcatgactgagattctagtttgtcagccaatacaccagtacaattttacagtgaagtatatatgaatataaagatctaatcttttttacgataaaacaggataagggaattatatattatgtgttttaatattagttttttcggatttttgttgtcaactagaaaaaaagtgtaaaatattattttactaacttaattattattaaacactccattagtcaaaattaagaaattttaattttactaaagaacaatgatatatgtacataaataaggatgaaaataagaaaaagattggaagaaaaaaatagagaaaaaagtaatgaatgtgataggtgatataatataaaaaaagagaactgtagagaaaaaaggaggtgaaattgtaatgaaaaagaaagtaaatgaatgagatcatgagctttatttttaagaaaacatgaattgtcatgcaattgttgggataagaatgcaggaatttcttttcgtactccttttctctcactgtacatccttttttttttttacaatctgaaaaaaatatttggaatatacaaaaataatttcaattgtttttcttaatatgttaaaaaaaatggatggaagtggtggaaaaaaaaaatagaatcaccctaaatatgttgttggtaaggtccagtaggtcgcatacgaatggcactagagcctcaatccagagaaaagtatgggcctgctagtaatcctggcctttgacaagtaatgtaagctaaaagtgaaatccaactatgaaacggtggacaaaagtaaaaatgagaaatgacataatcttttgacataatataagttaaaaaatgcaacaaattaaaccaaccaagaacttcattaaaaagtactactataataaaattattaatcagtcaaaaatataattattaaaaaactaaataattaaatatttcttaacttacaaaataatgtatagcatatatatatatatatatatatatatatatatatatatatatgagctaaaaatattattttattgaagtttaagcttttaatttgtgctgatggattagttttgtattttcttgaatggaagacgattacacaaaaacttgcttattgttgaggaataaaatggtatttgtctctacacaatatgataatgtacaatagtcaaattaaggaccttcaaataatgcttttttgtgtagtcttccaccgaagaaaatacaagattaggtaatgctcctatgacatattaatgtgtatggtctaacatttttttaaaaattaatgtgtcacttaaattggctaaaaactaatgaaccagtcaaaaatcgataaaaatccgatagattaactagtttaacccatttcactaattttttaaaactttaaaaatgatttcattttgtttttttaaaagaaatattataagttatgaacctttaaagtgaagtttattttatattattaataatttatgtatattacgttatttttttattatttaaatattatattaaaatattaaaaaaatattaaaatcaaaacgagagtgtctttaccaattcaataatcgatccgattttgacaacattactgaaattcaaaagcccattgtttttcttaacaaacacaccactataaaatctttccaaggtacacacaactgttcaaattcctcttgagataaggtatggcacaacaggaatcatatgcctttttgtttggaagatacataatcttcaacctctttataccaataattctttggtagtttctcattacctccatctcgttaagaacaatatctttcacacgcttaaacaatttttcttcaaaaagaaagagcattcttttaaaattttacattttctttatcataaacaatgccataggccaataccacattattcacagactgaaccaagtaattacctgctacatgaattgtaatttcgacctgtaaaatgtgaaagtaagaaaagaatgcctttctcttatataatttgacattactgcatggctccgacgaattcatattattacaatccattattttcctaatgacacttcgtttattgggattaaaattggtagtgtacttgaggataaggtaattgaattggtttttagtttccttacagcacaaacataaaattaaaattcattactgtcacctcacctgagactgaaaaataatactactagtataaaaaataattgactactaggaattggaaaaggcagtacgtgatgtgaaggtgtaattgtgctatgaatttattcaaatgtcctggaactcaagacaaaaactattacaatgtattgaaaatacaatattaaaaattaaaattccgatgccgggaatcgaacccggatctcctgggtgaaagccagatatcctaaccgctggacgacatcggatttgttgatgatgcttacgtgactttatttaagttatctaccttattttgatatttttttatagcaaaataaatccttgaatgaccgaattaaaaccaactaaaacttttaaaaaaatgctactttgtcaattaaatattactaatacaaaatatcacattaattatgtttttttataaacaacaaaaattatgtctgatgtttataaatatatgttttatcagttaaatttttatataagaaaatataagtattaatttaatcaattaatttattgtgtctaatgagatatatcttctatcgaagataagatgtatttttttcttaatcaaagttatttagagttttttatttgacatttaattaatgattttttattagattaatccattttagaataaaatgatacttttaattataattttatgctcatatcaaagaacgaacttccttaaagaatttaaatgtcaaactatttattataacagctattgattataatttattttttaattatagatttaattataatctttttgcaatcgataaatatacggaagttttatttaacttttaacaaatttttctttcctaaaattgataaattttagaatgaaatggtatgtttcatagttaatttaatgatctatttctaaataaacttcttctaataccaacaacttaactcatctaacatgtttataaaattattttagtttaagcttagaagtcgagtgtgcagataaacattccatactcacagaaacaaatttgagtgttacagtgtctgatacctcaaattggcatttgcttttttcgaaaagaaaaataaagataatgttgatcataacaaactaacccatattagagtggatgagtgagactggagagtccagtgtgagacccaagttggaaaaacgacaaacaatttcccattttctcttcttttaattttttttcctaaagtttctttcctgcttcaactttcctttccaacatcaaatctcgctcaaaaaaatttcccgagaaaacaaaagaaaaaaaaaagccttccttccttccttccttttttttttttctttttcctgccacccaaacatgataccctccgaacattattacccaaacaagacctaaccactttttcggtcatggatgcgcgtcgtgctccacgcgccgtcattgaccctaaggtccgtagggtcgggttcttcgctccatccgaacccgacccgatctcattcgaagtctctccctccgccaactccctctcgccggtaatgatcccaccgccgcgccatccgtcggagaatctcggtctccacgctcgtccctccgcgacttccccttctggcgacgaatccttcgccgccgggagctattccagctcgtcggacttcttccccgctccgatgtcgccggcttcgtcgtctgattcgagcaggatcgtcggcggcgacggagacttcttcgccggcgggaaggcggcttcttcgtttcctcgcggtgggtttgacttgacggcgacgatggcgagtagcgttccggcgagcgaattaaccacggtttcggtggtgaatgctgcttccctttcgattcgcggtgaggctttgcttcttttgcatggttccgttatttgaattggtggatatgctttgaattggaagtttggaacttcatttgtgaaagtaaaaatgaaattgcaactaaagagcgttggtggattgattgaggtttatgtcagcttctttaagttctagatttaacttttgataggttcttcttcagtgcaactcagctctacagtgcttatcagtagcaagaaaattttacagtatagtttagcttacgcctcatcggatacgcctttaaatccaattttgtttagagttattatttgatgttttagttcatgcttgacttcaatgatgcatgacagaaatgttgtttgattcaataatgttacaattttgtttaatatgaccacattttttattgctagtttacttggtggaaacaattcttggttaggctttacttacctttcggccaaactccggattagtcagttctcctgatgaaccggaagattaagacaaaaaaaagaagtctactggataaaaaaaaggggcaacaaactaggttttaatacaagtataattcaatatcaatgaataacataacttagtaagtaaaaatacgcaaagagaagtaataataattggttttgtgatagatgcctatttgttgctatttaaatctaaaatggttcacaaacaaaactaattaaagcttttgtagtgaaattggatctaaatcatgtccaagtgaaacccaaaataaaagggtaaagtataatgtgagattcatgtaagcgaactatagctatagtagtacctgatgttttgtatgtcctgtccctgtggctactttccaggagtagccaacagttaagtgactcaaattatgtttaagaaaaaattcacaaaatccacctatttctgtgccatgcaattatcagttttctggtttttgatactctatgctcactagaaaagatacagttgtttataaaaaaaagttgcttgtgtttttcattcatctgctatattgtccagtcggaacatatgaggaataattgtcgtttcagtccgacttacttattgtcaatgtattattgtattatttgtggatgtcatcataagatgctccctctggttgtggtcatcttttttttcttccttttatgatttttttgaaggaatcttggacaatcaaaacttatgattaggcatggtttggtttggtatttaatcattttctctaccattgcccccccccccctccccccaattagaaagagagaaagctgacaaaggaggaggatcagcagtggaagtgaaagaccaagctctgaatactaaacagcagaagaaagagaaggctgaaagacgagctcttcaagaagctcaacgagctgctaaggctgctgcaaaaggtgtgtattatcatttaacgtatacttgtttgaatgggattagtgcaatgttgattttgattatttaaggcataaaaaaactcttcagctagaactcttgaaaattttaagtttctttgcaaactcaaaaagttaattgaagcctgtacttattattttacatttcccattgaaatgttacacttctattatgttggtccttggacctagtttcttattcagacccactgtataagacctaaaacattgtttttagcaagcctgaatagggaatttatgatgatatttcacaactcttcttttctaatctattcactgtgactgacactgctaattagtttgtgcttttataatgagttgttagctgaaggaaacaaggcatctggaactctggcttcagtaaatgtaaaactagctaaagctgcaaagcccccacagaaagttgataatgcttcggttgcagcctctgacaagaaagggggtgatcgcccaccagaaaaagatagaaagaaagatgttcctcaaccacgtctgcaatacgatgataagagcagagtggagaaagccaaacgacgtgctgtggtaaaacaaactgaagctaagaacagagttgaactgttcagacatttgccccagtatgaacatgggagtcagctcccagatcttgaggcaaagtttttccagctgggtcctgtgcatcctgctgtttataaggtggctatgttattccactgtttaatcttgttacaattcatgtttcttgtgtgctcaggtcgggatctatcatttcataatatatgtgatgttcttatggcattctcatagctcaacaattagataataccacatgataaatggtgttccttgcattatatgaagttcaaacttgaaaacagaaggactcagcaccaagttaatttaatttaacagtgttcaataccgcctagagtgaaaaggtgccaaaaagtcagcgtatgagaggtcatttattgtattcagttgcaacactttctatgtttaaattattaaatggaaatgggttctttatgcctagccttgtgtactatattaaattataatagtttcatttaatacaatttcagcacttaagtctcttctaacatttcaatttcttgctttagttttcaacttttaataaaaatttcattgctgaaattttaatgcatcacatccactgctagggtaaattctacactatctccaagcatttagttatttcacttgcagttaaagtttcaaacagtcatttagatagtaacatcacatggttcgcaggaatctaaacattttaaagttgacagttgataaaaataaataaatcctacattaatctgtgtggtttacaatgatgacggcgcaatctcttaccccattggttatattttggactttttccaacactacattgctgccttcatttctttggttttgattttcacaagagggagtcaagtggaagggaggaaggggaagttatatgcggaccaagtacgacttgatttagtgtaattgtatgtttgaagcaaaacacttaaaggttaaagcaattatctattccatgtctcatattacaacaaatggtgaaaaaatgttctcttctggttgcaatgtttgtttactagaatggctaggcaagatgaagaatatgaaataacatgagttacagtccttaaatttgtttcactccttacaaggctcaaaatgatttcatgcctcttttattattattgcactgctttgtcttgcccattattctatttgaaagttaggaagttcatcttaaatgacatctaaattgaaaataaattgcactaggaacctattgtatgcatggagatactatgagctgaatcatgaatttatcattaaaatttatttatggtgttgcagtggatactggataggttagtcattaagacctggttcaatttgttttgaaaatttggcccttttatatgtattttccttaacctttttaatctttatgatgattatcaggttggtttgcagtatctgtctggagatatatctggtggcaatgctcgttgtattgctatgcttcaagcatttcaagaggccatcaaagactacagggttccatctgagaagactcttgtgagagacttaacagaaaaaataagtagttatgtttcttttctcatcgagtgtcgaccactttctatcagcatgggcaatgcaattagatttctcaaaagtcgaattgccaagctaccttcaacgctgtctgagtcagaatcaaaaacctctcttcaatcagatattgaacattttatatatgagaaaattatacttgccaacaaggtgatagtcaagcatgctgttacaaaaataagagatggtgatgttcttcttacttatgggtcttcatcggcggttgaaatgatactgttacatgcacacgggttaggaaaacagtttcgagttgtagtggtagactctcgtccaaaacttagagggaaacttttgcttcataggctagtggagaaaggtcttagctgtacatacactcatgtaaatgctgtttcctacataatgaatgaagttactcgagtctttctgggtgcttcatcagtgttgtctaacggaacagtttattcaggagttggtactgcttgtgttgcaatggttgcccatgcattccatgtccctgttttagtatgttgtgaggcttataaatttcatgaaagggtacagcatgattccatatgctcaaatgaacttggtatgtaaacaacgacagctgacgaggattgtaccgagctcttgccttgtgtctggaaaaaaggttgatgcttctctgattttcttacaggtgatccagatgtcatttctacggttgagagtagagaggatgtcaaccacttggaagcttgggccaatactgaaaatctgcaacttctaaacctgatgtgaggcatttttatttgcataacacaacgccaaattgtcatttctttactctgaccctgcagttctctatattgatgccagctatgatgcaacaccttcagattacgtttccatgataatcacagattatggcatggtaagtgctggaatttaaagatttatttagttgctgctagtagatacctaaactgtgctttataccgggcacccctatgttagattgttagtatggattctatctcactattttagtagaatgacataatctggactaagataacagtttagactaagaaaaccaaaagggtaaaataaaataaaaataatcctaaatattaaaacaagaaataatagatgacattaaaatagtggacgacaagaatctaaactaggttaatcctcataacaataaagccctctatctctggtaaaataatgtattttattagtcttaaaggagcattttcctttatactttttaacacttagtcacgattgttactataatactattactaaatataaaagatttaacaatttaatcttggcaggtcccacccacaagtgtacctgtaattgtaagggaatatagcagagaacaggtgtggatatgaatgcttcaaatgtggatcatctcaattttgtatgcatgcagcgaatccctattttaggaataattttgtaaagtttgggatgatgcatctttctgtatcattttcttgtcctggaataatgtaacggcccttttgttcttttcgaaattttgatcgcttgtagattcacctgtcgcagtgaagagtagggattgttgcttctccagacagattttggccatgcagtctcacttgaacatttttttttctttttctttttggttctagtggtcttcgaattttggatagttgctcagtcagttttggtggttattattctatacccaatttttgatatctttgattataaaaaccatcaccatgagttactggtgaaattgtcactgaataattttgtttcatgtgaatgctttaagtgggatacatagaaaaggattgcatgaaaacgttagccaaagcagtcacttcaactaaatctgaaatttctattaaacacattgccatggtatatcgttaggatggatgctgtttattgcaattccatattagcttgcggggatgcaagcatacgtggtataatcacatcatcctaatgtatagctatacctacagccataaatatgcctgaaattatgagctatacctacggccacaaagtgcttaaattatcctgtgggaaagttacgtcgaaaatgaaatgattgttatcgacttatcagaaaagactgcgaggccacctcttaaattcattacccatgtgagaacgagatgcgcaactacatgtccaatcactcactgtcacaatggttggagtcgctatttttctccatctgggtctaggagtctctgtaataaaatgattgaagttatgacaattggctgggtttaattggtaagtgtccagttttgtagaagttgttgatggttgatgtagcattaggttggatactcgtggcagtcccttgattttggaacgtcctggtctgtttttcattaaataatatcaaaacaagtgttagaacttggaacaaagagtgcccttaattaatgagtgctctagaagtataagttaaagagtataatacatgtcaataataaattattgatatttaattattttgagaaatattaaatctttttaagttcttaagatattaggaaaatgtaaatatagtacattattattttttgaatttcaaatttattttgtattatgttattttttattaaattaaattagcatgcaattttttcccaaacaacattttgttgggatttatttatcttgatgacacacttgttagttatctcctgtaaaagtttctatttgttggcaaactaataaaggctgctcaaattagtttgatgtaggtttaggagtggagaaagggaggagaaaaaaaatactataagcactattagagagaaaaaataataatttattttatgattatgaaactagatcccaattatagtctatatgtggttacttgtatactataagcgctagatgtatttctgataatataattattatttggataaaaaaatcccctgtaattttgacaattccaagaaataatttttatttgaaattgaagggaaagaaaataaatgattttctcccttgttttttttttccttgtccttaattaaaaatcacttaaaaatgaatgagtaatgataagagtacttttcctggtttttttctcccattccttttcctcatccaaaataatacataatatatacaatacatttgaattactagaagggaaaagttaaataaaaggtgcgagtttatcttttttgtactttgttgttgattgctttaatcaaagctcttctgcttagctatttgctatcttaaacattgaatcatcttagagttcttttgacatattcccccctcacccttcaaaaaaataaaagcttattgtcgatgccacttcatttataagtaagcatctattcctgtcattttttattggtttagtctattttcaaagttttagaagcggtgacattaaaagaaaaaaaaaattagaaatggtgttcatcgtaaatatcctagaaacaattgtcttatcattttatacttttggtatcttgttagttaaatatttgtttgaatactttatttaaaaatcacaaattatttttataactttaaccaaatacctttaacttttaatttaaatacataatatgataaaaaaaagtacaatgcaatttcccttttatttaaacatattttacactgtcattattaaaaaaaatacttaacaacaattctcaattaaaagttagttcaatagttctgtttgtacatcatacatttttaaaaaatactcaacgtgggaaagtcatttagtatgttaatgtatttttttttttgtttcatattatttgtctattagataatatacatttcttaataaaattattaattgcacaaggtattataataaaacgatattcattaataaaagtgagaatcttatgaaaataattaaagtataattataaattcatttcattatttagagaagataccagaaaatgaaagtattattagaaaaaaattgatattttcttaaatgaaaaatattttaaggagtaatactatatccttttatagctgtaccaaaaaagaaatccttgtataaattttcctaccaattttcctattgtctcataaaggaaacagtagtaaataaaaaagtacaaacagtaatatttaatgtcctaaaaatacaaaacacattcaacatttactgtaaaaggaaagtaggagattgataggaagacgtagtaagagaatttaaaattattaatgttatctttaagaagacataatataaaatgaaatgagtaataaatgcattaatcgtcgaacatatgtcaactgaacaaaaaaaaaagaccagctaacatttactggcaccgaaattatttctatacataaatacagttgaaatatatttttgcatttccaattaggtaaaattaatatactcctacatgaacattcaatttcataattccaggtataattataagtataattaaattaatccatccatatgttttagtttgttttgaaatatttgtcatttttatcaagagagtctagtttaattggttaaataaaaaattattcttactctcataattttataatttttaacaaatttaataaatactcattttgctacaaaactattaaagttctagctttttcccccttctaaaactatattttagagagtattttagacagtgtgttaaaaacagcattttggggattgttttgcaggcactttatttcaatttttttaatattatattcatttattgatatttctttaaatgtttaaatgtattgataataactatattttaactctttcaacgaataaatgttttttgtaaaaaaacattttataactacaacttatgcatttaataatttttgtaagagaaatatatatatatatatatatatatatattataatatagtattattattggtcaatccttgacacgaagataatcacgaggtaattcttttacaacgttgctataacaaaaagccacgaatgcatttatttcagaataatgatacttaaaatgacgtgaaatgattacagagaagaaagggatagagtaagaaaaataaagtacacaatgtaatgagtgacaatatactatattattataatataaaaaagagaaaaataattaaaaaaaaagagtgtaataaaatatataaaaagaaagggataaaagataagagaaaaaccaaaaaaaatagttttatgatttaaaaaattaaaccaatgattgattcaattaaaataatgagttgataggttattggtcgtattaatgagttgataattatatttgaaacatacaaactggtataggtaacataaatatgagtatatatgttaattgggatataaatttaataattaattatgataatttagtggtaagttgattcaataataaattttatatccttgttcaatttttgagtgtgacatatttttattttgcattttcattaaattttgtattttctaaataataattaattttgattcaatcagtttagctaaatcgatttatgtgtttaatcaattcgagatatcaatttaaccataaaatcaatcgtgccaataggtcacactggattaattacatgattaatccgatgaataatttcattcgattagaatatgagttttaaaagtatgatcaaagccatttattttatttatttttgcattaaaatctggagtcaatgggtaagcttcttggtagacaagctttccattttcattttatttgaagtattccatactctatcttcaagaaaccgctcccaaaagacaaacggtgccttcctacatatccttgatgttgctcatcttccttagattttgtagccttttttacttttctattttctcttcctatatcaaccccaaagtagcaacactaattgttttttttgtttttttttgtggggggggggggcacaagcaagtgattcacacacacacacacaaaaaaaaataataactctaagccagtgccaaaaaaagagtgagattaatagtagtaatgtagtaccacattaatccaaaatcaaatcttttataatttggtcaaagatacattactatcattaagtggcttaagagtatactaattaaatagttaagtcgagtacatcattatccattaaattgtgtacttacccatcctctttcatttgtagttttccctcgtgcattggccaaagtccctttatttatttatggcttccgtttcccaaagtcctccccttctttttgttgcatatgttttacaaaccaccaaacgacatagtaacataaaagagacatcgttttttgttcataaagtttttttaagatagtcgaagaagactcgaagtagagaaataaacagttgttgtaatgttgttcactccagcagaatgattaagtgtgttgcaagccaaatgggacaaaccatgcttatctcgaaaccctaattagccaactctcttttcctacttaacagctctagcacaccgtggcattcccaagcgcatgttctcttaaactcaaataaccattcattttaccaaaacacccccacacccaattctcttccctatattctataatacaattttttattaattaaaattcattaaaaactgttcttttttacaggagtaaataaacgaatgcattttttcctaattataaaaaatatgaattcgtctttagaataattattaattttctcccatattcttgatttatggtgaaatttattaataaaacatttattcattcttcatgtaaaaataaatgcatatattgatttattaacaatatacgagtaatatcattaaacataccactattacatatttaactccgagtatttatggaatacaatttaaatttgtgatattattaatttacttaattatttttgttgatataaatgtattagtaatttatttttatataaaggactatataatataaggttataagtgaaatttatgaaataaatgttaagacttagtataaaattttatagtttttaatgaattttactcaataacaataaatatttaaaaaagttacatataattttgaggagtattaaaattttcaaacatgtttattttaacacactttctattattaattaatatatattaaaattaaatattttaatgggctctaatacttatttaatgcatttttataatttttaataattttaactaataatataaagtatgttaaaagaattatattaaaaagagtattgatgcctttcttaatatttttaagtattatatgtactattgtccaatcaaaattaaaattttaccttaacaatttgtgaattttttttaatacatatctttactacacatgttatcaatgtaaaacctcaattttaattaaaaaacctaaaccatcattaaataaagtgtttcttactaatattcttctttccgttatagtttgtcactctaccaaccgtgggcaataccgtcacgccgagaaaaatacacgagaacccacgtttcgaaccaaaaagccatcagctgaatcccgatattacccttcgcaacgaggcgcgacaataacaaaggcaagggtacttacgtacattccatcacgctccagacattaaaactattaaaataaaaacaaggaacatgagcgatccgcgcaaaaagcaaaaaagaagagagagaaacagaaccgtttgagaattttagagacgttatcggacttcaaatccacaattcgccggaatttgggaaccgcggttgcgtccggagcctcgttagtagttagttagggtttcttttttctctttcttctcttccattcggtttcgaattctcgcgattagcgatgggggaacgaagctgaggccgaatttcaaggttctggttttcgtcgtcgctgtggagtgaacaattctgtgctgctggtggtggtgatgtttacgccgcagagggtttggtcgggctggtccctgactccgaataagagcggggttcggggcggaaccgggtcgggttcggatttgggtccgaattcgggagatagagcgagcacgaagggaaaaggtgtcgcggttggtgagaatggtgggaacttggatcgtgaagttttggttgagagggtttccagcctcgagaaagaggttagtttgttaattattttagtttttttggttttaatgttggggcgattcgttgtcgtttgcctgttatactgtgacgtaggcgtgtattcaagttttagatatggatttttttttttttttgtggtgtttcaagttttgatagcttttggttttgatttgaatttcttgggtgtgtagtgctacggtggaaattgagcgattgctacggaagtgttttttctaaaaggattttgaattatgggatatattctgtgttggtcatttgttaaatttaaaaatatcttttttttttttttttttttttttggtttttgtatatttggtttgggtactgaaaattgaagcttgattctgggtggtagcttgttatgttttgtttcacaggatgaggtttgaagatagtaattactggggatttagtttccgctttttaattccgtcctctccctttctagtcttgtgatgattcacattagaagttggcggtaaagctaaatgtggtattttgtctttggatctggctattttttagattgagaggactgctagaattttcaacaattaaatttcaaatttacatttaatttggactaaaattgaactggctcatttggattctctcaagtgcttgacctcaccctagactcttgaagggcctatttactatgaattcagtgagattggggatttcgttgtattttttttttttggttcttggctttgtctatcatcatttttatatccttgtttatctctttttttactaacattttttattgttccgtcaaggaaggaagggaatatttggcattatagtaaataattttattattgatattgagtatctggagtagttaaacaagacctaatggagtgagatatagattggcggacggtatgtcttaggacggagtggaaaaaagctataagcttggtggagggttaaacccattagtagttctatgttccagtcgttcccttgttttagttttttttcttcattttttccctcttcctttcacccctattttattttagcttatttttcctctcttttgtcttatttccactttttttcttcccttctccctttctctttctttgtcttatttccgatctatcattgagtattaacttgggttaaaagtgatgttgatgttgatgttgatgatattgagtgtctggagactttcatcattgagaagtaatgtgtttgtttgtgtggatatggctgtaaaagtaattagaaaagagatgcatttcaatcttcatgttctattttactgaagtttataattgagcagcaatgttgtatgcattgtttaagttcacctatcattaaaactagggtcagacttctaggttaggtataaacactaagtttttgcttatatgttgtttgagtcagtgcactttcatttcaaaagaaattatctcacaattttggtagctccaggtgttattctttcattttcagtcacccagggttctccatttctctaaatgttgtactgtgataaatactgattggctttaggatgactatgggatgttaagagggatcttaaaatgaaaataaaatatatagaaggggagcttagtgaatatggataatcatatgctacttatctttcttgtcattaatatttgtgctttttaccaatgaaacacagcaggacactagataagcatgtcttcttgtccaactttaacagttttatacttttattatttttccaattatattttgtggtaaggttgtgtcttggtaaagcatgtcttcttgtccaacttacctggcacagcggtaaagttgtgtcttggtgacctgttggtcatgggttcgaatccggaaacagcctctttgcatatgcaagggtaaggttgcgtacaatatccctcccccttacctgcgcatagcgtggagcctccgggcactggggttacagtggtttatattttgtggtttagtttgacctgattataagtttttctgggccagctttatgagtaccaattcaatatgggactgctcttgattgaaaaaaaagagtggaattctaaatatactgaactaagtcaagatttagtagaagtgaaggatgctctagaacgagaaaaagctgctcatttaattgctctatctgaggcagagaagcgagaagagaatctgaggaaggccttgggtgttgagaaagagtgtgtgcttgatgtaagttttttgacatacttgtttacatatgaatcaacttcttccttaaataaaaaatgcacgactgttttatgaattcttatttatgatggatagtctatttccatatacttctattgtcttaacattgaaatatggctatttcttactgatacttggaaatttatgcatcaacagcttgagaaggctctgcgagaaatgcggtcagagcatgcaaaaattaaatttacatcggactcaaagttggctgaagcaaatgctttagtagctagcattgaagagaagtctttagaagtagaagccaaattacgttcggctgatgccaaatttgcagaaatcagcagaaagagttcagagtttgataggaaatcacaagacctggagtctcaagaatctgcacttcgaagggatcgattatccttcattgcagagtacttctttgtctttttagtttaaatatcttctgttatctttttaatttaaatatttcttgtggctaattaattctgatttgtgacaggcaagaagcacatgagagtacattgtctaagcagagagaggacttgtgggaatgggagaagaaactacaggagggtgaagaaaggctggccaagggtcaaagaattatcaacgaaagagagcaaagggctaatgagaatgacagacaatgcagacagaaagagaaggaccttgaagaggctcagaagaagattgatgcaactaatataacactgaaaaataaagaagatgatgtgaacaataggattgcgaatattactctaaaagagaaggtaaatttttgtttgtgtttgcaatattgcttatttttatttttgtttatctggtgttatgtatttaattggtccatatcctcttatacaggactatgattctctgagaataaacttggatatcaaagagaaggagttatctgcatgggaggaaaagctcaatgctagagaaaaagtatgttcttatacctatttatttccttattatatattcttggaaattttgaagatggtggtcaatggtcctatgtaagttgctgaattttattgatttattttttcctttactgttttgcaacttgatcctgtgtaagttgctgaaattttattcaatggtcaatggtcctatgtaagttgctggaattttgttgaattcttggagtattggtattaaattgtcaagactgattataaaatgagtgtgttgtgagcatttttgttattgaatggtatgtgcccatactcttctccattttctttcttctgctgaatacagattggactctttgcaggttgagatgcagaaacttctcgatgaacataacactattcttgatgtgaagaagcaggagtttgaggtggaattggatgagaaaagaaaatccttggaagatggattgaagaataaattggtggaagtggaaaagaaagaagctgaaatcactcacatggaggagaaagttgcgaaacgggaacaagccttgggaaagaaagcagagaagcttaaagagaaagagatagagtatgaacaaaaagtcaaagctttgaaggaaaaggagaagttaattaaatctgagggaaaaagtttggagactgagaaaaggaaaatagaaagtgagagagaggaattgctcacacataaggctgaagttgagaaaataagagctaacaatgaagaagagttgttgaggataaatgaagagattgatcgacttaaagtgactgaggaggagaggtcggaatatctgcgcttgcagtcacaattgaagcatgaagttgatcagtacagacaccagaaagagctacttctgaaggaagctgaagacttaaggcaacagaaagagacttttgaaagagaatgggatgagctagatctgaagagaacagatgttgagaaagagctgaaaagtgtgattcaacagaaagaagaactattaaaactacaacaacatgaagaagaaaagttaaagaatgagaagcaggacacacaggcgtacgtgcaaagggagttagaaactcttaagttggctaaagagtcatttgctgcagaaatggagttggagaagtcaagtctagctgaaaaagctctaagtgagagaaaccaaatgcttctggattttgagctgcagaaaaaggaacttgaagctgatatgcataatcagttagagcagaaggaaaaagatttgatagagagaaagaagttatttgaggaaaaaagagagagtgaattaaacaatattaacttcttgagagaagtagctaatagagaaatggatgaaatgaagcttcaaagaagtaagttagagaaggagaaacaagaagctgatgagaataaaaaacatcttgaaaggcaaaggatggaaatgcaagaggacatagatgtacttgttgacctcaacaggaagctaaagaatcagcgggaagaatttattgtagaaaggcgacactttattgagtttgttgagaaaattcggagttgccaaaactgtggggaaatgatctctgaatttgtgctttctgatttacaatcctctgttgacattgagaacttagaagtgccttctcttccaaaattagcagctgatattgtacagggagttcctaatgacaatttagcttcatcaaggcaaaatactggagtgtctcctgcaactgatccaaagtcacctgtttctggtggcactgtctcttggctacgtaaatgcacctctaagatttttaaaatctccccaattaggaagattgaatctgaagattctggtactttaagagatgttgtgactttgtctgttgagaaaactaatgtggaagattcaccaggaagaattcctgatactgaaaatgaagcagagttgtcatttgctgttgtaaatgattcttttgatgctcagagggtacaatctggcaatgatatcatcgaggttgaacctgaccatgaaacttcagttgaaaaccagaacaatgttcacagtaaggcaccagaagatttgcaggctcctgattcaaaggttgggcagcagaaatcccgcaagggagggggaagacccagagtaaagcgtacgcacactgtgaaagctgttattaaagaggctaggggtatacttggggaatctgctgaagcattacctggggaatctgtggatgatcatgagaatgagtttccaaatggaaatgctgaggattctgccaatgagaattctgaaagtcagaaaccatccaatagaagaataccagcaaatgtcaggaagcgtaaccgggttcagacatcatctcaaatgactgtaagtgggcatggtggcgatgccagtgaaggacattctgatggtctaattccagggcagcgcaagagaaggcgacagaaggctgctttactccccgcacaaactgctggtgaatcaagatataatttgagacgacccaaaatgttagcactctgatttagaaccataatttccattttattattgaatatgatagctgctattttttttttttttttgtttttttgctatttgcgcacttactcatggatgtgcactgaatttttatagtggagcaacaacttcatctgttagagctatgtctggtggtggcaaagaaagtcagggagaggttgatcgtgtaaaagatacagaagaggggattgttgactcaaaaacttctcattcacattcggtgggcattactaatgagaatggtggaagcatacatcttgagcaggtaagcttggtgtagcgtttaaataatgcagatattttaagttctataccttgccccttataaacccctcggtgtatgtgtatcttatgaatcactgagttattgaaaattgggattttgatagtaggatccagaggttgacaagttttgaatttcagttaaattgcttgtcattatttgtttcagtctctgaaaggtgcggagaaaagggacggttatggtggtgataccatggggacctttgtcaacaatatggccttgagtgaggaggtgaacggaacaacagatgatgcggaggagaatgatgctgagtataggagtgaatcccatggggaagatgctactggtggagttgacaatgaggacgacgaagattacctgcaacccggtgaagcttcaatagggaagaagctttggaatttttttacaacataacaccacaagcttcttgaaaatgaagctgtgtcttgacctcatcaactttagggatgatgtccgaagttatcttgtattaacaattggaagtagatctctaaattataaccacgagtggtagtacttaggagaggtgattgaatttctctagtttttttttttttttttttttttttttttttttttttttgatgtttggattgaacctcttggtatttattgatagttttaggcatttgatagtgtagctaaagtttagaggttggattttagctacctccccttggaaattgattgaatccacatgtttgtatctccagttaaatgtgattgtttgaatttaatgagggtgcatgtttgtagcactaaagaagagacctcaacttagacagcgcaatgatgttaatctataattatatgataaatcaagtagtgttaggagagcctttatgtgttcgaaaaaacatttggggaatatgacggatgaaattacgagataagatgaaggtggacaaacgtggacaattaggtgatgtgccctctgcgatttcttctaacttgttactcgtcaaagaaacacccttcaaatcagctgtccattccctcatgtgagatacttctgtcaaatttttattacattttatcatgtaagtgtgattctcgttcaagatatgacacgccatcttcctcaccagaccattcatttgtaaattccattgacccaacaacaaagaatggtttatgagtttatccactatgacacgtccccatcaaatatttcctacaaactcttctttccatttaactatccaccctttacaaccttcataacccatatatctgtcaaaatgagtaggaaacagtgtacaatgcaagaaacatttttgcatgtctttttcaattaaattgtcatagttacagtttagtacgaacctcttttccgatttccaatttgtcaagtttattcaatgcatgtctccaccaatggatgtcattttcccttttcatagttcgagccatcacattgattccaagtggtaaactattacatttcattacaacagatcttgcatattctagtacttcacaagaaagtcgtgcagctgtttcacagtgtccaagttttagcaaagataactcccaagcttcttcttcttctttaaaggggaatattgttatggaattatgtggtgggcaatccatctgttgacacacatgtttcaaacgagttgtgataatcaatttaatgtcattcactttaagaggaatccccaccttttacagatcaatatattcccaaacatcataaaaaataagtagtgtttttactcttttctccaactctgatttcaaaattgtggttctagtcatctcatcaccataaaacttaacctgtattgtttctgcaatgtgatgcaatttggaaatggtgaaatcatgggaagcagtgatccaaaagacatccttgaaagtcccctttcttttaatctcattcttgatataaattgttaggaatgttttttcaactctcccattccaagtatgccaataatgaaaacttcctcatcctccagaagatccaacatgtcgttcacattttcatccgaccaatcccaaggccgcttttccagcaaacattgcaactcaccatccaattcatcgggctcgaacaattcattagccgagccagattggtgcaatgagtcattcacattaatagctttttttttttaggtcctttagtttatccaacaatagtcaaagtaattatcacggtcgtggaactccaaccattgtatttgtctatcagtgtagttttcttcccttgttagataggataacaactcatttatagtcaaagcatcgttaccatcgctacctccgttcaacgtgatcttctatcacacttatttcattgttttaattatgctacattttttaattttgtgttgctccttgactatagaataacgcaactctagtgtgtttaaataatgagtctttagacaagaaattctatttttgaattattttatccaaataaagaatatatttaaaaagtgaaaggaattaatttaactgaaataattaacttttcaatgaaggttgaatctaagtaaaaaaaaatatgtaacgaatcatatatgaaaaatatatattggaatgtaataaatttacctttttatgtcacgctaacgtaagtaataaaaattgaactcagtttaatatttagaggaatgttaagcactaacagctttctcgtgtaaaataataaaactgattattgagaatttgtaagaagcgttacaatttatccccttttgttaatttatttaaaatgtactctaaaatggtgacacaatttaagaacatattgaaatggcaactagaatgcgtacctcttaataaaactgacaattgtgtattgttttgagggttaactgaaccaccaacaatcattttgttgtctccttcaaccgcttcaatgcaacaagagatatagataaaacaaaatatggtcaccattttcaaacttcaaaagaaaatcgataaaaaagatgtcaaatagtaacatactaatactattaatactaacttaacatcttaaagatgataaggtacttataataatgctaacaattaaggaaagtttcatatgacaaatctttctctctcgcacacaaactataaaactgaggattttaaaataaaaatcaaactttttgtcacctaagaaataaaaaacacgagtgtacagcaggaaatgaacaaaacgaattggtaagtaaccagattcataccttctaatagattccgtatatgagatcgtttcagagaagcatctggtggagggaaccaacaactgaacttggttatcatggaaaggttaaagttgattggagcttgttccagaaaacgttccacatagtggagcaaaaagatgccacaatcgtatgcattttgttgctgaggcagctcaagtgacacgaatggaagacgtaaaaatttagaagaaacatcatccctcacattgttgtgcctctctttccatgcttcacatagataactttggaaaacattgtggagatcttcatgaattccttttcgggaatccatgtgcaagatgcaatgttctttgggagattccttagtttcttcatctctgtagcatgtcatcacttcagcaggatgacaaatgacaatcaaactccagtgaagactatggtttatgggaatgaagatataatccttttcaaaaaggttcacttttgttgtccaattgcttacacgctgaaatgctgctttaccatcaaaagcaattgatggattatatttgcctaaatcaacaagcttaggaaagaaaaagcaattgaaaaagtgaaacctgtcctgtttatcagttggaattttatttttcaaatacttgatataaaagtcagtgatattatcattaatgcatttctcaggatgtaaaagctcaatatctctctttctaatacaaacagcatcagggtccccctttggataaaaaaacgccctttctatgtccttgctttcaaatgcagcagaatcatgctccactatctgatctcccaacttaaattcatcttctgagggattgaagttgaagtagaaatcaaagaaaatgttagacttgatttttttttttttttgatgagggaagaaagaaataaaacataatgaactactgcctaacataagtaacacctcaagaatcttgaatgtagcctttaatttagacatcttgttataaaataacttttaaataagttactattaatgatattttttttaagaaaaaatatgaatcatatttttaaaaaaaatatgaatgttatattaaattttaaaataaatttacattgtataaatatgatagacttgactattattacaaatttccacctttatctcatactttgaataacaataattttatttttataaattatatataggtattacatcattattattgagaaaaataataatttatagtaaaggaatttgttaatatatacatgtttattttttgtattaatgcgctaacaagttataattaaatatacaaatacgagagtggtttgaaattagagaagtatgtaaggtggtatataaaatgcacaatcaaattagagaagataaaaaagtattgtaaatatctaattgagagggtgagaaaagtaaaaatcttattctccaactgtgttctaatttacaatactcaaatatctttcatcgttgatgtaagtgtaatgttaaaacctaagtgaaaatatattagcataagaaaagattgcagagaatattaaaaaaaaacgtcaaaatcatcaaagtcttaacaggctagtttttttttttttcaattattttttttaataactgatatccaccatacacattatgaatgtttttgttcatattattggggtttgtatatcttcaaggcagagagattaaaaacagaggataggagagagaaaaaaaggataattaatcctaaaagtcaaattaacggtgatttataatttatggtgcataaccataataataataataataatatattactacttgattctgagaatgaagcagagttgtcatttgctgttgtaaatgattcttttgatgctcagagggtaaaatctggcaatgatatcatcgaggttgaagctgactgtgaacctttagttgaaaaccagaacaatgttgacagtaaggtaccggaagatttgcaggctcctgattttaggttgggcagcagaaatcccgcaagggagggggaagacccagagtaaagcgtacgcacactgtgaaagctgttatcaaagaggctagcggtatacttggggaatctgctgaagcattacctggggaatctgtggatgatcatgagaatgagtttccaaatggaaatgccgaggattctgccaatgtgaattctgaaagtcagaaaccatccaatagaagaataccagcaaatgtcacgaagagtagccgggttcaacatcatcccaaatgatcgtaagtgggcatggtggcgatgccagtgaaggacattctgatagtctaattccagggcagcgcaagagaaggcgacagaaggctgctgctccccccgcacaaactgctggtgaaccaagatataatttgagacgacccaaaacgttaggactctgatttagaaccataatttccattttattattgaatatgatagctgctaaatgttttttttttttttttgctatttggacacttactcatggatgtgcactgaatttttatagtggagcaacaacttcatctgttagagctatgtctggtggtggcaaagaaagtcagggagaggtcgatcatgtaagagatacatgggattgttgactcaaaaacttctcattcacattcggtgggcattactaatgagaattatggaagcatacatcttgagcagataagcttggtgtatataataatcatgaaaaaataaataaataaataaatttactatattccgtcacaaaaagcgttagcgacggaattagcgacggccagagagtggtgccgttagcatgggaggtgcgccagagtggtgcgattagcgccagaagtgtcgccagtagtcccagaatgcacctggaggctctttttctcgaatatctggcacaattagcgccagagtgatgcgattagcgctaggaacatgtccagactcgaatatttggcgcaaatattagcgtgggaacacgggctgggggcctataaaaggccatttttacgaaatttcaggccaaaagcttcattctctccttcctcaagtcttttccgccattaatgaagtaggaagcttcatatctactccattcttcatctaaacactttccacccaactagaaagttgtttagaacttctccatgagctagattccagcttcagttcctcgagagaaccattaatcggagagatcccgttctctagggagctttgcaaaacttagttttggaagggaaagaaggcgattcaaggacgctaaagcttggagaagtgatcctctagccttccttgacagtttagaggtaagaaactcaagttttaccgattgatttgtgaaattgttcttaggatgaatagtgacccatttgtgttagggctggaattaggcttggattctttagaaaaatatgctcaggaggttgttctgatgaatattgaactttgaatcttgactattgatgaagtttggttttgactctgaaatatgtctaagtaggaagaatgatgatgaaatgaaaggtattatgataggtatgagccttgggacgtttactaaaagtgttcaggagaccgtatagaaggtgattaagtgttggattaattgttttgaataacttggttattcttgaaatatagagtggttaaagcaattgtgtgctttgaactagcttatgcagagtcttagagagactttagtgccttggttaggctgatatagatcctactgaggatctgtgagttgcctataaggtggttagttctgataactttaagatagagaacaaaaaggtttaaatggaaaggaataacgtttcttttcattctaacggttgagaaccattattgattgtttgtatgcctttatgtagggtgtgattcagaggctattagtgggtgtgaccacgaggccgggagaaccagtgtagcgctcagagcaggtaagctctttgttcttgggagtgtttcccgtggtctgtgttccatcatactccgaggtggtgatggttattatatatatcatgaggaatgtgtattgaaattgtgtgttactgttttattgaaacatgtatatgatgtatatggattgatgatatacactgtgatagtgtggtgtgattgttgagattctctggccagtagaatagattatatgtgatgtaagtcctgagggaatgtgcgcttcagtggatgattttcctcagacattgatataaagtcctgagggaatgtaccctttagtggatgatcttcctcaagcagtgttgaaagtcctgaggaaatgtgtccttcagtggatgaccttcctcaggcattattacatacatgtgatgtgctgtgatttatgagagccgtgatggctagatgatgtaatgccaattttaatattatatgccatggaagtaaaccagggggtaggaaagacctccaaggaccctgagtttactgagattgttatctcacccctgtaggggattatgttttgcaggtgatactcagggagcggctgatagatcctagggcaagaggcccgaatagagggatatggttctgtgggaaccttaggcacagagtttgagagcatttgactctatcttttgatttatgcctattattttgtacctttagagggatatgtatagttttgatatatctacattgtatattatgagaattcaccatatatgatgtacagtgggtgttgttaatgacgtttgatgacgtcattttgtttattgcttctaattgattatctgtgataattgctgcgcttaacaaccatgagtcaatgttaatgaaccggatgcatacggcacgttacagtgtagcttttaaataatgcacatagtttaagttctatgccttgccccttataaatgcatatgactgagtttttttttcttctgtatatgactgaggtcttataactgaaattttcttttttcataattgagtgcaacagttgaggacactccaagtctccaatattcgtcgctggctttgcaaacctctcatcggagattataggattttttgttcatgtttgttctaataagaacttctttgtgttggaaaacattggtcgcattgattggaattggaactcaccccaaaaacaataaatgcattgttatttatggctgggctacggtgcatgaaggtcatgggaagatgcactaagtagaaagggtcatagatagcactgttagcagatgaatgagacaaaagtactaatttatggaaagaaaagctgacaaattagagcagaaccaaggattacaaaagggtgcactaaactaaatttatacatgtctttccaatcaactctaagtggatgctttattaggtgaaagtaccccttgctatgactcttcccaagtgtactaaactaaattatgtataaaaggttgtcttaaatttatacgtgtcatacttgtttgtgtttcaaaaagagaagataaagcttaatttgatattgtgtacgtagtaggcacagttgcccttgaattaggcactcagggttgaaacaattcaatatttaaggacttgtttggtacagtggtatctggaattagtagtatttgcaattctgtagtggcccaagactttgtaagacaggttgagtgttattgtgtcattgtcaaacgagatacactcctcaatgtgtgctgtggagtgagtatttgcactatatcgcgggggaagatggaatgcaggaaaattgattgaatgcctcaaagaatttcagaaaataagatttcttacaaaatgcaggatttgtctaatgtagtttgatgcagggtgtatttttttttcaaaggcaaacaaatgagtattataaatttataaactcactgtgttttgttgtcctctttacaatttgattttatctgtttttatttttgagattttatcataattactttgctaaatttaaaaactcatttcatcttccgtcttgaattcacctaggaccaacagtttgtactttgcatatctcaaatataaaactctactgtttgaacacctatgtaatatgcaattgacttgcaatctttaactatttttcatactataaaattataaattatttcaataattttttaaaaatatataaataaagaaaggcaaatttcaaaattgtaggggctaaatcttagtctaaaataaacaatgttattgctaaataataaaaactatgggggttaaatattgtttttcatttcaaagaattgtcgtctatttgtaagacaacaattttttatccgaaaatacattcttccctgaatgttatgattttgttgttgtctttacaagaattatgaatacaaagactaagtgacgtaaaataagaacatgatctgaatcaacataatcaatcacacaaattatgggttttttatactttagcttgggacaattgaatatgtcaaatatatcctcatatttacaggctaaatctcctttgcacactgtctctaattctttcaaatcgcaaagatgcaatttcgttaacttgggaagtgtaatatgttgtgggaactatctcatgcaaatatctccttcattgaatcacaacaatttacagatatagactccaggttctaaagttgtggactatctcctgcaaatatctccttcattgaatcacaaaaacttacaaatatagactccaggttttgaagttgtgccactaaccttggtgtcaacaacgtctctattttatggcattccactataagaaattccttgagatgagaaaacacccccgtgccagcaacatctttgcatatgacacttaaacttggcaagtcatcaagatccaaagatttgaggttttggatattaatgcataaggaaaaagatacacagaatagactctccaattttgagcactttcgaatgttaatgtcctttaaagatagagaacctttggatgacagagcagcacaaaagcattcccatttattattgtcacttacagatagtttcgaaaggtctcttggcattaaataggacaattctgtgcaatctccaaacttaacacttcgatgttcaacatacataagaccctcatttaaataaggcatcggttccctaaattttccaacatagataatataggttttaggtccataaacattgttctggatttcttccacataatggttgtagctatcctgatcgagaaagcttccagcaaaacatttaagcctattcatcccttttacatcttctatttttatacttgaacaaactcggagatctagatattgcatattggtcaaaccaggcagtacgcatcctgtatcaatttcaccgttgaatttttattctggaacagatcaagccattgcaacttttttagattttgcatactttctggtacttggaggatcgaattacagtttgaaatgtccaatcttgacaatttttttagctctccaaggggatgtatatctttcaaatttgaacatccacagagcactaaagaagtaagagaacccaacatagacaacgactttggtaaagatgttaatctatcgttatatgataaatcaagtagttttagagaattcatatatgtgaaaaaacactctggaatatgacggatgaaattacaagataagatgaaggtggacaagtgtggacaatcaggtgatatgccctctttgatttcttctatcttgttacctgccaaagaaactcccaccaaattagctgtccattcacttttgtgaggtatctttgtcaaactttcattacattttatcatgtaagtgtgattctcattcaagatatggcatgccatcttcctcaccagaccattcattcttaaattcttgtgacccaacaacaacaaagaatggtttatgagtgtatccactatgacacgtccctcatcaaatattttctgcaaattcctctttccatttaacaacccacttttaacaagcatcataacccatagctctttcctaatatcattaggaaacagtgcacactgtaagaaatatttttgcatgtccttaattaaattgtcatagctactttttagtacgcttaagatctctttttcgaattccaatttgtcaagtttcgatgcatgtctccacgcatatatttcattttcccctttcatgattggagccatcacactgattccaagtggtaaaccatcatatttcatcacagtagatctagcatactcttgtactttccaagaaacttttgcaggtgcatgtttttgcaaaaataactcccaagtttcgtctttttcttctacatgagagagagggtgcattgttattgtcttatcaagtaggcaatccatctattgacatacatgtttcaaacgagttgtgataatcactttaatgccattcacttcaagaggaatccctaccttttgcagatcaatatattcccaaacatcatccaaaatcagtaatactttttttcttttccccaactccgatgtcaaaattgctgctctagtcatcttatctcagtaaagcttaatctatattgtttctgcaatatcatgttgcaatttgagaatggtgaaatcatgggaaacagtgacccataggacatccttgaaagtcctctttcttttaatctcatccttgatatgcttggctaggaatgtttttccaactccctcattccatctatgccaataatgaagactttgtcatcctcgagaagatcccacatctttgtaacattttcacctgactgcccccaaggcttatctttcaaggataaactttgcaactcagcatgcaatgtaacagactgggacaattcattagtcgaaccagactgatgtagtgagtttttcacatcaatagctcttttttcaactcctttagtttatccaaccgatcgtaatcttgtctcttgaattttttgcccttgaacttcagccactgtaattgtcttcttcccttattatttgtgtttaaataatgagtctttacacagtaaattctatttttgaaatgtattactttaaaataatttatttagaaatatattaattaaaagaatttgaaacacactcacaacaagaagagagatatagataaaaaaaatacaatcaccatttatcaacttgaacaaaataaaaaaaatgtaaaatattgaacatttaaatagaataaaaattgaaatttatcattaaaggttaagaaagcattatataaaagttaaggtgacaactttcattgctatataaaaaatgtcaagcatattagttaccttataattgattcaatgtatttactgcctgtggactgcttgaactattgcgagctcctttattgctacgatatttggggcatttactaatacccgttccattgccatagagatgcacatcaattctattagcatttcgggcgaaaatcttttcacagtggttgcacataatctgatcgtttcctatttctgtaacttctttccacgtttcacttctgggccgaccacccgtttttcttttactactagacgctccatccattatttatttccaaaacacagtaattttaatatgggcctatctgtaaatatatatatatatatatatatatatatatataataagtgaaagaaaatctcaggattaacatttggtagtgtgaatcatgaaccaaatttcatttacaaaaccaaaaaggagaaaaacggggattaccgaatgatgcctttcctcgtagttgtgaaaacagaaacttttttgaataaatttgacgagtgatttgagaactgaaaagaaccagaaagagatttggtctcgaagctcaccgataagaactccgtctcttaagtcttaaccttacctttggggaatgggttgtggctgttatacaggctgttgccgtactgtacaagtgatttacaaattacaaagactttgactttgcaagacaaagacaatttcttccaaatttcatattccatttaatttcgttatatttcttgtagatattatagttgttttaatttgacccatctgattatggtaataaattcattaaattgtggggtataaagtgtgttgtgggattttttctttattttattcgaaagcaaaatatgtaattttgttacatagttgtagatattaagttatttaattagctagacttatggaaaatacgtttatgatatatatcattcaggatgaaagatggaatagaagaaggtaacatagtcaaagacttagttacaagtataaaatggtgaagccctaataaaaaaaataaaagaatggccttcaattgaagtcaacaaatgaaaagaaagaaaatgcaatgtgaagaaaaaggaaagaaagaaaagcaaatgttaaaaagaagtaatggaataaaaattcaaacttagatctgaatgcatatgaaaatagcggtatttcaatctcaatgttgtttagtcacttcccaagcactcctacctttaagccatgccaagttacaacctcatcaagaccttttgatcaattatgcacgtatttaggttcttatctttaggaacttgagaataggatcaaacttatggtagtactatggttgtggtggattgagagattattataatacccagacacttgagtgatgagtgaatatttgtcttggtgaggggtattcaagatagacttttgtgtttgatagatttgaaaagcattgtttaaattttgatagggattcagtcatgtttagcatactaagcttggagatcgttttgttcaatgtcatgcttggaaacttgacccttgcttcccactgaaaacttttgtttattgctgaggacaacaatatctaaatctgggaattatttgatatgctcctagcatatagtactttccaagctaatagaagcaaggaatcaatcataaatcatcgataattgtccataaatgctataaactgtgattattccttcgctaccatgttctcagctaatttgggcaattttatagcaggaatacaacaattcaagcctgtttgagcaaagttatttggcgctaccagtgccatttaccacgccattcgcgccagcaggagaaattggagcttcttgactgaggtcccacgctaccagcgtgaaaaccacgccgccaacgccatcaaagggaaacttgccaattgcttctgttttaccacgccatcagcgtgagagctcgatttctgtagcatctgaaagctgttaagggtagtttgggagttttacttccccaaatataaataccaaaagcccacagctttgagaggacttctggcacgaaatatcacttagaaaaggctagagaaaagcttggagagcttaactagggttgggagttgcaggctcaagtggagattcttctcttctccttcttcttcctttttgtactcagctgggcatgcttctttttgtacatcattgccaaccatgattaggtttggctagtttttatttgtagttaaggctaacacttgatgtaacttccttggattggattggatgctattattcttttatatcaaggtatttcactttaccttgcttgaatgagtatttatatcttgttggaattgatcactctagtaggatattgagagcatctagggttcacaataggaatattggagttctatgtttggacttgggaaaagtgacaaactttacattatctaggaatagaaatgtatgtttgcaaatcatttaatgtaacaacttaatgcttgacatcatgaaagctactaaggaattagagtttttaattgggttgaagggtttatgtcactaagggattaagtcttaactaccaactttatgaagatgcatgacttgagtaacttgtggtaaatgaatatagtaaacaatccatgtacgaaggtgggaagcattgagtgtggattgccctaactactatcgctcttatatcattgcaatactaagttacttgttcttaagcatttaatgttcatagttttagtctttaaattcaatcaattacacatacacaatacaaaacttcctttaaaacatttgccatccaacttatagatatcagttataatacaattggtgtatcaatccttgtgggaatgatatctcacttatcactttattacttgaaacgaatggtatacttgccgatttcgcaacatatactcagaataaggactgttcatacttgagtaatatcaatatccaaaagacgatgagaatcaaaaatgccttaaaacaaggcatattagatctaagatcaataaataacatccaaacaagatgcagctagagagggaaaaaattaagatgttttggtttcaattggatttacatttattcagataagcaatacagatagtctgaacacagtaaaatttaagggctaataataggattccattcataaacacttaattatgtgactcaagccacattatatatggacaaagaacctacccaaaggttcccattacacgtgtagttacatgtgtatttgaatcttaagtcttaagtattaagtcttaatcttacctttgggctttggagaatgggttgtcgctgttatacaggctgttgctgtgctctgacacgtgatttacaaattacaaagactttgactttgcaagacacagacaatttcttccaaatttcagattccatttaatttcgttatattgctgtagatattataagtagccaaatgctaacgaatgttaaaagggcatacatattttatttcttgtagtggggttccttttgctatcaggttatttcttgtagtgggatgtcttgtatatattattgttgttttaatttgacccatctgatcatggtaataaattcatcatattgtggggtacagaatgtgttgtgggactttttttctttattttattcgaaagcaaaatatgtaattttaatatgtgtctatctttaaacttgaaatcataggattatgtactattgtttttctatataggtgggtatattcatggaagtggaggaggactttgcttcaatgtgaacaagacaagttagtggagaaaggagcggggtaggtgagtgtggaatgaagatcatttaattcagtatactgttaaaaaaaatgagtgtgaatgagaagttctttgaaaagatgtggatgaaaatctcaggtattacaagtggtattgcaatcatgaaccaataattttcattagagaaaaaatgaaattaccgaagaatgctctctttgaatatctcaaagtttcttgttttagatttgctttccaaaactagtgatcagcactcgaacttgatccctctattcctggcctctgaacctaaacttggggaatagatggtcaattacataagatgttctagggttggttattagtattttttttaatgactaggacgtggaccaattttcgagaaattacgcatacacactcataaaacggcatattgttaaattttggaaacatgagtaattaaatatataataaaattatttgagagattaaaattgcttaccatatgtgaataaaaagtagatttttaagcttaattaaaaaataaaggtatgtttattatttaattataaaatatgtttagtatatcaaagttaagattaaattattgatgaaaataattatcggtcaaattttacttattttctaattgaattttgaattaatcaaaattcttttttttaatgttaaaacaaaaaaaatcattttttccataattctatcgattttgagaaattaaaaatttagatgatccaaagtaatttttccttttctctgccttttctatttggtcttttcgtctgtgtcctttttcatgcaactggtctgggcataaaaatatggaggacatacatatgtggcgcgacggagccatatatcatatatgtaatcttacaaattaaaagccatatatcaaggccaaccatgaataggtttgactagttcatatttgtagttagggccatacacttgatgtaaactccctttagattggattgggtgttattattcttttatataagttattttactttaccttgctttgaatggattacatctctttattagacttgatcattctgataatgtgttgagagctagggttcacaataggtatattgtgattttaaactctgacttgggtgaagtaacattctttacattatctaggaatatagatgtatgtttgcggatgatttaatgtgtcaacttaatgcttaacctcaggaaagctactaaggaattagggtttttaagtgggttaaaaggttaatgtcactaaggaattaggacttgactaaaactttgtatgaagacacattgactgagtaacttgagtaattgaatgtagtaaataatccgaattaagaaggtaggaatcatcgagtgcgtgtgccctggctactctctcttatattgtcgtaaacttaacttcattgtttataattatttgttgtttcttaattcttgtctttaatcttacttatttcaacatacaaaacataagtttaccaaacatttgtttatccaacttttagatacaagttataatataattgatgcatcaatcctcgagggaatgacatcttatttatcactttattacttggaacgatcggtatacttgccgaaaacgcaacagtgtccatttaaaaacaaatacgcatagctctgttataaactttaaagcaattttaaaaactaaaaaatgaatataaggcaggggtgctactgtcaatctagtaaactgttttgattgagcatgtaattgttcatggctagatctacatggacgagttcatttagaaaatatttttaaaaatgtcaatagaaattatgcttcatgtttcctggatgggggttatccaatggactcttacatgcttgcttgaatgctcaccttgttttcatacctgtttcctttaatggttgtggttctgtttattaatggatgttggtcttaaatgaaagaatagaacccatggttatcaataaacataggaatggaatgctaggttatgatatagtgaaccttgtattgtgcattgttttcttcctagaacaattttgcctagcagaaatttactgattcttagaactgtttagaccaatgctcacatcctgtactaagtgcaattgttctggattttgtttaatggtgccataatacatgttgaggattgaaaaccactattatttacctgagttccacaaagcttaacattgggttttctgtgttttctattaaattgatgcatgctcgccctgaatgtatatgttgattcatgttgtttccttggattgtagtgtttctgtgcactacatagtcttggttctaaatgctagaatttgacctagagtttagaagtgaaataggacatagaatgcttgactattagtagcagaatttatgggttcttagggttgttaacccaatcatcatattatgttgcatagctaagcgttctgactttgcttgaatgtgccatggttctaagaacttaaagggtatgtaaaaaaaattactttttatgagtaactcttatggaggcagaaaagtgaagaatatcatgttatagttttgaagagtggtgctgctgatgcacgcatggcaacagtaaggaacaagcttagttatgccatatagctataaggctggtagcatcaaggaaatcaagatttttcgagaccctatattatagcttgctaaattctattttatgttgggaattatttaatattttacttaatggttaaaatctaggcatgaaataacttgagaaaccaataattgcttgtgcttactataataagactagctgctagatgatataggtcaccaagaaattaactttttgatagtggaagtgactctgctaaataacacaacaatattgaatatagaaaatagcaatcttcgttatgcgctatgctgcaacctccaaatcatatagtcgttgttaccaaccttaaacctgacaattctaaactaccaacttcttgctcatgatgctacagccaaactgtataagaccaagtatcaggagagttcttgagctgctttaattttaaatcaccaaatgctttttaaacccacaatgaatctgtgtcctgaaatttaatggtacttgaagagaggtatattgtttcaactccaaaaggttttggcttcttgttgtgtatcttctcggtttttggttattctatagtggtgttattggggtttgagtttggggaataatttattgttctttttattttttgttttttaaagtattgggatcctgatttcgggagggtttccaacatgccaacaagagttgtcattggctgtttttgttgagttgttgagaggttcctcgtacttggtccttgtttgtggtggtgccatttttatatattgttgagttttgctccatcagcgagtgaaacttggttggtcacttgattttggggttgtggtatttattcgatttacttattatgtttactatatagtaagtttaatcaatcattcttgtcttgacacttgtaaatggattaactgtgtataattaaggattatatgttgagttttgcctatatatagatattagggtggagttataagattgatagatggtaaaaggagaagagatggaaaaagttgttgatggttcgattttagctttaacaagaaactaataattcaaaattaatatttaccaatgcttatggttgaccatgcagcttgcagcggttgcggcactgtgcgtgcagtatgaagctgagtttaggccaaatatgagcattgttgttaaagcactccaaccacttctgaagtctcccgctcctgctgctccagaaagttgaagcaaataaaattgcttaggtgtctgcatcttctgcacagctcgattcagttatctccaaattccatcaaatactacagatatatctatacatccgaagcagggtcttggaatactcgaatgtgaagaacagaacaaggggctgcttccaagagttgtagaaggactttttgatttcataaattctttggatgaagaaaagacatattcaattaaattgtcaatggtacaaaataaataattaaaaccacacatgactggcaaaatcatcaggttatagtaaattatttttctgattttgttaataatttgtccaggttgaaatctacatggaaaaagtaaggtatgcatagaaaaaacaagtatgttttcccccatatatgtacttagagaatattctattggtttccgattgacaaatttcttaactttgttggagaagctaattttgatgtgaatttgaattttgaacaggactcagaataactctatcttcttatatagggacctatttgatttatcaaaagataatatacaaagtaaggagattaaatcacgaggaataattctacctggtgttacagaggtgagctgcatattatctcactgcattccgattattctttttcattttgaagttactttgttgttcacaattaggcatatggtcttatgtacaagtactgagatgtaaaatttcaattttgaaacttgaatcctacttatgtactgacaatggttgacattcaaaaacataggtgttggctttacctgtttagcatttttcttaggattcataaacttaatagtctggcctatgcttatgatgattgtaatctcttaaacttaacgtgattacaagaagttttgaggaaataaaattgtagctttactattaattataaattttggtctaatgataaaagtttatttaagaagtggtatcaaagaatcatgattttacttttacttttacttttgaagccctagcgggaagagggaagagggggtattgttgcctttatttgggttttgggctgaatgtcttcagttttcacccatgaccttagtgaaaaaagtaaccccttgctcgatgccgatttaaaaaacttcaaggaagtaggttgtatccttattttatgtacttgacattttgattgatgatgcttgtaagttgtaattggtatagccctttaagcttgacgttatcctggaaaacatcaataaaataaagttgtcctctttcctttagttataacttttggccaatccaacagtaagctcatgtacatacatataaatatgctttagcaaattatctaaggcctaacttctttaggtaacaacataagagcattggatgaggcactccttgagctgattcagcaagtagagtagaatggaatcatttagtatttttatatgcaactttaaaagttttcctttccttatatgctagaagatatttgttttactgaaaagaaaagaaaaaaaaacactaattggtgattcttattcaattaacgtcatatagtactaacaggacccctgtttttcccgctgaagcattgcaaagcctatctgtaagaaagaagcaagttgaatagcattgtttggttttatttaacaatgaattttggcttctaattctgatctcaaatatgtacaagggaatagctaatcaagcaattggtgagacccgtatcctgctttgactcttaatcttataatgatatcaaattcagtgtttttataaaatatttttataggttatggataatattaaatattttataatagctgtatattagccttagccatcaaaactttggacaggatgtagtaatagattagggtaaattccctgttttcttgagggaggaaaagtagtggtaggaaggtcacttgccccctacaaccttcctaaacaaaacatgtagaaatgaacgtggccagcagcagaagtcattgtatttatatattcacaattcagtaagaatttttttccagagataaaaggtcttgcatcttcctaaatctctgtggtattgcttatgaatcattgttaaacacataagactatgaacaggacgaggtccgggaaactaattgtagtggacttgacagggtcagaggaagtggagaaaacaggtgttgagggaagagttctagaagaagctaagaccataaacaatgaagtttgataaacctaggatctcatgtaaactatttaaatctctcactattaagctgactctagtagattaatctatgtgtatgtgtgttctaggcagggacagatctatttgagagactggggcagttgtgtacattatttttatttttattttacataatctgtttctagcattagtttatatgttgatgatagtatcttgttatgtggatttttaactattgttatatttcgtgcattcattgtcatctttatttatttattattattaaatcataaaatttatgaagctgttttggttttaatgaagtaaatgctcctaactttatgactatatgtatcattataaggggtgtgatataaaaaatctcaagggcaacattttttttgtgatttttatccatttaaaaaaaacaaaaaaaaatacatacaaagacgatttttaggcaaaatcgtctttgtatgtggacatataaagacggtccgtctttgtatgcggacatataaagacggtccgtctttgtatgtattttttttattttttttaaatagatacaaagacggttattaagcaaaccgtctttgtatgtccacatacaaagacgattttcctaaaaattgtctttgtatgtatttttttttgtttttcttaaatagatacaaagacggttattaagcaaaaccgtctttgtatgtccacatataaagacagttttgcctaatgtaacaccccgtaggcctccggtgcgttatcattaataatatcagttaagcgcttaaaaacataatataaaactcagcagaagcaaagaatcgcttttcttgattcattatgtatgaaataaaagcatatcacagagaacatacacacaagacagatatttcacacccctgctgatccagtttatcatacagtacatatgtagacagatcatcagaaatattataagtatactaaggaggaacatcatatatcatatcaacatcaattctgtacatacatatatacaacagtatcacaccacaccgtggtgatacaaaagaatatctgccctcaccgagggtatacagaactatacatatctttggtgtacacacaccatcccttatcaagggtacaaaacagaaacaaaaccaaatctgagccttcaagctccctctgctgctatcagccaagcaggaacgtctctactcgggcctcctgccctgagactgctctcttctgcctgaagagtcacctgaaatcataaatccccacccggggtgagatatatatctcagtaagctcagggtccttgggaaatcatccccaccctggcccaccattcacaatacacacatcaggcaaacatatcaaacatggcccactggcctggccctctggccctcatcataatatgagcatcatcatactccaaacacatgaacagatggcagagctcctcaatgcctggcggagctcctcaacgcctgacggagctcctcaacgtcaatatcaatgtgagaccaaaaactcacacccgtgtcatcaaacacatggcagagctcctcaatgcctggcggagctcctcaacgcctgtatttatctattggccaacagatctatcacaatcatagcatacattcatccagcacagatgcacacatatcattataagaaatgtaacaaccaatgcatgcatcatgaatcatgaccaacactcccccggagtgtggtgtgcaaccaaaatgggatatcattccccagggactcagaacttacctggcaaagcctcgctctgcagttctttccctgctctgtggctcccgccaccaacaatctcacaatcaaggcctaatcaaggcacatgtaatctcatatcaaaatcaagccaacaggcattccagcacagaacatattatatacagaattcccctatcctagggttcaatcaagctcaacccacaccaggctgttcacagaccatacaaggtccctcaaggctgaagatcaagcatctgagtcatcccagactcaatgcataacacatatctgagcataagctttcctcagccttataactcaatatatctctggaacggtctaacctcaacacaggcaccgttcaactagcctctcaggctcataccatcataatcaaggctctagcatatcagagaaccatcaacaagtgactctacacaagtcacacaggcaaccacagagccaagattcaaagtcatctaaattagaaactgaaagctaatccttcatctattcatcgctctaaataagtttctctacaggaccctgggctaattctagccccagctcatatgggtcactattcacagaaaatcccaaattcaaaatcaaccggagaaatttgagtttcttacctcagtggcgaccaggaaggctaggggacaactttccttagctctgttgtccgttctgcgccttgggtccttgccaaactcaagttcctgagcttttccttcagaaatgggttctcactcaattggggtttttcaagagaagagatgaaggattcaagctttctaagtgattctctcaagtttataggtcatagggaggtgtttaggccaagatatagggtcccaaaaagcttggaacagccattaatggaggttggaggtctagggaggaagaaaagttggttttttcctcccatttcgcgattgaccctatatatactcagcctgcccgaggtctggcgcgatccgcgtcaactccctcgaccatctggcgctatccgcgctgcacttggcgcggtccgcgtgaaaaaccagagaaaaatggttttccaaggcacttatggcgcgacccgcgccacccttggcgctacccgcgccaacctctcggccaattgacgctactcgcgccatagccacgctaccagcgtgaacctgccgaacgtctggcgctaaccgcgccacacccttcactgggtcttctgcttcaaaaaaccggcgctaaccacgcgggacctggcgccaaccgcgccatacatcagggttatcacacctaacaaccgtctttgtatgtatttttttttgttttttttaaatagatacaaagacggttattaagcaaaatcgtctttgtaagtccacatacaaagatggttttgcttaaaaaattgtctttgtaagttttgtttttgtttttttttttttttacttttttaaaaaggatacaaagacggtttttagacaaaaccgtctttgtatgtacacatggaaagatgattttgcctaaaaaccatctttgtatgttttgttttttatttttttttttattttttaaaaagaaacgaagacggttattaagaaaaaaatcgtcattgtatgttgacatacgatgacgatttttccctaataacggtcttcgtaggtgtttaattaaaaaaaatgaaaaaaaatttaaatacaaatgaagatggtttttatcgtatgtggacatacgatgacagtttttccttactaactgtcttcgtaggtgtttaattaaaaaaagcaaaaaaaaaaaattaaatacaaacaaagacggtttttaaggaaaaaccgtcttcgtatgttgacatacaatgacggttttcccttaataaccgtcttcgtttgtgtttaattaaaaaaaaatacaaacaaagtcggttttttagaaccgtcgtcgaaagtaccccattttcaacgacacgtgcaacaacgacggttcaacaacctacgtcgtatggtctaaataaccgttgtcgtaggcatcctgtgtagtagtgcgtgtgtcttgactactctctcttatattattataaacttaacttcattgtttataattatttgttgtttcttaattcttgtctttaatcttacttatttcaacatacaaaacacaagtttaccaaacatttgtttatgcaacttttagatacaagttataatataattgaagcatcaatcctcgagggaacgatatcttatttatcactttattacttggaacgatcggtatatttatcgaaaacgcaacaatgttcatttaaaaacaaagtcaaatacgcatagctctgttataaactttaaagcaattttaaaaaataaaaaatgaatataaggcaggggtgctactgtcaatctagtaaactgttttgattaagcatgtaattgttcatggctagatctacatggacgagttcatttagaaaatatttttaaaaatgtcaatagaaattatgcttcatgtttcctggatgggggttataaaataacgaatattggtacatgtggcatgtatcaagattttgtaaacgttgaagtttatatataaaattatgatcacacctcatcttctacacccctctctaaaaagggatgtcaaacactcattttccttttagaatttggtaggtccctgtgtcagtgtatatgttttatagcttgtgttgtaaatttgtgatgaattaattattgttgtctattcaaattatttaatcagagatatgtatcttaccgtggagatggtaatgaagagtattgttgggaacatagtcatatacaagccatctctgatgctcggatgtacagtaaacaaccatagaaaccggatgaagatgatgtacacggctaataatctcaacttcttacctgaattcgcgttcccctttcccaccaccaattttgagctgtttcacatctacttatcttccatctatgagaaaacctttataaacacagccaagtccaccttctcccaacaaattttgtgctgaaaacccatttgtagcttgttctgaacatcatgatgaatggaggtgcatatacgaacgccttttccttttattcgatccacatgtgctttaattcttgaaacacctcctttaaacttgagtccacactgcttgcacttcaatgtaccgtttccttctttggtaacttgattccagtagtgctcatccataggcctacccatgattattatatttcctgaactgaacacagataatgaaatttcaacaatattgatgcacatagtacactatgtgtgagtatgactctattaatcatgtagtatattttttcctgcagagagatattatacatatataaaaggaacaggagagaccatgtcttatgtgctccttttaataagatatgatatggttaacacttaacagttaacactacagaaagaaagtacacctatgcgtagcactgtagtttaataatcattaaaagtatttagcaaaaaataacaataatttgaataatttgcaaatggcgtaaacatgggtattgtataaatcttcactgcataacacagtgtcatgggatgaattaagcaagttcagaacttgaacttatattttaatcagacaatgtcgttaagagatcaacaattaaaaaaattaaatatacaaatacgagagtggtttgaaattagagaagtatgtaaggtggtgtataaaatgcacaatcaaattagacaagataaataaatactgtaaatatctaattgagagagtgagaaaagtgaaaatcttattctcaaactgtgtgttctaatttacaatactcaaatatctttcatcttcttggatagttgatgtgtgtaagtgtagtgttaaaagctcagtgaaaatatattagcataagaaaagattgcagaaaatattaaaaacgaaaaaaaagaagaaaaaacacagaaacaacgactacaatcaaatatgatatagatttagattttctattttattttaaaaaatgaaaaaaaaaaggtgacccggcaactaaaaaaagttgacatgtaaagttaattgaatgacgtcaaaatatcaaagtcttaacaggctagttttttttttttttaatagttttttaataactgatatccaccatacacattatgaatgattttgttcatattaatagaggtttatatatcttcaaggcagagagattaaaaacagaggataggagagaaaagaaaaacgataaataatcctaaaagacagataataataataataataataataataataataatatattactacgtgatatgatgtaaaatttactaattcttcgcggttcacctcaagcactgcaaaaaagcaccggacacacgccctgctttccctgcaaacaaacactttatctcattacaaactaagcacaagagacgaaaaactggcagaaaattagagagggaaaaataaaatttaagtgtcctaattaagtcctggcacggattaacactagagcccaaaaattgagaaaaacaagtcatactgaccttgaatctatgtgtcacagaacgctgctaccattcatagacccttggcaatccaatgcatgcatcagttccacctatcacggagtcatagttaaacaccctttgatgtgtcagaacagttgtggaatatcaacaccaaaggttttactttgaatgtgagtgaggtcatattttgccatataaaaggccaagtctaagaactttgaacaatcacatattgattgtaacaaataattaaagtcacctgtttctggtggcagtgtctcttggctacgtaaatgcacctctaagatttttaaaatttccccgattaggaagattggatctgaagattctggtactttaagagatgttgtgactttatctgtgtggaagattcaccaggaagaattcctgatgctgaaaatgaagcagagttgtcatttgcttttgtaaatgattcttttgatgctcagagggtacaatctggcaatgatatcatcgaggttgaagctgaccatgaaccttcagttgaaaaccagaacaatgttgacagtaaggcaccagaagatttgcaggctcctgattcaaaggttgggcagcagaaatcccgcaagggagggggaagacccagagtaaagcgtaggcacaccgtgaaagctgttatcaaagaggctaggggtatacttggggaatctgctgaagtattacctggggaatctgtggatgatcacgagaatgagtttccaaatggaaatgctgaggattctgccaatgtgaattctgaaagtcagaaaccatccaatagaagaataccagcaaatgtcaggaagcgtaactgggttcaaacattatctcaaatgactgtaagtgggcatggtggcgatgccagtgaaggacattctgatagtctaattctagggaagcgcaagagaaggcgacagaaggctgctgctccccctgcacgaactgctggtgaatcaagatataatttgagacgacccaaaacgttagtactctgatttagaaccataatttccattttattattgaatatgatagctgctaaatgtttttttttttttttgttgctatttttgcacttactcatggatgtgcactgaatttttatagtggagcaacaccttcatctgttagagctatgtctggtggtggcaaatagagtcagggagaggttgatcatgtaaaagatacagaagaggggattgttgactcaaaaacttctcattcacattcggtgggcattactaatgagaatggtggaagcattcatcttgagcacgtaagcttggtgtagcgtttaaataatgcagatagtttaagttctgtaccttgccccttataaacccctgtgtatgtgtatcttatgaattactgagttattgaaaattgggattttgatagtaggatccggatgttgacaagttttgaatttcagtttaatgttctttcccctcctggtgaacggtatcaaactaatgttaaattgcttgtcattatttgtttcagtctctgaaaggcgcggataaaagggacggttatggtggtggtaccatggggacctttgtcaacaatatggacttgagtgaggaggtgaacggaacagcagatgatgcggaggagaatgatgctgagtataggagttaatcccatagggaagatgctgctggtggagttgacaatgaggacgacaaagattacctgcaacccggtgaagcttcaacagggaagaagctttggaatttttttacaacaccacaagcttcttgaaaatgaagctgtgtcttgacctcatcaactttaggtatgatgtcggaagttatcttgtattaacaattggaagttgatctctaaattataaccacgagtggtagtacttaggaacctctggtatttgttaatagttttaggcattcgatagtgtagctaaagtttagatattggattttagctacctccccttggaaattgattgaatccaaatgtttgtatcccctgctaaatgtgattgtttgaatttatagtgagggtgctttgtgtatcccgttgtgtgaactactacaggtgtcaacagaattaatgccaaaagatatttgtaactgttattctcttaattaggagattattagcttatttagtgggctgaaaatcagcttgacagattgtaattgcattagcttatttagtgggctgaaaatcagcttgacagattgtaatcagtttgtatttatatgagaattctccagcaggagagcacaggtttttgacccaatcttctctgagtttaacatggtatcagcctaggttacgatcccagaacctagtttgcgttttttcctgttgcttttcagccttgtcctagtttcctgatcttgtttcactcttcttcacgttcttcttggtcatttgtttctcagtccagattatcctctcagtttttattcctatttttcctacatccatggcttccgaaaaatacgatgtcttgttggtccgccttaatggcaaaaactactcagcttgggcattccaattcaaaatatttgtcaaaggaaaagagttgtggggtcacgttgatggcagcactcctgcccctaacaaagaccaacatatggtggatcatgccaaatgggaagtcaaagatgctcaagtcatgtcctggatccttggttctgttgattcaagcattgtcctgaatcttcgaccttacaagactgcagcaacaatgtggtcttacttgaagaaaatttatagtcagaataacgcagctcgccgcttccagcttgaacacgacatagcgacatttaaacaggatagtctctccatctctgatttttattctcaattcatgaatctatgggctgaatacactgatatagtttatacaaacttgccttctgaaggtctaagttcagtacaaacaattcatgaaactactaaacgggaccaatttcttatgaaattgagaactgactttgaaggtatccgatccaatctcatgcatagagatcctgttccatcgttggacgcgtgcctcaacgacttgttgcgtgaagaacaacgtcttcttacttagtccatcatggaagaacagaaatcatctgttgttccagtagcatatatggcacaagggaagtcacgaacccatgacatgagtggtgttcaatgtttttgttgcaagcgatttggacactatgcttcaaactgtccaacaaaattttgcaactactgcaaaaagaatggacatattattaaggaatgtaaaatacggccaccaaggcgaactgccacagcttatgcaacctcaattgactccgctattcccagcagttctgccaatccagcacctgtcccacaaactgctactactgctgttccaactttgacccctgaaatggttcaacaaatgatcatttcagcattctctgctttggggttctcaggtaaatcctcttccccttggtactttgattctggggcttcccaccacatgaccaacaatgctagattccttactaatatcaaaaagtatttggggaatcttaagatacaaactgctgatggaaatcaattacctatcacaacaactggtgatatttcttcatctctaaccgatgtttttgttgctcctggtctcactagtaatcttgtctctattggtcaattagtcgacaataattgtcgagttcatttctcacagtctggttgtcttgtgcaggatcaacactcggggaagatcatcgcgaaggggcctaaagttggacgtctttttcctatccatttctcgttgtctccaagtctttctttgcctttagtctcttgtaattctgcttttgttgattaccatgtgtggcataggcgtcttgggcatcccaactcaaatgtactccatgacatgctcaaatctggttttctaggaaataaacacaccccatctcttaatgttattcattttgattgtattccttgtaagcttggcaaaagtaaaatcttaccttttccagcacatcagtcgaatgtaacccaaccttttcatatcatccatagtgatgtttgggggtggcaccagttatatctcatgctcgttataaatattttgtcacttttattgacgattatagtcgtttcacttgggtctattttctgcggtcaaaagatgaagttttttccactttcaaatttttttatgcttatgttcagacccaattctcatccaaaatccagattcttcgctctgataatgggggagaatacacctcacactcatttcaggagttcttgcaatccaatggcattatatctcaaaggtcatgcccctcaaccccacaacaaaatggggtagctgaacgaaaaaatcgccatttgctagatgttgttcgtaccctcttgctggaatctcatgtgccatcacgattttggtgtgaagccctttccactgcagttcatctcataaacagattaccatccccatcattaagtaatgaatcccctttcactcgcctatttggtcacccacctgattactccactcttcgtacctttggttgtgcatgttatgtccatcttcctccacaagaacgaacgaagctcactgcacaatctgttgaatgtgcttttcttggctattctcctcatcaaaagggctttctatgttatgatcctaaccttcgtcggattcgggtctctcgaaatgtaatttttcaagaaaatgtatatttttttgcaacacatcatggctctctctcttctccaatttctattctgccattgttctctaactcttctacaggacaaccatcatctagacctctcttgacctatacacgacgtagtactaccacccaaaatcaaccagcagaatctcatgggccctttcaagataattccttggctgctgatccagaacaagaaccagacccagaaccagcacctttacgacgtagttcccgcgctcgtaagcccccagaaaggtatatcagttccatgacagcaacattatcatctattcctattccttcttcttataaacaggccatggagaatgaaagttggcagaaagctattgaaagtgaacttctcgccttggaagaaaatcatacatgggatatagtgccatgtcccacatcgattaaacctttaggcaccaagtttgtgttctctataaagcttcgttcggatggatccatagatcgttacaaggcgcgactagttgtgcttggaaataagcaacaatatgggttagactatgacgagacttttgctccagttgccaagatgaccactgtgcgcactatccttgctcttgctgcatccaaatcttggccactacatcaaatggatgtcaaaaatgcattcctccatggtgatctcaaggaggaagtttacatcaaacttcctagtggtatgtcaacttcttctgctaatactgtttgcaaactaaaccgctctttatatggattgaagcaggccccaagagtatggtttgaaaagtttcgctccacactacttggtttttcattccatcaaagtcagtatgatccatcacttttcttccaaagaactcctaaaggcatcgtagtacttcttgtttatgtggatgacattgtagtgactcgttctgatcaagagtttatctctagcattaaaaaaatgttgcattcaacttttcacatgaaagagttaggccatctcacttatttcttgggtttagaggtgaattatcattctaaaggcatttttttaaatcagcagaagtatattcaagatttggtccagctagctggactcacaaatgctacccctgttgacactcccatggaagttaatgttaaatatagacgagatgaaggagaacttcttgacgatcccactcaatatcgaaagctagttggtagtctcatctatgtaactatcactcgcccagatatttcttttgctgtccatactgttagtaagttcatgcaatctccacgacacttccatttttcagcagtgcagcgcatcattaaatatctccttggcacctcaaggcgtggtttattttttcctgctaattcatctcttcacctccaagcatatagtgatgctgattgggctggctgtccagacacaagacgatctactactggctggtgtatgttcctagggaatgctcctatttcatggaaatgtaagaaacaagattcagtctcaaagtcatccactgaagcagaatatcgtgcaatgtctgcagcttgttctgaaataatatggctacgtggtcttcttagagagcttggattatctcaagcacaacccactccattgcatgctgacaacaccagtgcaatacagattgcagcaaatccagtttaccatgaacgaacgaaacacattgaggttgattgtcactctatccgagaagcatatgatcgcagggtcatcactctaccacatgtctcaacatctgttcaaatagctgacatttttactaaaacattgccacgccaatgtcacaattttctacttggcaaattgatgcttgtagattcaccagcatcaatttgaggggggatgtcaacagaattaatgccaaaagatatttgtaactgttattctcttaattaggagattattagcttatttagtgggctgaaaattagcttgacagattgtaattgcattagcttatttagtgggctgaaaatcagcttgacagattgtaatcagtttgtatttatatgagaattctccagcaggagagcacaggtttttgacccaatcttctctgagtttaacaacaggtggcaatttgggtttgcaagttgggcgtgtcaaggagtgggtaattccaactgagcacactaattattttaagacaatatataattgtccttcataaaatttggattatcatggctttcgatgctcatatatagttataacataatacagagttacgcagattcatgatacaaaattacaaatggtgcggctgacattgattagcgaagtgctaggtaacacaagtagggcctgtaatttttgtttcttctgtatatgactgagttcttataactccaaaattttgttttttcattattgagtgcagcggtgaagttgtgtttattcttcctccttatctgcgcatagcgtaaagtctctggacaatggatagatggttttttagtttttataattgagtgcaacactagggcatgccaatattcgtcgctggctttgcaaacctctcattggagattataggattttttgttcatgtttgttctaataagaacttctttgcattggaaaacaatggtcgcattgattggaattggaactcaccccaaaaacaataaatgcattgttagttgttatggctgggctacggtgcatgaaggtcatgggaagatgcactaagtagaaacggtcatagatagcactgttggcagatgaatgagagaaaaaagtaataatttatggaaagaaaagctgacaaattagagcagaaccaaggattacaaaagggtgcactaaactaaatttctacatgtcttttccaattaactcttaagtggatgctttattaggtgaaagtaccccttgctatgactcttccccaagtgtactaaactaaattatgtataaaaggttgtcttaaatttatacgtgtcatacttgtttgtgtttcaaaaagagaagataaagcttaatttgatattgtgtaagtagcaggcagagttgcacttgaattaggcaatcagggttgaaacatttcaatatttaaagacttgattggtacagtggtatatggaattagcagtatttgcaattctgtagtggctcaagactttgtaagacaggttgggtgttattgtgtcattgtcaaacgagatacactcctcaatgtgtgctgtggagtgagtatttgcactatatcgcaggggaggatggaatgcaggaaaattgattgaatgcctctcaaagaatttcagaaaataagatttcttacaaagtgcaggatttttgtaatgtagtttgatgcagggtgtattgttttgtttattttgtttattttttgcaaaggcaaacaaatgagtattataaaggtaccagaggtaccgaaagaaagtacaagacagaaacccctggttatgcactatttatcgcctatgtgcagcattatataaaactaaccagagatagtgagccatgcaaaaagaccaaatcatgtgctcgagaaggtacaaaaaagcaccgcaccaatgtgcagcatccccacatgatctaaagactataaaattatgtccccaacccaccttctaatctcccttttaaactgtctataacctacttatgtccccaaaggaaatgttagcctataaataggtaatggtaaaatgagtaaattaacgagggaatgagtcaatgttacgataattgaaatatatctttccagtaggcaatgaaagatctatagtaatatttatgctattatgatggagatgctgagttttgtgcatcaacaaatgctaatcttactcaatgaaggatgaagagatgacagagaatatgtatatataatatattcatcagctgccactgtttttgttgtcgaataagagcagccgagactgcataacactttggttgatcaaatatattaatattaatttctttttttgtttttcatttcaaacaatggtcatctatttgtcaagacaacatttttttttattcgaaattgcaatgcccagaaatacattcttttccaaaacgattatgactagtaccaataaaagccagtatactaattcaaaagtaaattatgattttgttttgtctttacaagaattatgaatacaaagactaagcgacataaaataagtaccataatctgaatcaatcatacacacgaattctgggtttttcataattgggacaacggctgatgtccaatatatcctcagagttacagactaaaattcctttgcaaactgtctttaattctggtaaatcgtacaattccaatttggttaacttgggaagtgcaatgttgtcggaactatctcctgcaaatatctccttcattgaatcacaacgacttacagatatagactccaggttttgaagttgtggcactaaccctgccgtcagcaacttctctattcgatggtattcctcgatactaatttccttgagatgagaaaacaccccccattgtgttaaaccagcaacatcttccttgtagatgacacttaaacttggcaagccaagaagatacaaatatttgaggttttggatattagtgcataaggaacaagatacacagaataaactctccaattttgtgcaatttcgaattttaatttcctttaaagatagagaaccattagatgacatagcagtacaaaagcattcccattgatgattgtcaagtacaaataatgtcaaaaggtctcttggcagttaatagggcaattcattgcagtctccaaacttgacatttctaggcttgaattcaacatcatccataagaccatcatccataaaaccatcatccataagaccctcgtgaaacatcagttcgctaaatattccaaaatagataatataggtttgaggtccatgaccactatcctggatttcttgcatataacggttatagttatcttgatcaagaaaacttcctgcaaaatattcaagcatagatcccttttacgtcttctaattttatatctgaccaaccgcggagatccagatattggatattagtcaaactgggcagtacgcatcctggtatcaatttcacctttgaattctcatcctggaacagatcaagccatttcaagtttattagattttgcaagccttccgtctcctagtggaggtatatattccaatttataacatttactgagcactaaagaagtaagagacctcaacttagacagggaatttggcaaagatgttaacccatgattttcagatagatcaagtagtgttagagcattcatgtgtgtgaaaaaacactctggaatatgactgatggaattatgagataagatgaaggtggacaagcgtggacaattaggtgatgtgccctcttcgatttcttttatcttgttacccgctaaagaaactccctccaaatcatctgtccattccctcgtgtgaggtatctttgtcaaattttcattacattttatcatgtaagtgtggctctcgttcaagatatggtacgccatgttcctcaccataccattcatttgtaaattcacatcattatccagcaacaaagaatggtttatgagtttatctactatgacacgtccctcatcgaatacttcttgcaaactcctatttccatttaacaacccactctcaacaagcatcataacccatagctttttgtcaatatgattaggaaacagtgcacactgtaagaaacattttttgatgtccttttcaattaaattgtcatagctacgttttagtacgcttaagatctcttttccgatttccaatttttcaagtttattcaatgcatgtctccaccaatggatgtcattttcccctttcatggtttgagccatcacactgattccaagtggtaaaccatcacatttcattacaacagatcttgcatactctagtacttcacaagaaagttctgcaggtgttccacggtgtccaagttttagcaaaaataactcacaagcttctttttcttctacacgagagagagggtgcattgttattgtattatcaaataggcaatccatctgtcgacacacatgtttcaaacgagttgtgatgatcaatttaatgtcattcactttaagaagaatccccaccttttgcagatcaatatattcccaaacatcatccaaaataagtaatgttttttctcttttctccaactccaatgtcaaaattgttgctcttgtcatctcatctccgtaaagcttaacctgtattgtttctgcaatgtgatgttgcaaattgaaaatggtgaaatcatgggaaacagtgatccagaagacatccttgaaagtcccttttcttttaatctcattcttgatatgaattgctaggaatatttttccaactccccccattccatgtatgccaataatgaaaactttctcatcctccaaaagatcccgcatcttgtacacatttgcacctgaccgcccccaaggcccctcttccaataaatcctcaaactcaaatttcaattcatcaagttcaggcaattcattagtcgagccagactcatgcagtgagtttttcgcatcaatagtcatttttttcaggtccttcagttcatccaaccaatcgtcaacttgtctattgcgtttttttccctggaactccagccactgtaattgtctatcagccttttcttcttcccttgttagataggataacaacatatttatagtcaaagcatcattaccattgctacctccgataacagcttctacatcacctgtttcatatacgaaaaatatatattggaatgtaataaatgtatttttttcatgtcacgctaacggcaagaaataaaaattgaacttagtttaatatttagaggaatgttaagcacaaatagctttattgtgtgaaataataaaattgattattgagaattaaaaacaaatctatatatgttgtatcacctaaataaaaaaataaaataaaaaagcgcatccgtgtgaagaaggaaaagaacatgatggaattggtgagggttggtgagtaagatttaagaacatattgaaatggcaactagaatgcgtacctcctgataaagctgacagttgtgcattgttttgagggttaactgaaccaccaacaatcatattgttttgagggttaactgaaaacaccaacaatcattttgttgtctcctacaacggcttcaatgcaacaagagatatggataaaacaaaatacagtcaccattttcaaacttcaacagaaaatcaataaaaaatatgtcaaatagtaacatactaatactattaatactaacttaatatcttaaagatgacagggtacttataataatgctaacaattaaggaaagtttcatatgacaaatctttctctctcgcacacacaactataaaattgaggaatttaaaataaaaatcaaactttttgtcacctaagaaataaaaaaacactagtgtacagagcagaaaatgaacaaaacgaattggtgagtaaccagattcataccttctaatagtttccgtatatgagatcgtttcagagaagcatctggtggagggaaccaacaactgaacatggttatcatggaaaggttaaagttgattggagcttgttccagaaaacgttccacatagtggagcaaaaagatgccacaatcgtatgcattttgttgctgaggcagctcaagtgacacgaatggaagacgtaaaaatttagaagaaacatcatccctcacattgttgtgcctctctttccatgcttcacatagataactttggaaaacattgcggttgcggagatcttcatgaattccttttcggtaatccatgtgcaagatgcaaggttctttgggagattccttaatttcttcatctctgtagcatgtcatcacttcagcaggatgacaaatgacaatcaaactccagtgaagactatggtttatgggaatgaagatataatccttttcaaaaaggttcacttttcttgtctaattgcttacacgctgaaatgctgctttagcatcacaagcaattgatggattatctttgcctaaatcaacaagcttaggaaagaaaaagcaattgaaaaagtgaaacctgtcctgtttatcagttgggagtttatttttcaaatacttgatataaaagtcaatgatattatcattaatgcatttctcaggctgtaaaagctcaatatctcttaaataacgacattaaaaaataaagcacgtgtgtaaagaatgagaagaaacacactggaatggtaactagaatgcgttcctcctaataaagctgttgattgtgtagtgtttgtagggttaactgaaccatcaacaatcacttcattgtcccctggaattctagtagtcagtagtattagtaactgacttcttatgctagcttattttgaaggttcttgtggggatcgttttgttgtaatcacatgatatccttcttattatatatattatctttttctgttaaaaagaaattattttattgtccttttcaatcacattaaagttaaagtatatgtatgaagagaaatcatatattacataaaaatgtaaaattaaacactatataaataagaagaatcataaatttaatctttaaggtttaaggtttttcaacattcaagacaagaagagatatagataaaaaaaaatcagtcaccatttataaacttcaacaaaatcaagaaagaaatgtaaaatatttaacatctaaatagaataaaaaatatcaaaatttatctttaaagtttaagaaagcattatataagagtaaaggtggcaactttcattgctatctcaaaaatgttaagcatgttacttaccttgtaattgattcaaggtatttactgcttcttgtggactgcttgaagcattgtgaggtccttgattggcacgatatttggggcattttctaatattgtttccatcgccgccagtgatatgctcttgaattcttgtagcacctccagcgaactcctcttcacaatggttgcacttccacttatcttttcctattttttcagcttcattccagtatttacttttcggccgaccccccctttttcttttactactacactctccatccattctttatttcctaaacactaaatcattttaatatgtgcctatctttaaacttgaaagtataggttaaaatgcactattcgtttttctattttttcgatacataattttgatatcctataaaaataaatgatatattaaaattgccaccagaaacttgtccaaaaaatcataaaatctcagtattctgttaaaatgacactacacgctccatccattcttcaattcctaaacacatctattatttaaacttgaaagtataggttaaaatgtaccactatttttttaaattcattattttggtatcctataaaaaaatatatgttaaaatagtcagcagaaacttatccaaaaaatactgcacaaaaccaaatcaaaaaatatttctgataaaaatttacccacctaaccatgttttggttgctttcaaagtttaatgcagagtcaaagcaaggaaatcaaatttcctgtaattaaaatcctaaatcgccttaagccttcaatcattaataataattaaagaaaaaagtggcagttgaatgtgtagctggcaggaagatatataagtgggtatattcatggaagggccaaagaaccaaaagggtgtttttttaaaaaatatttaccgatagagtgcgttttcgaaaatatatgcaaatctggtgcagggaggcctttaatttacaaatctggtgtgctgcaacatgcctggatcaggcatgttgcagcacaccagattctataaataaggccccccctcccatttcctgacttgcaccatctctctaaaactgctctgccttctctctatagttcttcggtggtcttttgtgcagcgaagctctgctgaagtgtcaagttgttcagataaaatcttgcgaacaagtaagcgtctggtctttatttgcctctgttataatttttgtagtcatgttgttatgatttacttatttatattgttagtgatgtacttgtgatttagcaaatgatgttaggttagcaaatgacaaaaaaattaggtagatacaaaattgtttaggtgtttgagactttagtgtttggataaaatgattagcattttgaatttagggtgaatgtgtggttattgtataaagggttaaataattaaggtttagggttcagtggggtaggtatgtgacgtctgggctagggttggggaagggtttggttgcatggtttaacatggaattttttttcgtgcatgaagttacagtaacatggctgattttgatggagctgattcaccccgctctgaatcggatcatgaggctaagccgattgatccgacatcttatgtcgtgcctaccccttacaactggggcgctttgcgtaggcgtgttcagcgcacgcacgtttcacaagttgtgtggaatgggggcgtggatcctcaggtattgaagactcgacgtggcaagctgtcggggggcccagcatatgacagcattcctgaggtcgttggtgatatgctgcgtgacgctggctttcttcatgtcgcacgtatgcgacatattcaggtatgcaacagttgatatcagtaatcaaatttgatctaacaataactatacttgtcaattgattaatgattttgttttagattgacggtggcctgattagtgctctggtcgagcgatggaggccagagacccatacattccacatgccacaaggtgagatgactatcaccttgcaaaatgtggttggaatcttgggattgcccacggttggcagagccgtcaccggattgactttgtccgactgggcgggggtgatcgaggacgttttcggtgaagcacctgatgaagacaccgagctgatcggtggatatctgcgactgacctacttcgataggcatttcggcgattggggtcagttggacaaggattttgttaatgtcacccggtttgcaaaggcacacatcgcccgccttcttggtgcatggctgctgtgcgatagatctggaggtagcgtgatcgcagcccgctattttccgttgttggctggggatttctcagagatcggagaatacagttgggcgtctgcggtccttgcacatttgtttagacagatgtgcgagtgtacagatccatcgaagaaggacatcggtggctgtcatatgctgctgcaggcgtgggcgtggttgagattcccaccaattgctccatctattccacagcgtacggacccacatgcacattttggacatcggtatgtgtgactgtatgtttaattcataacaattttaacatttaagcactacaatggttaacgttatttattttgtgtacaggtttaacacgctgcccaaacttacgacgcacgagttggtgtactataggacggccttcgaagacgtcgctcgagagaacgtatgtatgctgattgcttagtaattggaagttagtgtaacaccccgtgtatacccggtgtattatcattataataataataatacaccgggtatacacggggtgttacattttgtggtatcagagcggttttcttgatggaagcattatgtatggaaattgagtgttgcttttgactgttgtttgcatttggcatgactattgcatgtgtggacactagttgtgggcctgatcaactcactatttggtgtgcatgtgtagtgttatgacgaggtcgagaaacaacagtggggcaaccaatgcccaaccagatccagtagcggctgctttggcggccatgcagcaagagatggctgctaataggcagatgcaggaggcgatgcagcatcagatggctgctaaccatgaggtgaatgaggccttgttgaaggctaatcgggagatgatggatgagatgcggaccctgagagggggtaaccgggcatcttcagttcctcctactcatgagggtgatggtagccgtcaccaggctagtggtagccaaatcagaggagatcagatgtctcatgttgaggctgctaaggagctcgcagccagagggaagatgttagttgctttcaggaagcacgaccctccagttttccttggcggttatgaccctattgccgcagctagatggctgcaggatttggaccagatcttcactgtgatggagtgttcagatccccagaggttactttatgcgacctatatgttgaggggcgaggcccatcagtggtggatgaccacatctcagttgctgagagaccagggggatgtgatcacctggcggatgtttgaggcttgcttcctggaccagtactttcccagggatgctcgtgagcagaagcaagctgagtttgacgttcttgttcaggggagcatgactgtagatgagtacttggtcaagtttaatgagttggccaagtatgctcacttccggagatccttaccgatgctgacattctggctgctaagttccagagggggcttaggaagagcatcgaggagcgagttgtgggaagcggatctcgtgatatggctaccttggtgaggcagtgccgccaggtagaggacatgcttcgcagacatggaggcagtcaatcttttccctcagacagacaggaggggaagaagaccagcagtaccggcccacccgggaggggtaagggcaaggatgtgagagtctccacctcttctgggaggttcaagagggactttagccagagcggctcatctcggagaaggccagctccgaagtgttcagcctgtgggagggagcactggggaacgtgtccctcaggccagattgtatgctacagatgtggccagccaggccatatgtctcgggagtgcacacaggcaggaggccgtgcatcagtgactacagtggaaatgccagcacctaccgcgggtcgggtgtacacagttgatgccagagaggcggccaggactcctgacttgatcagaggtacagttctgatcaatgcttgtgatgtgagagtcttgtttgactctgaagctacacattccttcattcaggatgtgcttgctgataggcttgagttgcctaagtgttgcttgttctcttcgatggaggttaccaccgcatctagtgagagatgccgggtgagcacgtgttgcaaggacgtgcggttccagcttgatggcagagagtacacgattgatctgtactgcctggctatgcctaccctagagatcattctgggtatggattggttggccaagtatggcgtgatgctggattgttgtcagaagagggttgtggtgccttctgacagagctggttccagttccacctctttcctatcagtcttgcaagtgcgtaaggcactcagggaaggagctcagggctatatcttcacatgtgtggttgaagataagccaagtgttgatctgtcgcagatcccgatggttagtgagtttgcggacgttttccctgaggagatcactcagctaccacctgagagagagattgagttctccattgatctggttcctggtgtgggaccgatatctgtggcaccttaccgtatggctcctctggagttgagggagcttaaggtgcagttggaagacctgttgtctaagcaattcatcagaccgagtgtctcaccgtggggagcaccggtaatcttcgtgaagaagaaggatggtagtatgaggctctgtgttgattacagacagttgaataaggttactatcaagaataagtatcctttgcctcgtatagatgatctgctagaccagttgaagggagctacagtgttttctaagattgacctgaggtccagatatcaccagattcggataaagcctgctgacataccgaagacagccttccggtctaggtatggtcactttgagtaccaggtcatcccctttggtctgacgaatgcccctgcagtgttcatggattatatgaacagggtattcaggccttttctggattagtttgtggtggtgttcatcgatgacatcctaatctattcccggacggaaagggagcatgctgagcatctcaggatcgttcttcggaccttgaggaatgatcagttgtatgccaagttggccaagtgtgagttttggttatctgaggtgaagttccttggccatgtgatctcagcagctggggtatcagttgatcctagcaagatagaggcggtgatgtcttgggagagacccaaagatgtatctgaggttcggagtttccttgttttggctggatactaccggaggtttgttcaggggttctctcagatagtgatgcctttgactcgactcacccggaagggggttccgtttgtttggacccatgagtgcgagcagtgctttcaggagttgaaggaacggttgaccacagctccagtgttgacccttcctgaccctgaaggaagctttgaggtatactgtgatgcgtccaagcggggacttggatgtgtgctgatgcaggataagaaggctgttgcctatgcttcccggcaactgaagcctcatgaggaatcttatcctacccatgatttagagcttgcagccatggtgttcgctctaaagatttggaggcactacctgtatggtgctaagttggtggtgttcagtgaccataagagtctcaaatacctctttgatcagaaagagctgaatatgagacagaggcgatggatggagttcctcaaagactatgagtttgagttgagataccatctcggcaaggcaaatgttatggctgatgccttgagtaggaaacatgtgagtgcagcctgcatgatgatctctgattgcaagttggttgagcaattcagagacatgcacctgagtgtggctgtaggtgcccatggtcttgagctgagcaggaccaaggtgtctaatgacttgattcagaggatccgagagacacagaggcaagatgagactgtgagggccatgattggccaacaggatgtttcctgggaggattacgacttggtgatgtatcaggatcggattgtggtgcctaagggcgagttggtggacatcgtcctagctgaggctcacaagggccagtttagtatccatccgggtgccactaagatgtatcaagacttgaagaggaatttctggtggccagggatgaagagagacatagccgagtatgtggctaagtgtctcgtgtgtcagaaggtaaagattgagcatcaaagaccatctggtttgttacagcctttacaggtcccggaatggaagtgggatagcatttccatggactttgtagtggggttaccgagaactcagggtggatgtgattccatctgggtaattgtggataggctgaccaagtctgctcatttcttgcctgtgaagactgactacacggcggagaagttggcccagctatatgtcagggagatcgtgaggttgcatggtatccctgatagcatcgtcagtgatagagacccgaagttcacctctaggttctggggtgcgcttcaagaagcttttggtacccagctgaggctaagcacggcctatcatcctcagaccgatggtcagactgagaggaccatccagactctggaggatatgttgagagcatgtgccttggagcagggcactagctgggatcgatacttacctctggtggagttttcctacaataacagtttccatgcgagtttgggcatggccccgtatgaagccttgtatggccgacggtgtaggactccagtgtgttggaccgaggtaggtgagaagcagctccttggacctgagatggtccatgagactactgagcagatcaagatggtcagagataagttgcttaaggctcagagtcgtcagaagagctattatgatcaccgacacagacccctgcagtttgaagagggtgatcatgtgttcttgaggttgtctccgataacgggtgtaggaccggccttgggagtaaggaagctgagtcctaggttcattggtccttaccagatccttcagagggtaggaccagtgccttatagactagctttacctccccagttggcggggctgcatgatgtgttccatgtatctcagctgaggaggtatgtgtcagatccttcgcacgtagtagagcccgatgtggttcagattagagagaatctgacaagccctacaagaccctggaagatcttggatcggacggagaagcgcattcggagcaagaccatccccattgtcaaggttcagtgggaaggaaggacgcctgaagaagcgacttgggagcgggagcaggagcttcagcagctttatcctgagttgtttgacaggtatgttccttggttttgcggacaaaagtcctaaaaaggggggttgaatgtgatatccctaagtcccagcgcgtttggcgcgagtttgggcgcgtctggcacgaatttgaggccttttggagtggattatgcagaaaacactctgcagaattgtttctgcataatctggcgcggccagcgccaggtgtggcgctgatagcgccagggccaaaagtgtggcgctggtggcgccaggttggcgctcttggcgccgcagcctcgggaagctggcgctcttggcgccagaatggcgctggaggcgccatacagtgttgtgttttcccagccggcgctcttggcgccgcatgtggcgcggatagcgcgagaggttctggaacttggcgctcttggcgccggagttggcgctggtggcgctgtggtttctggaggttgacgctcttggcgccggagttggcgctggtggcgccattgtttctggaagtttggcgctctgagcgtgggagttggcgctcttggcgccagaggttctggaggtcggcgctcttggcgccggggtggcgctcttggcactgtggatctgcagctggcgcgatcagcgccagagtggcgcgatcggcgccgcagctcgggcagacccactatataaagcttatttcgcgattttggagccccaaccttctcttcttcttcctcagacctcccactccattgttgagtgcccaagcttggtttcttcaccatatctcaccaaaatccatccctaaagcttgttttgtgatggaaatcacctttaaagcttgaatccatcctccattcaccatcaaacccactccttgtgagaatccctttctcaagggaagttcgaagaactcgagctcggcgaggaacggcgacgattcgtgagtacccaagctaggggaagtcgtccttaggccttccttgcgtcaattgaggtaagaaactcgagaaacacctcttgatttgtgagttggagttttgggtgaatagtgacccacttttgatagagctagttttagccttgggtcatgttgaaacatgtgcttagaatgttgtgaggatgtaggattagctctcatatgtgagtttggtgaatgttgacttcatggctctatgtggtgcatgtgttgttgttgggctgagttgcttagccatttgtgaacatgctagagccttggcttgtggtttaaatggccttgagaggctattgggatgagccttgttgaaccataggatagatgaccttgtggttttggaaaggattgtgagtcctttcattgtgagcggttgtgaaccgtatatgcttgtatgccttgtgtggcttgtatgttgatacatatgttgtgtgtgccttgatagggcgtgacaccgagggtgtcagtggcgtgggccacagagcacagggagaactgcagagctcggctttgccaggtaagttctggacccttggggatgtttcctgtaatatcccttagtcccagcgcgtttggctcaaattaggacgcgtgtagcgcgagtttgaagccttttgggctggattatgcagaaaacactctgcagaattgcttctgcataatctggcgcggccagcgccaggtgtggcgcggatggcgccatggccaaaaggtgtggcgctgatggcgccaggttggcgcccttggcgccaaggtctctgccaattggcgctgtgggcgcgggagcggcgctccaggcgccatggtctctggtggttggcgctcggggcgccaggtcggcgccggtggcgccagaaccaccctgtatttcccagttggcgcggttggcgacgtatgtggcgcggttggcgcggggctctctggatgtggacgcccagggcgtgggatctggtgctggtggcgccagagtccctggagattgacgctcttggcgccggaggtggcgctctgggcgccagaggttctggaggccggcgctccgggcgcggggatggcgctggaggcgccgtggtcatcagcagctggcgcgatcagcgccagagtggcgcgatcagcgcggcagctctgactggaccactatataaagtgggtttcgcgatttttgagtcccaaacccctttctcttcttcctccagcccctttcctccattgttggacctccaagcttcctttcttcaccattcctcacccaaatccatcccttttgcttgtgttgtgatggaaacacatttggagcttgaatccttcctctctttcacctcaaacccactcattttgaggatccctttctcaagggaagttcgtagaactcgagctcggcgaggaacggcgacgattcgtgagtacccaagctaggggaagtcgtccttgagtcttccttgcgtcatttgaggtaagaaacttgagatttacctcttgattcatgagttggggttttgggtgaatagtgacccacttttgatagagcttgaattagctttgggtccagttgaaacatgtgtttggtatgttgagaggatgtaggattagctcttagaagtggatttggtgaatgatgtttccatggctcttgttgatgcatgtgttgttgttgggctgagttgcttagccattgttgaacatgctagagctttggcttgtgattgtgatggccttgagaggctattgtgatgatggcttgtgaatgccaaaccttgttgaaccataggttagatgacttgtggtcttgagaaaggattgtgagtcctttcgtgcttgagcggttgtgaaccgtgatgcttgtgccttgtatggcttttgtgattgatacatgttgttgtatgtgccttggatagggcgtgacaccgcgggtgtcggtggcgtgggccacagagcacggggagaactgcagagctcggctttgccaggtaagttctggacccttggggatgtttcccacttgcttgtgctctaccatactccgtgggagtagtggtttcattcatgactcatgcattgtgtggatgttgcatgctcatacatgtatatatgtgcttgtagctgtgcttgatattgtattaagcctgttgatagatcttctggccagtaagatagatatggataggagggaagcgcacctcctagtttggctggctctggttgactcggtcccgggatgcggagattccctgaggccaagagcatgtggtcccgtcgcggtgcagcctagtctcggaggtaccatatacgtgcatccatgcgaaggggtagcacccgatgggatggcacgggtgtgaattcggtttcacactgaggtcggcgttgacacggtccgccgtacatagagcaccgggttggcgtgcattgtatgtgtatgagaggccgggatggcccagtgttgtgatgccatgatgttgcgtcatgatgagtgagccagggtggaggagatgcctccaaggaccctgagcttactgagatgtttatctcaccccgtgtggggcttgtgttttcaggtgatgcttctggcagaggggagcagtctcagggcgggaggccccaatagagacggtaccagcttggccttgggcagctgtggatcgcttggagctcggctcagcggttgtggtgttttgtatgcttggagctcggctcagcatcttgttttgtttatgttgtatacccctgtgagggaagacatgtgttgtacatgtgttttgagttgtatatgctcagtttatgtatgccctcgtgtgaggaaggatccgtgggatcagttagcacttggatgctattctttgtatgcacctcgggtgccggcttttgtgtaactcggttatatatatatgatgtgttttcctcctgtttatatctttgagatatctgtgttatctgcctatggttggtttgtatgatctggttaagcaggggcatgtgttgatgcttgttgtgggttgtgattccatacatattgctatcgagaaaatatggttttcggttttatgcttccgcaataaacttgttttaaaaaggttttaattaattgtgattaagcgctaatctgatgattatacaatgataatacaccgggtatacacggggtgttacagatttaacctttatgtatgaatctactataaaaaaatgtcttcctgaatggaatagggccacaactttaatgaaaaaagtgagatttcatgcatggaataacttcgtgagtatcacaaagttattaattacatggatcaaaattggatgaatgcaagtcacatgagccaagcgtataaggaaggcgttgagtagttcttcgaatttgcctccaaaagaagtcgactggatgatgatggaaaatgtttttattcttgtataaaatgtttgaatgggagacgaaaagtactagacgacatacgagaacatcttctgtgtgatgagattaagaagaactatgcgacatggatatgacatggtgaattgacaaacatgcagagcgggtgccaaactgaaccagttgatgtagaaatgggagatcgattagagtatatgttttgtgatcttggacaagatttttgtcagcaagcacatgcctttatgtatgacatattggaaagtgattcgaagaagcctttgtatctggggtgcaagaagtctttaacgctattgccggtggtgttaagtctagttaaagtcaaggcaaaatatgggtggagtgacaaaagattcacttcactgcttaaggaagtgcaggatatgcttcaagaggaaaacacgttgcaaaaaagttactatcaggcgaagaagatcccttgtccgatgggtatggagtattagaaaactcacgcatgccctaatgattacacattgtacagacatttaaagaaaggcatctataccccaggtgtggggtatcacggtacaaaatgaaggatgatgacgattgtagcaatgaaagcacaaagaaaggccccctagtgaaggtgttatcgtatcttctaatcatttcaaggtttaagcgtctgtttgctaatggagataaggcaaaagaccttacaggacatgcaaataggagaaactgtgatggaatgatccaccatccgaccgatgcctcctagtggaagaaggttaatcgtttgtatctgaattttggcaaagaggcaagaaatcttaggcttggacttgccaccgatggaatgaatccctatggcagtttaagcactcagcacagttcgtgcctgttttgctagtaatttacaacttgacgactccttagttatgcatgaagtgaaaatacatcaagttgtttatagtgatatttgtcgggcccaagacaacaaggaaatgacatcgatgtttatcttagtctcttgattgaagacttgacagagttgtgggatgagggggttgtcgtgtttgatgggtatgaaaatgagacattctagttgtgtgcaatactattttgtaccattaatgactttctagcatacaagaatttgagtggatacagtgttaagggccatcgtgcatactctatctatgaagaagacacaagctatgtacaactaaaacatgaaagaaaaatagtatacacttggcatcgatgttttctgaaaccttatcacccttactagagattgaaaaaagcttttaatggaagtcaagagcatcaaagtgcgttgatacttttaactggtcaacaggttctttagcgggttgaggatatcaatactatatttggaatgacccaaaagaagctaacaagtaaaacttgcatatggaagaagaggtcgatattgtttgatcttccatactgtttcgatccagatgttagacactatattgatattatgcatgtggagaaaaatgcgtgtgattgtgtcatcggcatgcttcttaacatccaaggcaagaaaaatgatggtttgaatactcgccaagatctagctgagatgggtatacgtgaccagttacattcaaggtctgatggtaacaaaatatactagcctccagcatgtcatactttgtcaagaaagaagaagacaagtttctatcagtgtctgcgtcgtgtcaatgtgtcacaaggatactctttaaatattaagatccttgtgaaactgaaagatcttaaattagtttgcttaaagtctcatgatttccacgtctttatgcaacaactgttagccgtggcaattcgagatatttttcctaacaaattgaggcatgccagtaactcacctgtgctttttcttcaatgccatttgtagcaaagtcatggaccctgtaaagtttgatgacttggaaaatgaggctgctattatcttgtgtcagttggagatgtattttcctccttcattttttgatatcatggttcacttaattgttcatctggtgaggaaaattaaattgtgtggtcctatttatttacagtgaatgtacccaactgagcgttacataaagatcttaaaagggtatacaaagaatctacattgtcctgaaacatccattgttgaaaggaacattgcagaagaagctattgaattttgttaagagtacattgaaaagacaaaaactattgggcttcctgagtctcggcacgacgagagagtgggaggtaagggttcacgaggctacatattataactttgggtctaaaggtattgcaacaagctcatttgtatatactgaataacagtaatgaagtttttccatacatactttgtcacaaagtcttaatcaaggaaagtaacccaaaaatgaccaagaagagggtgttgaaagagcataagaagagtttcctaaattggtttaaaggtccaatctttggtggcgataatgcttttgaaatgttaaggaagttagcagatgggcctaaaagaaatgttagaagttgagagagatacgatatcaacaagtatttgttctacaccaaatcacaagacgataagagtacaatgcaaaaatatggggttagtcttagggttgaatcccaacactttgctactatacatgatgccaatccctgtttggagtccatgccttactttggagtcattgatgaaatctgggagcttaattatgttaaattcattgtgtgtgttttcaagtgtaagtgggttgatagcaatatcggtgtaaaaattggtgattcaggatttactttggtagatcttaagaaggtagcttatcagaatgagcctttcattatggcagaacaagctaaacatgtgttttatgttcaagatccttgtgatgaacagtggtcagtgactctacatggaaaaaccattggtcctaatcttgaagatgaggattcaacccttgatacttgtctcactcttttctccacacaaattcctacgtcaatagaaaagaagaagttgacgacatccacgcaagtcataatgatcatgatgaaggagaactaattaacatcgtataatgtaatctttttttatatttacttgtctccatatttacaattacataacttactatacttttgagttaactttaattaatcttgttttttacaagcacatgactacaccatcgagctcccctcctcctcctaagtcagcacctttgccatctgcaccgaagaagactagaaaagcaacacggcttagatcattggcatggagagaccagtggttcatgtggatactgccactaggaaatcttacggtccccacaaaaagaaattaaggacgtatttggggattgtcgcttgagacaaggaggatgttgcatttgttaactggaaaaaaaatttctacagctcagaaggatttgatttgggaggacattaaggtatttgaattaaatgttgaatgttattgtaattggttgtactgcaaatgttaaaatgttgaatgttattgactaactattaaatgtattttttgtatcgcagactgaatatgatattccataagcatccgaccaaagacgaagaagaaaatccttaagacggtaggagagcgatgaaggcaatttaagtcagatttgacctccaaatagactctggcacaaggcaaggaggaggactatgacattgttcatgaaaagtacggtatcaacaaagaaaagtggaaccaattttgtcatagtcgtagagacctttcatgggaggttagttgacatacattctttatgaatttgacaattatgcattattttcaagcgcattttgttaacaagtttctgtctagttatgacaggatgttaggaagaaggctcgggtcatctagaagctaaacacttcccctcatgtgttgtctcgcgggggttatgattcattatttactagaagaaaaacaaatgaaacaattggggcaagcagcccattccgggagcatagaaacaatcgttgatcctccatatcttattagacgatatgtgaagtaaaagatggctcgcaccaaaaattatggagagatgacatctgaggtggcacaagaaattgcagataggattctaagttattttttatttcaatcgttaatttttataataacaatagtaggttgtaaactcatgcagtattttgttgattgcagttttcccttgaggagcagtcagcacatggcagctttgtcacccatggacgtcaggatgtactgactgctttcattgggcgaccagagcactctagtcgtgtccgtgttgctggagctagtgtgatgatcagacaatactttggatcagcttcagcaagctccaacacgtctatgtcgatcaacacagaagagttgcatcgattaacaaaaaatattacggagcaactaacacacaaaatcagggcgagttggagcagtcgatcattgaaaaattgctcaacaactaattttgtccttcagccaaatgcagtcccaaatgcaatcctagggactcgtaccacctcctcagcctgaggttgatccttttgctgctcgtgtcaacacaaagggaagttgtgtcgatccctcggggcaggacccagacacaggtgcatcagacaggcatgggttgtatgttgatgacaatcctcccctcctagttgccttttgaagagtttatgaggggttgacaattgtccacaattgtgatgaccctaagatctggagcgagtggcgcgaggatccgcgcggttagcgccagatccttttagaagaaaaccctgctgagggtgtggcgcggttagcgccagggctggcgctggtagcgccagactctctggaagtggggctgatggcgccaggttggcgctggtagcgccagggtctcttgaagtccacgccaggagcgccagagttggcgctaggggcgccaactgggttagtgtggcgcggatcgcgccacaggttcggcctgtccacgctgttggcgtggaagtgacgctgatggcgccacagtttgtgcagcccgcgcggatagcgtggcacatgacgcggatcacgcgggaacgtcggttcagacttatttaaacggaaagtcgcattttgaggagaagaaaaatggttttcttcttcctcagagctccagcagccatgggagagcttcccaagctcccatgaccttgccttttgaccctaaatgcttccttaacccttttcacccctgagaaaccgagtgagagcgagaatccttcctccatatcctctaaaatctcagaaaagccccttgctcagaaggaggaggtagagctcgagttcggcgaggaacggcggtgtttcagctgcaccagggccagggagagcagcccagaggccttcctcttcagttctgaggtaagaaactcgagttcctccgattgattttggatttgggggtttcctgtgaatagtgacccatctaagatagagctagaattagctctgggtccagttgagagatgtgtttagaatgatgagaggaggaaggattagctttcagcttgtgatttggtgactgttggttttggctctaggctgtgcatgtgtgacttggactgagttacttgacttgagacatgcaagagccaaaatgacgggcttgaggtgcctgagtggccatggagacggtgtcttgtgatgtagatcgtccaagccctgagaaaccctgagtgtttggttgatgagagctgagatgctcaatgtgaatggctgaggctgagtctgtggagactctgaggccatggttgatctgaggtagaccactgagggtctatgaaaggcttgtagaggatgagcctgatgaaccctaggcagatgacctgggttgatggaaaggactgtggttcctttccctggggcagttgtggactgcctaatgagcttgttcatgtttacctgctggaatggtatgtgatttatatgtttgtatgccttggtagggcttgacactgtgggtgtcagaggagcagaccatcagacgaggctagagctgtgaggcacggcttgccaggtaagctcatcgttctggggtttttcccttattttggttgaccacccaagtggggtgaagtttgcatgctatgtttgatatatatatatatatatatatatatgtgtgtgtgtgtgtgtgtgtgtgtgtgtgtgtgtgtgtgtgtgtgcgttggaagcttgaggggctgagaacggttcttggagtggaactcaggccgttctggaagatggaatatgcgatgaaccctaggatagacactgagacagtgtgaggtgttcagtgattctgatgaggtgcagaccatgaggtggtctgtgatggaacctataggataccggactggtatcgggctagctgagattccctagctagaggaagagtttgaggactccctggaatagctgagattccttgggaggtgccactgctctccgcctagagtcctaaggatggattgccctgtctggaggttcctccttaggcagagatgatggaagtcctgagtggttatcctcaggccaggttatgtggaagtcctgggagatggagtgccccggagtggggtgatctctctcaggcagcagactggaagccccgagggattgagtgcctccgttgtgagatgatctctctcgggcatgcgacttggaagtcctgagagattgagtgcctccggtgtgagatgatctctctcaggcagctgatgggaagtcctgggggattgagtgcctcctgtgtgagatgatctctcccaggcagtggaaagtcctgagatattgagtgcctccggtgtgagatgatctctctcaggcatgtgatgtgaagccttgaggggttgagtgcctccggtgtgagatgatccctctcaggcattggactggaaagtcctgagagattgagtgcctcctgtgtgagatgatctctctcaggcatgtggtttgaagtcctgagggatggagtgcccccggtgtgggatgatctctctcaggcatgtgctgaggaagtcctggaggtgattgccctatatggatgttcttgcccaagcatgtgatatgaaagtcctggagaggccaggcagttgacagatatgttgtatctctaagagagggcttcccgggggggatgagagcctaaggcctcttagatgagccatatctggattctggaagtcctgagtagatgactcaggcaatgatttgttcagtggatgaggcgatgcctctttgatatagaaagtgtccaatggttgacacttaggtattgtacctctgtgagacgagtctgagatggcttgagagccaggatgaggtgggagacctctgatgctgatagcatccagtgactacccagatagctgggaatgtatgatggccaggatgatgtcctaggcttagttatgttttgtttatctgtctatgcttgggggtgaaccagggtaagggaggatctcccaggaccctgagcttactgagatgtatatctcacccctgttgtgggttgtggttttcaggtgcttctagaggagaggagcaaccacagggcaggaggccctggtggagcatgctggagtggtcatgagctgcagatgaagattagaagaatctttattttgatctctgtcttgtactctgtataaagttagggtgtgagtgtacacccgctgtactgtacatataatgatgtatgaccagatgtggtcttatttttgagcatgtatatgtacagatgatgatgtggttatatttgagattatgtttcctcctgatatctcttgttagttttctatgtttgtatctgcctatatttgtgtgtttctgtttaactggatcgacaggggcttatgtatgttttatatggtgtgtttttacattccatgcataatgtaatcaagaaaaacgattctatcgcttccgcaccgcgtttagttaacgctgatagcgctctatgatattattaatgataacacgtccggggtgttacaacaatgtccctttgggcaatgatcaagtgaaggtcggtgttgaggaagtccgagatgctgatgctcgggtccctatacccactcaagaggttcacttagtggggcaggccattaacaccatccttgcttgaccgacacatcttgtacaaccttttttagaacatgtatttccttttgttgtgttttttattttaaaaagaatttgttacagataaagtattgactgtcattgaattatgtttattaactgtgtaggataaacagggacctgagggaccttcaaaacctgtagataggtcggaacctgatgacgatcccctatactagatgacattgacgatcccacaacttttcctcaagcctatgcaggtgttgtgggattcaactatgtttgggatttataatgatgacgtccccttgtacataaaacatgaagatcttcttgaaatagcacacgtggtcaatgtctcaacatccctgttatacaaatgtgaattttgtaagtcactttacattatagtccattacataactgattgttttaaattgatgcaaaatttactttattttaatagtaataggcatatgaatgagttaagtctgcgatcaaggaatgcctctgtgtatggattccttgagccctagtccatatagagatctggacaatcacaatttgaatgtggggattatattaaaaaatggatgcagaattcatagatatatgtctacctaggagcttacttgaatgggtaagtaaaattgaactaaacaatttaaataatgtatgcactataataacttaatgttctccaatgcagtgcacattggaaactggtcattatatgtcctaaggacaatgttgtcatttggttatgttccttgcacaataagcccgacaactacttggaaggaattattaacaagtcaattgtattttgtaatacatttactttatcattagtatttgacatcaatgttttctcttaaccaatgctttgaagggattcaacgatagtcaaggaagtaaatccaaggctactgctgaatggattccagttactgtaagtaatttaaacaatgcttaatgtcttaaaaattacattttattactatatacactaattttcagttaactttgaatatcttattgaatttagtgtaataagcaaagaggaagcactgagtgcgactattatgtgatgcattggatgtcaatgatagtcctaggaaatttcaaggataattgggaaatgataattgtttactttaaaactatttcatttgttatacttgttaatatttacactgattaagttatgtttattatatcatgcagtatttgactaatccaagacatttggaactagagaaaataaaggcaatttgcattcagtggacaaaatgttatcttggagttaaaaatgaaaaactatgtgtttaagcaattttacaattgtagagttatgtttaattacattcggttatagatgttttacaattgtattcaataacaatataaagattttttttgtgaaactgcttggattgatctcttttttaatttgcaggtttgggtaatattaaaaaaacaagcaggatattaaaaaaatagcaaaaaataacatcgattttctaaacaccaatattatggtgcactcacaacatcactttttaggaaaaccgatgttttgctgcacctgacaacatcgatttttaggaacaccgatgttgtggtgcatacgacaacattgattttcctaaaaatcgatgttgtaaagtgcaacacaacattgattttcctaaaaaccgatgttgtgagtgtaccacaacatcagttttcctaaaaatcgatgttttgagtacacttgacaacatcgattttcctaagaatcaatgttggttttgttggattttaaggaagctgcaagaagaattgaagcaaggatagcttgaagttttagctttttacatgcccaatcattgatgacatttgtaattgtctaagtggctcaagttatttccttatgatccttcatgcatttgcattatcattctcatacatatatatctctgattataaaactaaaatggttaaatggtttttcaaaactcaagttctcatggttgaagtttttgaaatctgaaaaactcactgttttaatcgattacctgtttatgtaattcattacatgtgtttgttttaaatatggaaaagccatgaagaacagattaatcgattaccatttgttgtaatcgattacatagtgttaaataaaaaccacgcattgctgctttaatcgattaccatttattgtaataaattaccatttgcattatcatttattgtgctactttaatcgattaccataactcgtaatcgattacataagtcttttgaacattcatgtcttgctgctttaatcgattacgtgacgatataatcgattattatgttcataaatacttttccagaaagcttaagaacagtttaatctattaaatgatgtattaatctattacatttgatgaattaatcgattacagtctgttaaatcagtttttctataaatagcttgtgggtctgttgattgaaatatcccagaaatcattttctacgaaatacccatttactcacaaagctttagattctctgaaagaactcattttgagtgaaaaacatcttcattcaaacacaaaagtctctattgattggtgatgaatacctaagcaagatttacaaacaaaggttttcaagaaagcattttctactgttatgcattcaatctctgcttgattgtctgtgttcatctcattcatttgcaaaggatcatgaggtgatatctttcttgaaccttggactgtgttagttctattgtttgtttaagattttgagttgatttctcaaaacaaatagtttctttaaagttgattctggagaagggttctttagatggtagaactgagtagtgttttcagattctagatcttagaaatctataaggtttagattttgtatctttgtctagagttgacaaggaagatctgttgtaaaagcttgtaaagaacaataattgtttagtgaaatctctaaccaagagttggttggaagtaactggatgtagcctcaaaggttgtgaggtgaaccagtataaattgttggattctttattctaattttgttcatttctcattgtttgaatttgggtgatcaagaaattatcaacaaggtttattttctggcattacttgaatctcaagagtgattttggttggaagaaagattttgttttaaaagattttaagtgatacgatccttcttacaaattccataaattgtttttaagaaaattttaagtttctgaataaaccaattcaccccctcttggtttatttgattagcgttcattgtattttcaggtttttgcatattttactttttttttggtttattgcttactatacgacatcggttttcttaaaaaccgatgttatatagtgtatgttaacatcagttttgcataatcgatgttaacattgatacttttaatgtcggtgatttcaacatcgatttttaactgtgttgaaagttaaaaaaaagaatgatgttaaaagcccattttctagcagtgaagataaatatgaactttttaccatgtgagctcatatgtagtaagttatttcacttacgaataaataattagtctatcaataatttatatcattattattatcaaaactttaggcaataatggatcgtctagttataacatattggatcaacttagcaacaacaataatcaaattaaagagaatgagagaaagcttcaatatagcatatattattatgtttaaattaaacacatgcatggtgctaatgcaccatgggcacatgcaactgaaactggccatgttataaaacatacaatatagttgctagatccaactattttgacatatatgaagtgttattataaaatcaaggtactaagcatgagctataatagctattttgggatagaacaaacatttctacttaggaacaaagacaacatgatcctgaggtaggaagtggcagacaggaacaattcctggttgaaccttaagcacttgaaacgccaaatgcttgggattccactttgatgtgtcattgtggcacactgcaactgctttaactctgcttccattagcaccctctaatgggacaaaataggcttttgtggtttctgatttgtggcaataaaacactgcataagggtaattctccttgtgacaaacaacaatagccttgtcctcacccaacctcttaacccctggtgccattgtgtattgttgcaattgcaactcactctctttctctgtcacttctgtggaaacaacatcaacattgttgcttcctagcttggaagtggcgaaatcaaccatggactcaagtgaagtcacacaacgcttttcctctcccttaatgctaggcacttcacactcagtgatggtgttcttcacagtttgagcctcatctgacccttccttgatggagaacttggttaacacttcattcacctattaaaataattgttgtgaattaatatcaataaataattatatattatttttagtatcatcaattaacaattcaagatatgataactagattacaaatacttaaatgaaattatgataagattgaccatatgatggatttgaccaattattagtaaatagtccattgagaggtctctatccaccgttaggaaattgtaaatttattatttcataaattaagaaaatttacatattcacatgctcttaagcaattccttagaatgagcataaagctctcaaagaggaattgatgatttttcctaccaagctactctcatgaatatgagtgcaaattcaagttagtgtttgatagccttttaggtattatggttatactcacctgctataatcttgtatttatgtacattgttatattatttttgtcttaaatatatttttagtccctcaaatttaagggtttatttttttaatctctcaaattaaaatttatatttttaattccttaaatttgaaaaaaaaaaaagaattttagtctttcttacgatcaaaaatcggtcaagattaattaaaaaatacattttgcaaattaattgaactaaaaatatatattttaattcagaaagctaaaatataaagacgaatacaaaatttgaaagaacacaaaacaaatttaatctattaattttttccatcatcaccttgtttgatgaaaagggtatggaatcagcaactgatcgaggcaagaacaaggcatcaatacgtgaggtgaagtagcgagtgaaatgaaggttcaactttgttccgtggtgcaagtccttttccaagaagaagagtgccacgttggggtcatcgtgcaactgggtctcgctggctgcgtaattgtaaagaaatggagaatgtgggcccactccaacgtgcactggcttacccttctttggtcctgtgtttacgttcactccaccattgcctacgttcactgatgtgcccttgttgggctttcctttccctgtgttcacgttcactcctccttttcctacgttcactgatgtgcctcctggctttgttttccctgcgttaacgtttacgcccccctttcctacggccacagaggtgcttttgtcttctgccaaatctgcatatattcagattgttaatgccagaatttgattgtgcagttcctaaagagtagtggtattcttggagatataaaattaatttggtggtcggaataaatgacttggggttaagagagaatagaagaagggagtagtctgggttcgaatgacatttttaacaaaagttaataaattaatatttgtctatatctatttctattctttgtctctacttttattatttttccatgaaatgtcaactttaagcaattaataaagcacttgcgtttgctgatcactgataattgttaattaaaatatcaggtgtttagattttcctttgtctaagatcatgtgcaaggttttttctatcattatcaggtgtttagattttcttttgtttaagatcacgcgcgtgcaaggttttcctttttccttaggagatgaaaaatttactaacatattatctaacactcttttctaatatattttattctattaatttaaatttagaatcagatctactagtactgatgaagaaataaaactcatatattcaatagattcacataaatttcatttaataagagaataatgagaaagagcattaaaaatgtgttactgtaacaaacgagtcagtgtttgaaaacaattgctttagtcacaaagttattccaaatagtactatttttttttttttttttttactgatgatgttaggactcagaatgtgtaacgtatgaaaatggtatgaaattcaaaaacaatttgaactttctaattaaaaactatctactaaatgaactgaccagggtgaaggatatctgtaatggctttcggcattggagcggtgggaagcttcgacttccagtaaacttcaggggacaaggttgctgcatgggttgccaccactgcaagctgcaaattaaatacaaaaccttcattagcataaaggccatataaacattactattatctaatatggaaacatgtctgaaataattagtatcccatgatatatcaaagctttaggggttcatgaatattgaataaaaaggaaccaaaacttgaagacaagtggggaaaataataaaacacgtgctaattcaatattatagtttggaaagtgaagctcacattgagtaaagcaaagatagataggagaggcaacaccatattggaaattaaccaaaggtgcaaccaaaagtgcttggtgaagtagagagaaaatttagagaagctaaaaaaagtgaggcttgagataggaatgaggatccttgtgtgcctcacacagcatttatatagctgagatataatcacgcgaatccaaaattcaggttaagggtatgggtcacaaataattacacttcaacattcataattgtatatcttttatatattaaagacatctccaatcagtttttatttttagaaattaatttcatttgagatagataaaccaccaaaatgaatacaacttctctcttgatataattaagaaactcaattgtgtaggactttattgatacacgtagttatgataacaaattatataactacctaaagttttaaaggaaaattaaatgtgtatataacttcttttaaaatctgtccttggatataaatatataatgttaaaaaatataattttaaactcccttataacagttttaatttctactaatgttttcttaaacacttattaagaaaaaaatattacatgtttctaattttttaaaatatttcatatatttatttatatgtaatattttttattaacattataaacttactataaaaaaatattctggaaagaatggattccagataaggtcggttgaatgttcaaatagcatccgatcgatcgactaccaaatttgtcatacatttttaataacttcaactgtcgctgcttcgacgactttaatttgtcataaattcttttgaacagatggacaatgagggtaaatttatatttctttcaatatagatgtattattaataatttcttttaacttaatcgacaatattttattgatattatatttacattaatattatttattttaaataaatgcattaaatatatgaatttaatcagatgaaagtagaaggttttttttcttacaatgtcatcttattataaattttcgtgtaaagtatatttattgagttttataataattctctcaaaaatatatatttttttagttgataatgtaattttttttattgatagtagataaaaattaaactcttaaaatatattttaattttagttatatatattttaataaatatgatttatatagtactaccctcaaactttttaaagcatgtctcagtttttgctgtattgatttaacaggataattcgatgcatcaaataacaaacaactactcaaaatttattaggggcagaacgatagttgttagtcattttcaaaggtaaacaagcaggccattaaagagtttagacttttttttttttttaatgtatactcaatgtaactttttataggaagtaattttgttcaactccaataaatcactatgggaggaaaaatttaaacgtattcatctaaacgtggaaaatatacaagattaatattaattattaatctaaagtataatttttttatattagtatctcaatatattattattagtattatttatcaaatattaatatgtttcgataaaaatttacaaattatttttattctgttatcatctagtaatagtaatgatatctatttgattataaatgtaaatattatattaaaagtccaacattatgtaattaatcttctagatataaaaataactgaaatgagatttgcttctttcaataaattttttttctctatgcactgtcagaaaattgacccaacatatttaaataactcaaatatctattaagtatgttgacgctcgttggaaataataaataaatttcaaaaaaaaaaaatccttaaactaattttaatttaatcagaaacttttaaaatgagtttaatttgaaactaaaaattagaaaaaatataaattttaaaaattgaaaacagcttattgtttttaaaaagtttaaaacttacaagtaattaaaaatctccccaaatgtttagttattcattaattgttttctagaatcagtacatatgcatgcatttcattcagagtcacgcaacgctccttgttcttcttacatacacgcactgaataattttatttttaataataggaagcgagaattttattcagaagaaaaggaatcagatacaaatctttggcaatatgaatgcccagttgggatggagattcatccaagcagcacatatcctgaaaatcaaaggctaaacccgctgtctaaggcccgtctggatatggtttctcgtttttagttttcaaagttttaaaaattaaaatcaattttagttttgagttttgaatttcagtttattctttatttttagtttttgaaaggatgttataaattgaagataaataaaatgagtcaatcattttatcttatctaaatgtattatcaaataatggcgggggctgaatagcggattggaagtggcaacaatgacgttggtggcgatagtggtagtgggagtaaactagtggcggtcacaatggtgacaacggtggtagtggtgataacaatggtggaatggcggtgctagcgacgacgataatgataggatggaatagtgttagcgacaacgataatggcgattaaaggcaacagaatgatggagtcgacaatggtagggtggtggtggaatggtggaggcaacaatgtggtggtggtggtggtagtagaggtggcaacaacggtgtggtgacggtggtggcaatgacaatggtgggggtggcagtggtggtggaatggtggttagaatgcgtttttaaaactaaaaatcatattcacaaaacttttttttttagttttgaaaatgaatgtaaaatattttgaaatttgatttaaaaacaaatttagcttcattcactactaaagaaaatgaattttacgatgccaaaacgacgtcgatttgcaaaacctgtcttaaataggaggaatgcaaaccataatggttttacaaaaaaatgtcgtggaatgctacgttcaacaacagttatgtagataatcgtcgttgaacgcaacattccatgacgtttttttgtaaaatcgtcatggtttgcattctttctaatttacaaaatttccaagtacacattcaatccctcactcactcacactgacccgcgtgcccttcctccctcacttagctggtgccctcactccctccctcactcaatggtcgttgaaggggtctcctgcaccgcactgccatcatgtgccaccattgtcatggaggtaagaactaaccctctattttgttagttctatttcataacaactgaatgaaaatgagtctgaatttggggttctgagtcttaggaatggttagagttaggacccaacccttctactctaccttagtgtcatcagctttagcatcatcaggcaaaagcaagcttttctgattcacctcttaaacctcctaaatttcatgttttcttgcacgtttgttgtttatacttaagggtggcttgttagttacgtaagatagatgccaggcatttccatcactctctatctctgtttttcttggtgggtactatcttctttattatctttgatgcctttactttattcctcaatgcgtagtttacttcacttcagttttgctcacattagccttggttcattaattttgatgaaaaatatcagggatcacctattaacatcccaaaatttcagaactacagttaaatattaaagcaagtcttaggccaattgatagtttatatttgagttatttgggtgaaatgtttaagggaaaagaccatattaccctttccttaaactagaaatgacagaaatgcccttgaggtcaaaatgataaaaatacccctggatattttaaaaattaccaaaataccctttagcctagaaatggccagatagttttgggaattctgtaagaacttgataaaagacagtatattcctagacaacaaattattgaaatatttggtgataagaaaaccctaaattgaaatttctaggaattttggtagatattttgaaaagaactcaatccagactacctcagacatcaggaaaacataggaaaataatagatacaatctatagaattttctcttaattatgggataaatagacttctttaataagctagtttagtaattttactaattaaaagcgaaatggaccaataagaaattagaattaagctattacatgaaataaggaagaaaatttgttgatttagttctaggaaataagccttaaccgtatgatataagatcaagggagaaaagctttaggaaaattcaagaatggacacatggagggttaaggagcttagcacattttcattggtccatgtgtaaaggaagtaattaatgttttgagatatttcatgaggaaaagcctattacaagcaagatatcacacggatgagagagaaaaaaaaacaaatggaatgccttgatattaggagttgcacgtgaagaataagcaagggataaggaaaatgtagaaaactcaagaagctagacacttggaaggaaatgattcattagccaataaaaactaactaaatggaaagtagtcataaatgatacaagattttttagcaaaggcatcttagcttaggatgtgaatgtgcaacaattcctcaaaggcatcttaggatagcaattttatataaatgaatgtgaggaccatggaataaggcttggaagcaagaagtaaccgtgcaaaaattcctccttgtagcctacatccctttcaccttgtccttagcactttaacacaaaaccaagcccactagccttaagaaaatcccacgtgaagaggcaagatagaaggctgtccaaagttctaaaataaagcaaggtatgggaagtttatgataaatatggtttaagtatgctaggattattcaaattgctttagaattaagctttgtttattaggtgtatgattaattgcctcaaagaactaaggttggtttaatgaattgattaattgaagaaataatttgaatttagtttaataaaagattggtagtatgaatgattaaaatttagcttaataggtaattgtttaattgacttgaatatctaaggaagtaatggatttgaatgataattaaaggaatattttcactaaagtttatgtgttgtttattgtgctataaattcttgagtttacttattaaatgttatataaaaagtatgatggaatcatgtttattatgttgaactatttgagttgtgatgaattatgacttgttctgagaaatctatgaagtggactgtggctgtataattgggattttgtgtaaagaagtttatatattgttctatatacattaaactctgtattagattcatgttgacaaatttgagcataagagattaagagatgagtaatattgaagagaaaaaatataatcatttatgatgttcatatgcatatgcctggcgggggctaaagaccgtgttattttatattttgcctggcaggggcttaagtccgtgttattttatattttgcctggcgggggcttaagtccgtgttattttatgttgaactttatgaagattgatgttggaattttaaagtataagcgtatgagataaaagagaatcattcatgcgtgttattttatattttgcctggcgggggctaaagtccgtgttattttgatattttgcttgatgaggacgagaccgtgttaatataagaggctgagtatgcatcatattttgacaatgctatgatgacttcctatatatatttttgaatgactatttgaatgaatttctgtatatattttgtgacttaaattatgtttatcataaacttaccctgtcttttgtgtctgtggttgacacctgtgatgatcccaatttatttgggcgagcagagaacagtaaagcatgagcaaaggatggtggtgaagaagatatgatgaagatattttgatgacttatatttttaggatgtgtattttgtattagactttctaccagtctgtatattatgttggcatgtattttgggactgtatgttgaattgtattttggattgtatatggatggactgtatttttataaatagaccgtggtgaggaagaactcgttcacgataattagtaaaatttgaagcaagaggaaaagaattttccgtaaaatttatgactaatatatttttaagaaagttggaacggaaattttttctaaaaccaataaaataagatagtaaaacgaggcgttacaaccttagtgcaaaacatggaaaatgtagtagcaaattaaagttgattagctagcaaggaccacatgaaaataataagttgaataactagcatatggcgacaactacttattttcaattgagcaatacttcaagaaacaaagatcagttggtatagctagtactttagacatatcaaaatactagtactttagacatatcaaaatatactgaaaccacaattgatttcattaaataaagagagaaaaagagaaaaattgagaggaagacaatttttttttgtaaaacttatcctttttagctgaaaaatggtatagctagtacttgacacacatgaaaatatacatgaaaccacaatttttttatacacctgaaaccatagttaatcatagtccaaataccacactttttaacatgagaaataactacttcagctcgtggtttgttaccttattaacaacactaaaaaataagtttaataattaaaaggattaaaacaatatgtatcaaaagacaaagaaacaaacaaactgatgaaaactctgcaacttaacttcagagaaaattcacacataacttgaattgggacaagacgaaattgctatatcaatgatcccttctaacatcaacaccacactcttcattgttgggccccaaacaggttcatcttcgagataccaaagtgcccccttaacatgttttccacaatatttttatccatggaaaggaaaaacttattaagttgtccgataacaaaacacttataaacccagttgaagagaataaccgccctttcaaaggccttgttgtcttttgcactccatgagccagtggatgacattgaccaagatgtcatttcttcaagacaaaatggtcaacaaaaaaactttaggtttgacgatcactatatagagaatgatcttgtatgtcaacaggaattattcaatagttgatactgaagagaggaaaccatgtgtgctcctttttataacaacaattggagagagtgaggtggggtggcaccaattggaatgcaaatcttgccaaaatgtagtaagaatttgaatgatttgactcctcagaaaccccaaatagagcaggaccaagaattgagctgcattatgggagaatcagtatcttcaaaaaataaaattaagtgactgaattgatagaacttaccaaaagtacttgtttttatttatttatttataccttttttggcttcccccatttacttttcttgttatacaaatcaagttaaaattgcactttcttatgtttgaagctggtggatataaagataattaagagccttaaatagagtaactccacacattcataataaactgtttttgagttgagaacacttcctcaagttgatgatatattattaatgtgttttttttagcagcttagagatatcgcgtggttgagaaaatagacacaaccaactaacatgttagtattaaattgtaaaatttcagttgtgcttcagatagtaaaaacatatgtaagagtaagaaccaccatcaactagttcacctaatggctaactttatttgattctcttgcttacatggtcttcaagtggggcgaagctcagccaggtatcaaagatttcaatgcatcacacaccataatatcttgttcagaacaataccattttgcaaacatggtctttattttgtgtttgaggatgattacttagatggcccaaaattttgtgttttttatttttatttttaattaggccaatgtatcctctcttccatcaatataagataagttctttgtaagatcagttgagaggtgaccaaataggtctgcatagtcattcctggtcagattcccagttcaatatagttttgacaactaaacttgatagaatcctaagttagaaaataatgttacaaataatgtaccaatacaaagggaatttgctgccacctgttcatatggaatcctaaaactaatttaaattgagtaaaatacaacagttcactactgaaaaaggccttttaacgataattcttaaggccttttaacgatggttgtacaatcgtctttgaagcgagcatcgtcgaaagccaatatttttgacgacggttttcaaaccatcttagaagggtataatttctaagaagattttgtcaagaaccatcttagaatttttttttaacaaaatagatgtttctaagacgattttccagagaactgtcttagaatatcttttttaaaataaaaaattgcccatattttattattttataaccttaccaaattattattattattattattattattattattattattattattattattattattattattattgtctcatttttaatataaagtaatcttagccttatttaactaattgtaataaattatctatacatgttaaaacatacttttcagaaataaaacaaatatcaagaactttattatggaatgtggatgtcaaaactactcagcaagtcaagaatagaaaatcagaaccacattagtcaataactaacctctatactttctgatgttgtcagtattgaccatattctctccttatctatagcttgctgcagttgcctctgagtaatattagcccagaaataactccttctaaaccctgctcaactttttctccacatgttgtagcttgaggaccaaaatgaacaagaaattctctgtgcaaaccaagtttagtgattacaataatgcttgtcagtgcaagcatgagaactgatatgttacttaagctttttaaatccgaggacatattttttccagatctaggaaatccattaaaaggtcatttctgcattgtctttaagaataaatacaaagcttgaaggaaataggaatataaaagcaatgtttcaaaataaacaaattttaaggtgaaacatacaaggaagaggtagcagtaatgcaagaatccctttcaaactaattaacaaaggatgtcactacatgtggaacttgcttggaccaaaaccattcatatgctttcaaatacttatttgatagtttttcgctaattaaactctctaggggagcagatagctgaagtaaactagatcaataaaatatttaacaattttaaggcccaaaccaactaggaagtagaataaaatataaaaactaaacaaataaagaaataaataataaggaatgaaataaccatgaaacatataaaacaaaagtacatcaaagatcaacagatagtctaagtagttttcaaaagtaaatatgacctgggaagtaattgattcgaattttgtacagtttatgggataagccaatcaattcatattttttagggagtcaaaaagatctaacacaatatcctaattcacacacactttcacaaggaaaaaaaaggataattgaaagaaagtagtagagataaatctataaactacctaggcagcatacaatataggattaacttatatcaaaaagcacagatccaacaatagtggcaagagcaacaacatattctggaaaggtagtatgcatggtccatgttttctttgatgaaggactatcagtgaatgtgtaacgtcctgaaatttcaataaccgaaaatagatgttctatgtatttcttatgttatttgactatttgattaatttataattagttgaaatgctatgtggattctccatgtacaattgtttggtgtagatgtcaagttatgcagagtttgtttgagctacgttgaattgtgtgattccgagtttgacccaaaaacctattttagtaaaatcatcattatggattggttaaccgttagatctccttccaattttacaggtatcttcctaacctatacatataactttttaccgttgggattgcgaaaataatatccggagagtgagaaattaatttctcactgaagcagaaattttgaaatttgggcagctcgcccaggcgagtttatgaaggctttttgactcatctgggtgaggaaagtcggcattaaatacgaccatctgcatctagatcatgaaaatggggaattttcctcccacaagcgttccctaacctccctccatcatcctccaccacccacaaccaccgaagaccaccacggactgccattgcttgccatgagatcccggcactgtgaagaaccttttaattggagcggaatcttcaaaaattttctcgaagttttggtagagaatgaagctcccaatcctcctttcttggtttccttgatgtaatcttagtttcttttgtcttctcctagctagtttaagcttctattagtatctcttgtgttttgggtatcgttgttgggagttttacacttcctttgaaaaaccctttgaaaatgagatgttataaaagtctcatttttatgaaattgatatcatttatgtggtccttgttgaaccctagtcgcattggtgtgattggaatttcaaaaggatgtcttttaatgtaaactcacaaaacacccttttagcccctttttgaatttgagtgggtatttgaccccaaatgttaatattgatcttatattggaaatctatattaaattgtcttcgatttggtagatagagttcttcgtttgaacgaaaacatgcgtattgaaggatctctaaaacaacattgtgaggttttaacaggagaactcctggttagataagggaagtttactatgttggtaatagtttagataccatagttggggcccagagagtccaactacgaaaagaactgtctgtccctgctatgtgctggttttcaagaaaaactgtttttaactgtgaacatttcaaaatcctatagatatagaatactaaaaataaaaaaaaatgatttttttgtttatcttcatttaataataatttagattaggatgcgatgtagttatgattgatgtgtgtttgttcttatatgtgctcgttttcaagaaaaattatttttaactaatgggatgtgatgaattggcttgttgatggataaaactataaatgatattattattgtgatgattgttgggaaaagtcttaattacagaggagactttgcccaaaattttataatatattttcctatttaattctttattaatttttaaatgggcataagagtgtattttctatattgtagtcctcctctttaatttagaattctcctaaaataccagtctaatggtaatatggattgtggatgaatgaggtgatattgatgtcattgataatgttgaaatgagatgttattgatgtgttgatgatgattgaatgagataatgatgatgtgttgatgatgattgaatgagataaagatgatgtgtttgatgatgtacaaatgaaataatgttgatgtagttgatgatgttgaaatgagatgactttgatatgtatgatgatgaaattagatgatgtgatgtggatattgataatgacattgataaaagattatgttggtgctaataatgtcattatgtgatatgtatatatattgacacccatgggggtgcatgactggttacccttacgaggaaggatgtgttctttgtcgggtcatgcattgatggtgcccgtggttgtcattgtgtgatgtggatatacatggatacccatggggggtgtatgactggttatccttgcgaggaaggatttgttcctagccaggtcatacattgatggtgtctatggttgtatgttgtgtatgtacacgtgggatgcaatgactagttggttacccttacgaggaagaatgtgttcctagccatggtcattgcatcaatgagcccaagttggggtggtatgtatgtacatggggggtgcatggtgggtcacccttgcgaggaagaatttgtttctggccgggtcatgcattgatgatgcccatgtgacatacttcatttgttttacggaaataagatgattggctgcagagtacagaggtactggggggcacaactgtttggaactcctttaatgagacccatggctgatcaccagtggggggagcggcctgtgcacgatagagtgaccctaacatcctgctacatcatctttttgtgttggactatttctgggatggtaccacattgcatgctgagagatgagtcaggagcatgcatcatttaagcattataggttgactagtggaatgcatttggatgactgtccttgttagctgcatgatgaactaattgagtattgtgatgatgtttgtgatgttttgcattgccttctctaactgctgttatctattacttgttggttatacataataaactcacccttgcgtttgttgtaccgtgtggttggtacttgtgatgatcgcgaaccttcgttcgtgtgagcagatgagcagccttaggtgactctggagggagattctttttagttggagccgtcaagccaacgtgatgacgttgggtttctttttgggaaagagttgtgttttgttaatcaactcttccttagttagttctttgactttttgttagatatgtaatttcagttgtattacatgtaaaactaaaggaagttttaacatatggatgacatataccaatttaatatatatatatatatatatatgtacatatgtgtttaattatgaaattgtgatacgtgtatgataattgtattatcgcgaaaaatttaccatcattttcataatcaatttaatgaagtttttattaaaagttaaatattgtgtggtaagagttgatgatacagtagcgatgaggcgggttgttacagaatgcaaaagactgattttaggacaaatgtaaaagaccagaatgagaaacagaaaatgaaatacttctaagaatttattaaagggatacacaagagcaaattaaattttgtaaccttgattgcaatcaaaacaccatacttacaagttagtgaggttgtttagaaatgaaactccaaaaggaattggccattaaaactactctatgaggttgtttagaaatgaaactccaaaaggaattggcctattaaaactactctcttacatcaccatgtcataattaaaaaccattcaatcaataaaccaacaaataaataataatagatttaaatttcacaagacgaaagattcatacagtattttatctaaaactatcaaatatattaagtattttaatttttttgtcataatattatatattttgaaaaaatttacaatatttttttctataaaaatattataatttttttctcctactcagtaaattttctgaatttatccatgattgatagaaactttaccatttcaaacattgtattaatatttattatttattctaactctctattctcatcatatcatattagttattgttcttaaaattttgtcttttatatttatctctcccgaggtgttaagtaggtgttgcactggtgccaattaatttttgtttaaaaatgttcaaagttcatttcatgctaccagaggaattaatttttgtataaaaaaggtgtttttatcataatgctaaatagatacgagaagtagaaagctttgccttcacatttatctgaaatagcaagactaagggataattgttaagttattatagaagaaatattaggcaattatatcggtcagtaaggtagttaggagttagcttgctataaataatagtgtagatactacatagtctgtttttggaagctcattgtagtggacaatgcttaaactcttaaaatctcaataagtcgatacaaaatattagtttctttctctctctccacctctctaggaactgtgtgcacattttgttcttttttgggtaccaattgcattaatttgtattagagctttccatcaatgtctctcagctacaaacaagcagctggaaatagtatgaacacatttgaggatgcaacttccaaggcaatactcttttgcttttaatctgcatcttcagcatgtgtttgctaagacaattctaatgaatactcaagtagtttatcaaatagtgcagccatgaacatttttgaaagatcttttgactccttgattgctgtcacctttggtcttgttaagcactttaagatcttgatgtttaattcttcaacatcaaatgtcttttcaagaccaaaaagatgatttacaatgtgtgtgaatcttgtctagagtagagatatgttttctattgtgttcatcttgaacatctcatactcatgaatcaaggcatgcttccttgatcttttaacttcatgtgtcccttcatgagtgatttataacatctcccacatctccttagcgcttttacacctaacagttctgaaaaattcattagatgaaagtgcagaagtaatcatgttatttgctttgaaatcgtattgaactactctcttttctgcatctgtcatctcatcccattctttggaaatcatttcattatcaacaatttttattggaatcaaaggacctttttatattgcattccatgcaccagggtcatttgattgaatgaatatttgcattctatttttccagaaactgaaatgttctccttcaaacatcggagaacgattaagggagacaccctctttgaaggtaatttgtgtggtattcattttctttgaaaagagatagtgatcttgaataacactcaagaacatgctcttgataccaattgaaaacagtataaacacacaataaccaagagggggtgaattggtttaaacttcgtcttttaaaatctttaaaacaatcagagtattaagatcgtatcacaaacaaccttcgaaaactttcagtcaatcaaataccacctttaaagaaagcaatagctgaaattatatttctgttgattctgaaaagattatccaaatgaataacaatcaatgacagcaagaagagataaagagaaagtattcaacaccaagaactatactggttcacttctcaccttgagacgttatatctagtttcttccaaccaacttggttagagttccactattcacaaaattcttttcttacaagcttacaacaatcacccttaatcaaacctagattatgatcagaaatctaactcccttagactcctagtgatcaagacatagagaatctcctctctactctttcctttagagaaacctactctagacaagccttaagaaatattttgtaatagtaacaaacaaactgaaattctaaaatgaattacaaacaaattttaatggcaagagacaacctgatgattcaaagcatatgaatgcatacaatttaccaatcttggtccaggttgaatgaaaacaaatttcagagcaaactctccaagaatttctttagaatcttgtccaagaagaaatctttcaatgtaacatgaagatttagaatttgtgggacaagagctcagtgactcaaagtatctcttttcatttcagaagacttttgaaaatctatgaaaattccattgtgtaatgttttgttcatttcaaaagacgcaacaactttttatagaaaactgttgtaactgaatgtaatcgattaaatcgtcaatgtaatcaattaatttcagtaatgtaatcgattaataacatatttaatcgattaaagtgttcttgaactttctggaaaaagatatatgagcaaaataattgattaattcaccatgtaattgattaacataggaagtttgtttcaaaaacatgtcaagtaatcgattaccactaaatcgtaattgattatcacagaaagacttattatgtgtttgtgttgtgtaatcgattacgtcatagctataatcaattaaagtgttcatcaaggcttgagtaatagattaccatatactagtaatcgattaaagcagtgcgaaatagtttttccaaaacttaaccaatgaacacttggctttttatgcaatcatgaaaactttaaagctttttcacaaaacatgtgcttttatgaaaaccatgaatgcaagccagtgaatgatgtttatgcaatgcaatgaatcataggatgaaactcttagacatctaaagattacatatgccttcaatagaaaatcacccactaatgtgaattcactttcaaccatgcactaatggtaattaattaagaacggttgttctaaacaattaaaaaccatagcaagtgctctcgtgaaatttcaaaaccttgtctaagctaaacattgcattaacaaaaaagataaccataagaaaatgaaatccaaagacagtatatataccaaaagaaacagaaccttgtctaaggtaccaaacagaagaaactcttataaccagatcacgaaatctattgtctaagcttttaatatcaaaactttgactcatgtacctaaaaatatcttgacacataagtccataatagagagaaagcaatcacataagatttttctagtctagtcttttagtgtacataagtgattctactcacagacacattattttcactataaccaattaatgttacaatcactgactaacaatatacacaaattaggcattttatcaagcagttagtggccaagaacagcgaaatcacatagcggctttcatgaaaccgatacattaccttaaaatgataatgcaacatcagaaacaaacatttagttgcgaaataggttcattgggtgcaagaacgctactaacctgggatggagagacgaggcaaacacgtagaagtcgcgagcttcgagtgcgactaacaatgatgcaagaatgcaatgagtttcgacttcgagtgcgagattgacaaaatcgtgagagaaccacactggaagcagcaaaatcgcaagactgagagtgagagatgaggtttttgtgtaggcgcgggattgtgtgtttaatttgggggacaggacgcaccttttataataaaacaacaacatcgattttcattgaaaaaccgatgttaacatgttattgttaacatcaattttcctaaaaatcgatgtcaacaataacacgttaacatgggttttcttagaaaacttaaaaaccgatgttaataggaacatgttaacatcggtttttttcaaaaaagttaaaaaccgatgttaacaggaataggttaacatcggtttttctcaaaaaagttaaaaactgatgttaacagtaatacgttaacatcgatttttcttaaaaacttgaaaatcgatgttaaccatgtcctgttaattacaaaattgccaccgtattttcattaacatcgattttgtaaaacaaccgatgttaatgtaatgatgttaaatgtaatatttctagcagtgccactcttaatgacttaaacctctatttagttcattagttaagctctaactttcaagttgatcctagagtaattacttcgtttattaactctgttaattaaacttaactaaacataattaaagtgagtgagaaattaattctccgtttttcttattaattaaacaatttgtttatcacgtctagacacattagtgctctaaactttcattaattagtttgaatctttcatattaactttaaaagtctctatttacaaaattatcattaatgagagatttccttactttaactttctagtttgtagttgatttttattgaccgttgatttgaccaatgattttctaaatctaaatcactttttcctaagctctgtacttttctcgaaacaaacataagctacttttactatgaactttccaatctagaaaattggaatgttatcatccgagccaagaaactcattaaatatgattcaaaatagatcttattctattgttgattagagatttcttccatatgtaagggtcaatcaaaattcaaactctatattatactatttgattaagaggcacaagtcgctatcacttgtaccaaccgttgttgataattaatatctctcacttaagtcaatattgatagattctaaccacttattttcattccttctcatctcaccgagttgaatcaattgatttacaatttaattcttaataaagtccaattattgagtactacgcgagacaactctggattacccaatattaatttattctttcatggtaacaacccgcggtccccttctggacgtatatatctagttaatgtttagcatacatccctttaaattgataaaaatgaatgttagctacttaaagtggcctttaaatgaaatttgtggagcttgagctcgtaagaatttagtatttaatgtatttgtattaaaatagtgaagagaaaaaatataatacaattttaatttctctaatttataattttgatcttttttttctccacggtttcgatctcctatttgagaaatttttgtaaatttggttcagttctcattttttatatgttttaattcttttattttagttaaattgcatcataaatataacatattcacttaaaataaaataaaaattattttaatgaattttaaaaaaatacaaattgaggattgaatcaaaattatgaattttttaaatatgaagatcaaaattattataaaaaaacgagaaacaaaattgcaaataaaaaaactaaagaatactaaaactgaaatttaccccttgagttgactatttacgctatatactaaattttaatatcagaggggtaaaaatgtattatctcaccatgttaaaggattcctgacatttttttttgcttttatgcagttttgatttaattgtcctaattaagataggaatccccacttacatataaaaataaaaaattaaataaaagataggaattcccccctctccaatatttcgtctgatccgtttcaattagaatttgtttggtctctgttataacttcaatcactcaatcctccccaacctatatagtttttaaaatgagttaacataggaatcagggagttcggctaggtgataattaggagggtaggatgtaatgtagacattaggtgctactttattattgtttgaattgtacgtcattgttaatgagaaccacaaagagtgtgtgactcctataacattggcaaagatttggatctacattccctgccgtaacatttcacacattcatcctgctgcatgtcataatttaatggctgtaatttgtttttcttatattttatttttatttttttatcgataattgttagtttttattatatgagagattagaacttacaagttctctccctttttccttcaagcaccattcttacattttattaatttgtaaagatttaaaaataaaactaaatattaagattaaagtttccttgtctttctatttgattgcatatagaatccttatcccaacgaattttttccctttttatccagcgttccatatttgcatttgtatcatttcatgttccttattgttgtggtgtgaaatagctagctgaaatgtgattcaatattcaacacgattccaaaatgattatcaaactaagtatcaaaagaaaagatttgtctttcaactatggattctcaaactaaaccaaagaatatttgaatttgagatgatgaaaacggaaataataataaagcaataagaaaatttgaaatttaaacgaacaatgactaaaaagataaaatgtgcaaataatattaaaagataacaattctatttgattgattagtcaaactgtcttgaacatgtacattttgaacatgtacataaaagcaataagcaagtcctttacattgtatctttcaagactatttatactaaacatatcaaaataattgtcttgaacatgtacattttgtcactgactccgcgatctctaaaccggctaaaaatccttcattcggctagttttgaatgacttagctcgtaattgcttattttcccttccgtatattttaggcacgtttgttctcctataataatcatgctatcgttgactttatctcttgatcttttgctaatatccgctaatctcttttcaaaattaatttatattttattatcaaaatataaattattaagaaatttgaatattaagccgaaacaatagtaataaccctctttaagcattttttgggctaaaaatccaacagcttataacaaaaatttgaatgttaaaactttataaatgtatattggtacatattctcttgttaatttgtttatcgtattactaaccaaaattttaaatgccattattatagttaagtttaaatatcctttttattcctattataaaatacactaattttaatatctagttacattttaatttctatttatgattcctaaattagatgtctaaatgtttttcttatgtctttcccattagtcttgttaacaaaatacttacgtgactttactgttgccacatcacgttatcatgttacaaaaaatgttaacatgacaaattaaaaaaaaaaaaaaaagtatgtatacaatagcaagttgcccttggcaacaacgaggatcaaatctgttccaatctcaatcccactattaagatgactctattaggtttacttaaataacaatttcaaataaagctttgtaaataattttaattttctaactaacaaaaagaaagaaaaaaattaaacattacagaaatcataataacaaaaaaaaaaaaaaaaagcagggcaagaaagattgttgttatgaaataattcaccattatcgtaggaacttctagggaatagttcatttggtgttttttaggtatataggttgttattttggatgtataaactttaaaaaaaaaaaatacacaattgataagctaaagggaaaatgtgcacgatgaactcgatgtgggaatcaatttggcatttggggggcagggtatatggaatatttacattacccctataacgtaaaaaagccagttttatttctatatatatgcacatgttattagctatagggtctgttatctgtctcttataggattagtaaactaaagcagtgcatgttattttggtttttgggttttgggcatgttattttaaacatttaagcattaatagaaataaaggctaaatttatatactcaataagaaaatttgaagacttcatgtttcccttattaccttgtcttgtaaataacttgttagatattaaaataggtcaggccgtcaacaggaatttacaccttaactgatttaaaatttgacatgctatttttttaataactattacatcattttattaatttgatttagaatgtatttttattgatacaatcgttgaattatatctatatattatcaagatcgtctatgtcaaatttgttaaaattgaacaagaaggtaatcaaattatcaatgttttagtatattttgaaatgtttatattgcgtcgattttaatatatatgaacaaggtaataaataattttggattaatatgaatttttgtatatgtgatttatctaaaaggaacttaattttaagaaaatattattcaattaaaagttaattaatcttatatcacaaataaaataaatatttgagataaaaaataaaaataaattttatttccacaacttattaagattgcctcgtaactcgagtaatcattgttggcgtatttaaaatttggcttgttatcctgtttacatgtctaatatgaaaaaaaaaaaaaaaatctttagataagctaatagtcaagctagcttttgaaaatggcatgttatacctgaaaaaaaaattgatggactaataggacataccgaactttaattttttttctataataattcagacctatttatccaatgtaattgaatattataatttagaatgctaataattaaagtaagaggttaagagcacatttaaaaaaaaacacttatttaaatacactctctctaatttattaagatttaggttaattttaatcttcatagtttcataaatccataattttggtctctttgatttttattgtaacatttgattttctcttgtttccaaattgtgattttgatcccttcgataatttatctatgttgactgttatgtaattattgtttacaatctattaaatgatgtgacatgtttaagatgaatttactaaaacataaatatgattatttttaattaaattaagttaaaattaatttaatacaaataaataaaggaattattgataccctcccttttttccaagtctttttcttgttttcatcccctttcccttacctacatcgctccttcgcaccctctctttctctacctcttcttctcctttccttcacccactctctctcccaacttagtgcaagatccatatcaagcctcaaagtagtgtgacgcaaggaccccgcacttgaccaaatcatagagtcagggccgatcctgacattttatgagcctaaagaaaataataaataaaggggccttatatattaataatcagtgtattactctcccttttttctagtttctcccttttgtagttccttgctttccataccttttatcagaaagaaaatattaccgtttccacaaagctagaaattggtgtagactattcaataatttggtggaaattcaatgttcaattgcttgtaacaattaaatttgagtttggaatttgggaactgccgttggatgcgctatatcgagaagtggagaagaagctgaaagggtaagtggtgcatgaactatttttttttttaaaattgttaagccatattaaatttttttaaaaaaaaatattacagcaaaactaaaatttgggacctcaaaatttatgggcccagtacaagtgcacctttgaacatagtttagggacgggcctgcatagagtacaataatcaacaagcattataactaatgtgctaacatcctcaacgaaccaagccaagtcatccctctgcgctagctacctcgaaaaatgccacccacgcatgcgcatcaaggtcaaagtcgaaacctttctcaaccaaaacccctgctttttgacaactctgttcggaggagacctcgaatttgctccattgatggcaggttacaacaacacaagttttggctcaatggagacgacggagacctaactagagtgttggcggagttgcatggaagtttgaaggatcctagtacacgagctggggtgccgcacccatggtcaaactgtgacatgtgaaggaaaggtgctgcaagggaatggatcgattctaccataggttttagtgcgaatatgaagtgtgaaatgtttataatgcaaaggaaacttcgatgtgtgtctttttaccattataaattatttttaaaaattgtttacctaaaataagtgcatcaaaaaactacttaccaatatgggtgatttttttcatgttggatgtgggtgacgtttgtcaatgttgctccacccataaagtgccacccatatatatgtgtcaccttttaaagtggactatcacaacgggtggtgccactttggtccactccatcaagaaggcgaaagtggcttgtttcaagtgagaaacgagcctcaacaacttttaaaaaaaaaaatatttctagtatatataaaaaaaaggatatcacaatggtgtttagtagctaaattttctccccttaaatgcattaattttgaatgaaatgatgacgactccattagtattcatgtcagtctatccaatgttagcattcatgtaacgccctgattgtcgacttctcgacgactctcacactatgaaacttcgtgtgttggcacttcactcaacactcctcattgatcagaaccctccactagtcagaatcctaaaacatgagaaacatgaagaatatgaattcacaaggaaacttgaagaaaacctagggattttgtaacacaacacttaacaaaactacaacactaagaatcacaagaaaacatcaagaaacaaggaattactaaggattttcatttttgactctaatgcagaattatacctttaaagcatcccaaaactgaaattgaagaagaattccacaaggtttaagctctagataccaaatgatggactcctgaactgaatcaagtcctgtttgccccgatcttccttgcaatgaaatcaattcttcaattgaaagaaaaacagagtatgaaatgctctatttaaggacagctttttaggtttttgtgatttaagaattggaacaatggaagaagattagaagtggatttggattgacaccatggaataggaattccaataagtcttgaaagaattaccacaatagctcataagttattgataagaaacaagaagtttttcactaagaacaagggagaataactctcaacctctcacacacaaagtgcaatctaatttcattcaatcaaaagttcttacaatctattgtgatgtggtttatatagatcacaaaactacaagctaaatgaaatgtaaatgcatcctaaatgagattcaaatgtagcttccaagacaagcttttaaagacagcttttaaaaactaaaaatagcgcttctacagaaagaacgactttaatcgattatttcgtaatggtaatcgattattttgaatcaaataatcgattactagatcttggtaattgattatttgttcatatcaggcctggaagctgattcatgaacaaagtaatcgattatttcaccaaataatcgattatcacaggaactcccacttccttgtaatcgattacaagacggaataatcgattatcacaggaactcccacttccatgtaatcgattacaagacggaataatcgattacaacagagctatttacaaatctaacatttatacaaagtatttaatctattagaggctactcgtaatcgactacaacagataagctcaatattttgtagcctttttcatgattctccaagagatacaagctggattgtatatgatcttggagtgtttgagccctagcccttgtcattggccctttaatcaccaaaggaagtgcttccatgtgtaattccaagtcttccttcacttgccttggttttaggattgtatcatcccctccttcttgaaaagaacttgtcctcaagtttatttcttcatttggacctgcatcatacaaggaaagatcaccaacattaaaagtattactaacaccatattcattaggcaattcaagtttataagcattgttgttaatcttttctaaaatcttaaaaggcccatctcctctttgttgaagcttggatttcctttcatgaggaaatctatcttttctcaaatgaagccacaccaaatctccttccttgagtatcatttgctttttgtgcttattggcttgcttggcatatttttccattttcctctccacatttgctttcacttgttcatgcatcttcctaacataagaagctttagacaaagcatcacgactaatcatagaagatgtgttaggtaatggcaataaatcaagaggagttaaaggattaaagccataaacaacttcaaaaggagacatagaagtagtactattaactactctattataagcaaattctatgtgaggtaaacattcctcccaagatttcaaattgcttttgatgtagcatctaagaagttgacccaaggtcctatttatccgtttgtgggtgacaagttgatgaaaataaaagtttagtaccaagcttaccccacaatttatccaaaaataactaaggaacttggtgtctctatcactcataatacttcttggtaatccatgtagtctcactacctctttgaagaaaagattagccacttcacaagcatcatcacttttatggcaaggtatgaagtgtgtcatctttgagaacctatcaaccacaacaaaaatagagtcctttcctctcttgaatcttggaaaaccaaggacaaagtccatagagatatcaatccaaggagagttaggaataggcaaaggtgtatacaaaccatgaggcatgaatttagatttagctttatgacaaacgatgcattgagaaataaatctatgcacatcatgcttcattttttggccaaaagaaatgttcatgtaacatagccaaagttttatccgccccaaagtgacccattaaattattttcatgagcttcccttatgaaaagttctctcaaagaacttttaggaacacatagtttcttgtctttaaacaagaaaccatcctgtctaaagtatccttgatgagctccttttgcacacaaagcaaagatactagagaagtcattatcacttacatacaactcctttatgtgattaaagtcaagcaatttagtctcaagcatagaaatcaagcaatgccttcttgaaagggcatccgccactacattcaactttccttgcttatgtttaattacataaggaaatttttcaatgaactcaacccacttagcatgtctcttgttgagtttaccttggcttttcaaatatttaagagactcatgatcactatgtatcacaaattccttaggtaaaagataatgttgccaagtttgcaaaactctcacaagtgcatacagttctttatcataagtggaatagttcaaacatgcaccctttaatttctcactaaaataagcaatgggatgtttatcttgaattaaaaccccccaatacctatattagatgcatcacattctaattcaaaggaagcattaaaattaggcaatgcaagaataggtgcattagataacttatccatcaatgtttggaaagcaatctcatgctcttgctcccaagaaaagttcatggtctttttcattaaatctttcaaaggaaaggcaatagtactaaaatatttcacaaatctcctatagaaactagctaaaccatggaaacttctcacatctttcacattctttggagttggccactccatgatagctttcactttctcttgatccacttggactccttggccacttactacaaaacctagaaacacaacttgtgaagtgcaaaaagaacatttatcaattgttccatacaatgtttcctttcttagcacctctaaaacatccttgacatgcattaaatgatcatccaaattagcactataaacaagaatgtcatcaaaatatactaccacaacctatgaaatgtctaagaacatgattcataggtctcatgaaagtacttggtgcattagttaaaccaaaaggcataactaaccatttataaagtccaaattttgttttgaaagccgttttccattcatcctcttccctcatccttatttgatgatatccactcttaagatcaattttagagaaaatagtagcaccatgtaattcatctaaaagatcattaagtctagggataggatgtctataccttatagtgatgttattgattgccctacaatccgtacacatcctccaagtcccctcctttttaggcacaagaatgattggcatagcacaagggctcatgctctcacgaatccatcccttctcaagtaacttctccacttggctttgaatttcctttatttccattggtgaagtcttgtaggctggcctattaggaagtgaacaacccggaattgtaacaccccgtgtgcacccggtgcgttatcatcaacaatatcagtatcgcgctattagcgttatctaatcgcggtgcgaaagcgaaagaatcgtttttcttgatttcattatgcatagaatataaaacacaccatataatatcatacataagccccattgatccagttaaacagaaacatacaaacgcaggcagatataacatagaaaacaaacaagagatatcaggagggaaatataactcaaatacaataacattatcatctgtacacatacatgctccaaaaacaagatcacatctggtcatacatcacaaatatgtacagaacaacgggtgtacactcacaccctttacctctatacaaaactagacagagatcaaataaagattcttctaatcttcaactgcagcccatgaccactccagcgcactctactagggcctcctgccctgtggtagctcctctcctcaactggcacctgaaaaccacaaaccccacacagggtgagacaaacgtctcagtaagctcagggttctgggaatcttccctcaccctggttcacctccaagcacaaacacataaacagatatcagagctaaggatatcatcctagctcacacatacaaagtctaggacatcgtcctagctttcacccatcccagccatctgggcacaaacactggatgccatcagcatcagaggtctcccacctcatactggctctcaagccatctcaaaactcgtctcacagaggtacactaccatagtgtccaccccaggacacatcttatatcagagaggcaccgcctcatcactgaaccagcattgcctgagtcacctactcaggactttacacacacattgcctgaggattctctcaactcaggacttcaagcaccagatatggctcatctaagaggccttaggctatcatcccctcgggaagccctctctagagatacaacatatctgtctactgcctggcctctccaggacttctatgacacatgcctgggcaagaacatccataaatgggcaatcacctccaggactttccacaacacatgcctgagagatatcatctcacacaggaggcactcaatctctcaggactttccagtccaatgcctgagagggatcatctcacaccggaggcactcaacccctcagggcttcacatctcatgcctgagagagatcatctcacacaggaggcactcaatccctcaggacttttccgctgcctgggagagatcatctcacaacggaggcactcaatcccccaggacttccatcagctgcctgagagagatcatctcacactggaggcactcgatctctcaggacttccaagtcacatgcccgagagagatcatctcacaacggaggcatcaatccctctggacttccaaacacggtctgagagagatcatctcacaacggaggcactcaatccctcagactgtcaatccactacctgagaaagatcatctcacaacggaggcactcaatctctcaggactccacagcaatggcctgggaaaccatccaggacttaatcgcatacctgagataaccactcaggattctcaatatctctgcctaaggaagaacctccatatagggcaatccacccttaggactttaatggagagcagtggcacctcccaaggaatctcagctattccaaggagtcctcaaactcttcctctggctagggaacctcagctagcccgataccagtccggtatcctataggttccatcacagaccacctcatggtctgcatctcgtcagaatcaataaacacctcacactgtctcggtgtctgacctagggttcatcatataatcatatttctagaatggcctgagctccactccaaggaccgttatcagcccttcaggcttccacacacacacacacacacacatatatatatatatatatatatatatatatcaaacatatcatgcattcatcacccccacttgggtggcagaccagagaaagggaaaaactctataacgatgagcttacctgctagttgtgcctgcaactccggcctcagggacaatggtcggctcctctgacacctcgtgtcaagccctaccaaagcatacaatatcatattacagaccattcaggcacataacaatcattagctcatcagacagtcctcaactgtctctgtgaaaggaacctcagtcctttctatcaacccaggtcatctacctaaggttcatcaggctcatccatcacaagcctttccatagacctccagtggtctatctcagagcaaacatggcctcagagtcgttccagactcatacacaagccattcacagagagctcgaagctctaacaaccccagatcctctgggtttctcaggacttggacggtctatctcaccagacaccgtccccatggcctatcaggcacctcaagtccattatattggctcttgcatgtctcaaatcaagtgactcagtccaagtcacacatgcacagcctagagccaaaaccaacattcaccaaatcacaaactgaaagctaatccttcctcctctcatcattctaaacacatctctcaactggacccagagccaattctagccctatcacagatgggtcactattcacccaaaacccccaattcacaaatcaatcggagaaactcgagtttcttacctcagaactgatgaggaaggcctctaggctatgcttcctagccctggtgccgctgaatcaccgccgttcctcgtccaaactcgagctctgccacctccttctgagaaaaggcttctctggggtttcaagggaaagagaggaaggattctagcttataaccagttccaaggaggtttactaggcttagggagtgatttaggtgaagaattaagggtttaagaagcttgggagcagctctaatggaggctggagtcgtggggaagaagagggaatagtgttttccttcaaaaacgcgttttccccctttatacttagtctgtccgaggtctggcccgatccgcgcccgatctcgcgctagtcgcgccagatgcaccgccactgccgcgcgacccgcaccacatccacgctatccgcgtgaattggccgaacatgtggcgcgatccgcgccacaccccgcgatccgcgccaacccctcggccctgccacgctactcgcgccatagttcacgctatcagcgtgaataccccgagagaaaagggtttccaggcacttctggcgcgacccgcgcgactctcggtgctatccgcgccacactcataatacagcttcccatactggagcctgacgctaatcgcgcaacatcccgcgccacccgcgccagaccttagggtcatcacaggaatcaaatctatttgatgctttatacctcttaaaggaggtaagccatttggaatttcctttggaaaaatatcttgatactcttccaaaagatattgcatagctttgtgcaacctttcaccttgcttttcaacatgtaaacaaagagagttaggaagcatataacaaagaggttgttgagccaataacactctcttcacttgcttttcactcaaaaagaagctctcttttatctcatgaatttttttgttattattttctttttcatttcctttttctcactagatttccctttttgtacaacactcttttttttattttcaagtgcagtaatttttttcaactcttttattctcttttctttcatcttaatttgatcctcacacacttgtctaggagtcaatggtctcaaaataattttcttgcctttatgctcaaactcaaaagtattttccttgccatcatgtacaactttcctatcatattgccatggtctaccaagaaggatatgaccagcctccgtaggaacaatatcacaaagaacattatcatgataaccattaatagagaaaggaatgagcacttgagaatttaccaacacttctccactttcactaagccattgtagcttgtatggctttggatgttttgtggttggcaagtataatttctccacaattcttgtgctagctacattagtacaactcccaccattaatgatgagtgaacatactttgtctcgcaccaagtatcttgtgtgaaaaatattttctctttgattctcctctttatctaggcaaaaattactcaacattcttctaaccatcaaaagatctcgctcttcggcccacaagtgtaagtgtcttttctttctcacttgaagaactagatgcataacttgaagattcacttgtaaccttcccatcctctagcaaaatcatagttcttttattaggacattgagaagcaatatgtcctcttcctagacacttgaagcatttgatgcttcccatttttgttggagttaattgttcaatttttttacttggtttttttaccttctcttctcttcttctaagttaagaactctccctttttggctcatctctccaactagaagttgcaaccccactagacttggaatagggaattttcctccttttcatttgttgttccaccctttgagctttatgcactaggtcctcaattgtgtcataagagtatagctccaccacatcttgaatttctctattcaaacctgaataaaccgagccatagttacttctttatgttccacaattcgagctctcatcatcatcaactccatttccttgtaatactcatcaacactcttggaactttggaaatgtctttgaagaagattgtgaacatctcttgaataataagctggaacaaatctccctctcaaacttgctttcaaatcttcccaagaatttactctttgccttcttcccccaactatatctctttgaatgtggctccaccactccaaagcatatccaccaaattctgtagttgcaagagtaactttcttgtcttcctcaaaatgttgagatgagaaaatttgttcaaccttcatttcccactcaaagtattcattaggatcattagtgccaaggtattttggaatttttattttgatttcacccaatcctccattcctctcatctctctcttctctcctcatcctcctatcctcatcttctctatgttctctcctcatcctcctatcttcctcttctctcgtcactcttctaggataatgtctcctatgattttctcttccatcatgttgtctcctttcctcccgctcactcctcccatcatagtaatttcctccataagaagaagcataatcactcccccttctactaccataaaccaatccatccacaccactcatggaactactctttcttgttttctccttttgcaactcttcaaattttgcatccattctagtttgcaatttctccatttgcttagtcatggctctcatcaacctataagttttaagtgacaaagcatctcctccacttgaactcatccttcaaagaaattgttagcaaaaaacaagtatatataagaaattcctcaccactctctaagtgtttactctcactctggtgtttgcacactttcgaggctttttctataatattctctcttgcctttttccactcttattctctctttagttcgtaggcaaaaacttctaatcaaatcaagcctctttgctatagtgaaatatgaaatgattctagacaaggcttaagagtccaaagaataggaaacttttaagacaaacttttggaaatttaaagagacaagcaacaaagcacaatttagaaaggactaatttatgagacaactcaaggactgctacagctgtatcaaacttcaaaataaagatatgccaatgaatttaattgctaaagacattttcatcaattctgaatgccatacactttcacttgaatttgatgttcaaagcaattttgtaaacttataatttgtagcctgcttctaattttctgttttccagctactcttcactatttctttgctttctaataacacttgatgcaattttctttttggtttttgtttttctttttgtttctaacacttgttccagatcaagcatgaaattgaaatcaaacaaagtattacacaacacaacaacaatactaacacaaattgacaagaatcaaagctataaattagggaaactatgaagaaaccctaaaaaacatgagaaacatgaggaacatgaattcacaaggaaacttgaagaaaacctagggattttgtaacacaacacttaacaaaactacagcactaagaatcacaagaaaacatcaagaaacaaggaattactaaggattttcgtttttgactctaatgcagaattttacctttaaagcatcctaaaactgaaattgaagaagaattccacaaggtttaaggtctagataccaaatgatggactcctgaactgaatcaagtcctgtttgccctgatcttccttgcaatggaatcaattcttcaattgaaagaaaaacagagtatgaaatgctctgtttaaggacagctttttaggtttttgtgatttaaaaattggaacaatggaagaagattagaagtggatttggattgacaccatggaatatgaattccaataagtcttgcaagaatcaccacaatagttcagaagctattgataagaaacaagaagttcttcattaagaacaagggagaataactctcaacctctcacacacaaaatgcaatctaatttcattcaatcaaaagttcttacaatcggttgtgatgtggtttatatagaccacgaaactacaagctaaatgaaatgtaaatgcatcctaaatgagatccaaatgtagcttccaagacaagcttctaaaaacagcttttaaaaactaaaaatagcgtttctgcagaaagaacgactttaatcgattatttcgtaatggtaatcgattattttgaatcaaataatcgattactagatcttggtaatcgattatttgttcatatcaggcctggaagctaattcatgaacaaagtaatcaattatttcaccaaataatcgattatcacaggaactcccacttccatgtaatcgattacaagacggaataatcgattacaatagagctatttacaaatctaacatttatacaaagtatttaatcgattacaggctactcgtaatcaattacaacagataagctcaatattttgtagccttcttcatgattctccaagagatacaagctggattgtatatcatcttggagtgttggagtcctagcctttgtcattggccctttaatcaccaaaggaagtgcttccatgtgtaattccaagtcttccttcacttgccttggttttaggattgtatcactcctcgttgattagaaccctccactagtcaaaatcctctgtaggtagccttttctgagacctcaacaatctgatttagctgctttcagaatcaatgattgtccccataaaccaacacaagacttttgaactactttgtccttactcacatgtttcccgagaaaatttccagaaggtcacccatccataactactacaagccaaacatgtttaactgtagagttcttaagtgataggctactaaaaagtagatgcatcttgttggtatatgtagtaccaattaattccgttaagtcattctcaattgtacagtcctatacttgtatagcctctggatccctctctttcaagtgtgatttgtcagggagttacaatttatgcggcgtaatcgcactataaataagtgaaaaacgagcctaaaaacgttaaaaataaaaaataaaaaaaaatctgatttctggtataaaaaaaaagatatcacgaagacgttttgtagttgaattttctccccttaaatgcagtaattttgcatgaaatgatggcggctcaattagtattcacgtcggtctatccaatggtagcattcacactgtgcaaatcacactaaaaacgaacttccactggaaacaagccacagggtcgcgcctccttgatggagtggaatagattggtgtcacctgttctgacagtccacctaaaaagatggcacagattagggtggcacctgtaggtggagcaactttgactggtgccacccacattcaacgcggtaacaatctcctatattggtaaataattttttgaccacttatttaagtaaataatttttaaggaaaacctataatggtaaaaagaatagccctatgatgtgtgtgtgtgtgtgtgtgtataagtgtctatagaaggagccaaggtggagggttgggttcatgtcaaccaacctactcttatagcccctgaagcataaaacaacatgtggatagtgcttttgtctaaaagttactgccttcattcctttttttttgtgttatttaaggttgttaggtaaaattaagaaaaataataattttttttgttaataaaatagttgtggaattttctttttgaccgttttttcactccataataaatacatgtgtaaaataattaaatattagaaagcaagggtatacttgttaaaagagtgattaagaactgacacataagtgtgtcatctcacaaattaattggtcaatgttaacaacctaatggtcaacctatagccaaattaattgagggaccaaaattgttaagtttgaaaactaagggatcaaatgttataactaaaaatcaagagactaaaatcgtgaatttctgaaagtaggagactaaaattataatttagctcaaaacttattaaaaactataaaattaaaatagagaatcattaaatatgtgagacccacaaaattttcattttcaaacaaattcaaccaataaaagagattgtattctaaaaggtgtccctagcatttcatgtaggggatatttggtaggagataaaatttttcatatccagaaagatgatccctgggaatcatgacttttgaaaatgattaaatatgtttggctagtcataatatatttcctggaaattaaagattctcattttgttattagaatttttctaggtatgtaagtatttttacaaatataccctttattaaaatactttcattaaaaaaaaaaatttactaaattttatagttaaaagaaaaactaacccaagatacgaaactatttgatggactaacctacccttatgtaagccctaacttctggcgcggacggcgtgggatgccgcgcggatagcgccagaagtcctgatgagaaaaccctgttgagggtgtggcgcggttagcgccaggctcactagaagttggtgttggtagcgccagggtctcgggaagttcacgctgggagcgccaatagtggcgccaggggcgccagagtttttgcagcccgcgcggatcgctccactggttcggccagttgacgccgatagcgtggatgtggcgcgattagcgctgcgatggcggtgcatctggcgcggttagcgcgagatcgggcacggatcgcaccagacctcggacaggctgagtataaaaggggaaaacgcgtttttgaagggaaaaactattccctcttcttccccacgaccccaacctccattaaagctgctcccaagcttcctaggaccttaaatcttggccttaacactttcttatggccttgaatcttgagagaaacctttgtaaagcttaaatcctttatcctttttcttagaaaccccttttctgagcaaattcctttccctcagagaaacctcagaaaacggctgattagcgaagacccaaggcttggaaaggactccagagctcgaggaagctatcctgcagccttcttgatcgccactgaggtaagaaacatgaggttctgcagttgttttgggattgggggtttcctatgaatagtgacccacttgtgatagagctggaattagctctgggtccagttgagagatgtgtttagaatggtaaaaggatgaaggattaactttcaatttgaaatttggtgactgttggttttggctctaggtggtgcatgtgtgacttggattgagtcacttgatttgagacatgcaagagccaagttgatgggcttgtggtgcccgtgaggccatgggaacggtgtttgtgagttagaccgttcaagccctagaaaaccctgagtatttgggtgatgagagctgagatgctcattgtctgtggcttgggctgagtctgtgggactcagaggccatggtgatttgagatggaccactgagggtctgtgaaaaggcttgtagagaacgagcctgatgaaccttaggttgatgacctgggttgatagaaaggactgaggttcctttcacagaggcagttgaggactgtctgatgagctaatgactgtttatatgcctgaatggtctgtgacatgtggttgtgtgccttgatagggcttgacacgaggtgtcagaggaacataccatcgttctagaggccggagttgtaggcacagttgccaggtaagctcatcattctggggtgaattcctttctcttgtttgccacccaagtgggtgattgatgcatgccatgatagattatagatatgtcacatgcatgctgtagaaagaaaggccaatatggcctgatattgatatttatatgtgattgaagcctgagaggctagatgaacggtacttggagtgatactcagaccattctagatgtatggatgtatgatgaaccctaggatagacaccgagatggtgtgagggtgtgtgacacctgtggcttcaggtgtagggtcatgggcctttggattgatgaacactgtgagagtgttctatgatgaggcaaagaccctgagatggtcagtgatggaacctataggataccggactggtatcgggctagctgaggttccctagccagaggaagagtttgaggactccctggaatagctgagataccttgggaggtgccactgctctccgcctaaagtcctaaggatggattgccctatctggatgttcctccttaggcagagatgatggaagtcctgagtggttatcctcaggcagcagactggaagtcccgagggattgagtgcctccgttatgagatgatctctctcgggcatgtgacttggaagtcctgagggatgagtgcctccagtgtgagatgatctctctcaggcagctgatgggaagtcctgggggattgagtgcctcctgtgtgagatgatctctcccaggcaatgggaattcctaaaagattgagtgcctccgatgtgagatgatctctctcaggcatgtgatgtgaagccctgaggggttgagtgcctccagtgtgagatgatccctctcaggcattggactggaaagtcctgagagattgagtgcttcctgtgtgagatgatctctctcaggcatgtgttgtgaaagtcctggaggtgattgccctatatggatgttcttgcccaggcatgtgatatggaagtcctggtgaggccaggctgcagacagatatgttgtatctctaagagagggcttcccgaggggatgagagcctaaggcctcttagatgagccatatctggattattgaagtcctaagctgagagattactcaggcaatgtgtgtgtgtgaagtcctgaataggagactcaggcattgctgggttagtgatgaggcggtgcctctccgatatgagaagtgtcctgggagtggacactaagttagtgtacctctgggagacgagtctgagatggcttgagagccagtatgggtgggagacctctgatgctgatagcatccagatagtaccaagacagctgagaatgtgttgatagccaggatgatgtcctaggcttaattatgatttgtttatctgtctgtgcttgggggtgaaccagggtaagggaggatctcccaagaccctgagcttactgagatgtatatctcacccatgttgtgggttgtggttttcaggtgcttctggagaataggagcgaccacagggcaggaggcctagctgagagtgctggagcggtcatgggctgcagatgaagattagaagtctttttcttttgatctctgtctagttttctgtataggaatagggtgtgagtgtacacccgttgttctgtacatatttatgatgtatgaccagctgtggtcttgtttttgagcatgtatatgtacagatgataatgttattatatttgagttatgtttcctcctgatatctcttgttagatttctatgtttgtatctgcctatgtttgtatgtttctgtgaactggatcattaggggcttatgttatgttttatatggtgtgttttatattccatgcataatgaaatcaacaaaaatgattatatcgcttccgcaccgcgtttctagataacgctgatagcgcgctatgatattattaatgataacacgtccggggtgttacaccttataacccctcgggcataaaacaacacgtaacaagtataaaacaacaagtcaataatgtctttctctaaaaattactaccttcattcttttttaatatgttatttaagattgttatgtaaaaatcaagagggacaataaattgtgttgattttaataaaatagtcggggatttttttatccctttttcattctacaataaatacatgtgtaagataattaaatattagaaaacaagtaaaaatacaattgttaaaagagtgaattatgggatcttgaactttgtagaaacaaaatatttcaaaacctgacacatatataaaaagaaacgaagagagtacaattcaagcaccaatacctattcctagtgatacccttctttattaataaattattgatttgagtgataatgaacttaatcaccttaagtaagatatcaaatttgaatcttgtgaatgaaaaaaaaaaagtatgattaagagagaaaaaactcaactaaaagtgatgaatactctatactaataacataattaaaaaaaagtaacatgctatttaaagctttaaacgccccccggacgtgttgaggaaattaatgcattaagttggatttaatcgccattgtgagaatgcataaccaaatgaaaggaaatagtggtctcgtgccatcatgcatatatatgatgatatgaaggactcctcctgtcctttatttaaaagtgtaacattgatgcgctgacaacacatatccttgcaggtttcgattgaaattgatacatattaccgactaaccacataagggatgcatcaataactggtggcatagaattgacatatcctcgatataactattgacgacgaaccgcatataaacaaatcataataactattaacgactggcatataaagtataaactaatcgttatcgtggagccaaactttaagaacattgtaaccttaaaatgtattataagatggtttgaaattgttgcaggtcttagggtgaactttcataaaaagttcacttggagctgttaatgtgcaaagacactctttgaccagattttcaaaggtgcgcgctgaattgcgggattctcaccatcccgttcacttatcttagtgtcccggtgggcattaatgctcgcaaagaggacgcttggaggataataatccagaaaatgcaaaggaagctaactcccctggaagacaagtaataatagaatctctcaatggtggaaaggcattatttccttcattggtgagcaatctaggtcctcttggttcatagataatttgggttgtaaagtagggagaggtgatcaatttaggttctagttggatgattggacaagaaacggttgtttatctaggcggtatccatgattttattttcccttgcagttaataaaaagtggttagtaatgcagctggcagaatgacaacaatcgaattgggtttggaaaattgattggaggagatctgttttgcctcgtgaggaggaaactgtagaacaattatttactgacattaatgttggagtaaggggtttttgagagagaaaaggatttagtgttgagtgtttgaagtattatatcaagagacatcagatgtgcaatgcttgaagtgttatttccagcttaggaaaaatcttaaaaatataacacgttattcacttccaatccatatgggcccatatatacaataatttattgggcttgtatgtaaacatattaatatttaatatatatatatatatatatattaaatatatttaacaattaatcaaattcctcttaaacaatttgaagaagacacatggttgtggaagagaaataatgagggactattcactgataaagatgtttgttccttattgcataatgcatgcatcttctagggtagtggataacttattttcattattgtagaaactgaaagctccctctaaagctatttttttacatggagattggctcttaatagaacccagatatatgaccagttattgaagagaaacatcatcactcataatattgactctacatgcttgttgtatggactgatgctggaaagtgcaaatcaccttatttttagctgtgacttctcttatcatatttggcaactatgctatagttgcttggatttcaatcagttctgcctacaagttgttgtggcaatttttggagtcattatgacttggttaaaggtgtaaagtctcgaggtgaggtgtacttatgctcatttgggttgcagcaatttggtccatttggaatcaccgaaatgctgtcattttacggaaccagcagccttgtgcagagtatgtcattgaagaaattaagtctaaatcgtagggatggattaaagctaaatacaaatactttcgatctttctattatgaatggcattgtcaaccttattgttgggaaaaagataccaacttcccctttcaggacctgttatgaatggtcttgtacaagcaaaatactctatacacaaacaataattatgcaagcaacacaacataatttttaacatggaaaaccttctcaatgtgagaaataaaaaccacgggaccgatcttggagtccacccaaattcttcactatcaataaagtgagattacaaaatggtttcaacaaccattacaatcaacaaacaactttaacaaaagttgtaccaaaccatcacaagaggcaaacatataaaataggcttttgtaccaaattaatttataccatcataaaaaacaacaaataaatcccaatggtcaaactgacatattgcaagagaagaacacacggatcaaatttgaggataatccaacaattgagcaaagagataactctttctcaatatcaatgtccgaaacaagatagaatagagcaggaattctgataacctctatttgcagttgaaacaatccctcttggaacagttcaatgaatgatccgaatggtaataatgtagaaacggattttagtagggctcctcaaattttgaatacgtccaacggttaatgtgagagaaatgtccctcacaataacgctgcacgcttcagaaaatggtttcataaccgattcggtttaggaatttccggttatactacaagactctattcatgaaaccaaccgttagatgttaatattggtgagtcaagaaccttattacaaagttttaccaagatccaacggttaacagaagggatatagaagattaaaggatgatagtttctaccattctccacatgcgaattttaacggtttctttctcctctcctttttctctctcttgtggtttcaaattaaccggcaacatatgaaaagaagtaactgctggcttattaaaataagaaatttcaatcttttcttatttggctggacttggcttaggttcaagcccaatacttatgccttctgcaagttgcatcactttcaactagtagtgtaggattggaatatattgtactgtagttgttaattatgccttatggtaattgttctatttgcactggtggtactatagcttgtaaactttgctggtgtatagttgtattctgctgttagatcacttcatatgaactctaacatgttgataaaatttaatttgttggctgcttaaaaagaactaatcatcatcgaattggggtattatttaaattaaaattcagaccatgagtaaaattcaaaattgaaacataattaaaattactcaaagatttctcataacgcaaccaataactattaaaaaaagaaaagaaaagaacataaacaagacatgaaaaaatgcagaaaaataaataaatacaaatggagtcttgacgagaaagagaaaaattacatagatgagtgtgcaacgttgacaacggagaatggacttttaaataaaatatccctaatcgaagataatttatattcgaaaaagggataatataatccttttttttatattattaaagctttacccctaggtcagaaagtaattagattcccgacctatcatttccgaaaaacaaaaaatttatcatgtaccaaattctcccaaagtaaatattagaagaagaatgctaataagactctctatctagtatttcgttttgaatactctttataattagctggtttttttatatttaaaataatcaattttgatgggtcacattccttatgatatggctctttcccctaattaatttagaaattttcatccaccaaacttagttatttcctttaaatttcagttaatgataaagaaagttaaaaggagagtattaaaaagaatataaaatttgcatttctcatattataatcagatattccgtatgatccaatgtcctcttcctatttttattttctctcctctttttctattccaatattctgaaggatgtaaaagacctggtataatggtataggaaatgaatggtggactaatacataaacctaaattgatggaattaaatcgtcatatattttcaaactacagtattttctaaattaataattaacaggcagcatgggtggaactacgtgttcataggataaataggcatttttgttcctggatatatagagacctgacaaattcgtccccgaaagatgaaaatttaaattttagtcctcgaaagtgcaaaaagtgcaacaaatctattcatccgttaacttctgtcgttactgttaatgaaaaaaccaatatggcacagagggacgaaaatgtcacaaaaataatagtcaacatggcttcagaatagattggattcaaatgtcagtaaattttcgtttaacaaaatgttagtaagtttttattggacaaatttatcagatcccaaattttgtttcatttaagggtaaaatacaatttagggtaaatagtcattttcgtccctaaatatgtagagcactaacaaatttgttctgaaagatggaaattcaaattttagtatatccatttactttatttgatacaactatttgtttgtcttctcagatcattgacacataggatattttgtctaatggaaacttactaacattttggtccaatgaaaacttactaacattttagtccaatctattcaggagtcatattggtaatcatttttgtgacattttcgtccctttgtgctatgtaaactctttcattaacgataatggatgaatgaatttgttgcacttttttcactttcggagactaaaatttgaattttcatctttcgaggacaaatttgttagtgctctacaccttaagatatgaaaatgactatttacactaacacaatattatcaaatgtctgaaagtagtaaaattgattcatttaataccattaacataatattctaaaatagactaatataaattaaagaaaaatatttttaacgagatttactataatagtctgaatcacaactatttcctacaaactaatatcttgcaataaactttggtgaaatcaaatttgttacaaccaaatttgctgaaacaaatgaacaaaatatgattagttaatattataaacatttgtcgtccaacacttggagtccaatattaacattatttaaagcaaatcaaacaactctaaaatttttgatcggttttgatctattcagttcggttttgatcggatctatatatctaaactcgtgatctaactcatacataaacgattttgatcagttcgatttaattttgaccaaaatatataaatgatccaattcaaaccgtctaaattaatttgagtcaattcgaacttacaaatgacatgtacccgtgaacagcattatttacaggcgcagccaccccctatgaatctgaaaattgcttactagcaggattggaaaaagtttcgccccctcttccttatttatttattcttacataactcctaagtcttaataattagttatatatctcagttaaaaaaaagtgtttgtctgtctatatattaagaagagaaactcttatttattcatcatttagcaattatattacgtatactttgtctattagatatttggctaataaatattatacaatagaataatattatattatttagcttttaaatttctattcttaaatattgttattcttatatttaaattattgtctttagacttttataatttttattttattttaatttgttagattatttttcaacactatttttatgtttgaaaaaaaaaatctaaagttaaacttagctcagctttatgttctaaaactacttttaaattctttaaagttgattacatatgaaatttcttttcattgggtatatggtcttttattttttattagtctaaattttaaatggttaatagtagaaatctgttttggtttcaagttgaaaaaattattttgcgtctagaattgattttagatcaatttttatatatttgattttatgttgtaaaagattttaaaattaattttagatccaaaactgattctaaattgaaataactatcactagcttttatattgaatcataagattttattaaattttacttctgacttattgatacaataatgaaatcattcatatttaaatcatgttacttcaaaatcaattttaaccaaaattaatttcgtaaaatcaattttaattaaaattaattttataaaatcaaatttatcaatgttgatctaaacaagtgctaagtaatttgttgttgttattttagttactatgtgatggattttcgtccgctaatttattctggttccgctgtgttaacagggttggcctatgtatatatggcggttcaagttcctgttttagacttttagaaagaaaaaaaatatcattagtatttatataagttctgttattagatgatttagtatagtgataatttacatgtattttttttcttggtgaataaggttcaaacctagctgaaagaaaaaagtatttatatattttatagtgctcctaatttttgcttacttttattagttttaaaaagatttctcctcaaaattcaaatgtagtctcatagttataacacctaataattaacgttgcccaattaatctctaaaaagatttgatagttttttttccagcaaaatactaatatcattaagtaaacgggtgcaagagtaacccaacccatgtactcaaaaggattggatagtgttaattgaatagagctaaaattatcttagtttaagagtgcacaatttgatgcataaataatctattcgcctcacaaaatcacacaacatgcatctcaaccttcttcgtaataaaaatctgtcgcgtctcttgtaataaattaagtagaactgtgagaagctaaattggggatcacgaaatacatgttacggaactcctttttatcttcttcccaaagccatatattcaaccaaactctttgtatttacttgaatttaatcaattctcgttcccctctcttttttttctacccatccgtcccttgcccacataaaagcaactaaaattcgttgaaccacgggtagtttaattgaatttaagttcacaataaatctggttgataattggtgttcaatcactattcaagcaagccacttaagaaaccattcactatatatataaaggctacaagccactttgtttctcaacctcacttgatcgattctccaaatacctaatatggagtttcacattcttgccatcattacttttctcattgtgagcccctactcttcacacgcattcatttttctttaaatagtagtggttcaatttatctatagataaactatttatttaatctctatagttatgtctattttaaattttagttcctatacacacaataaaattgtaagttttaatccctacgcaatttttgtagcaatttatcactactagaaagtttttgtagctattttatatcattaaaatgttttatccagtgttaacaatagggatcaaatcttaacttttatacgtgtaagatttataattttctcatgtaagagctacaccatttcccttataaaagttaaaaactaaaactaaaataagcacatctatagggaccaaataagtagtttgtccattatttattttctttgtatacttctaagtctctatttgcatgtgaaaatgattgtgtgatatggcaacaaaaaaaatgatcgtgataagagaaactgaagaggttgtgttacgaaatgcagcttgtcgtggcaactaatgctgatgctgcattacctcctgcattttactggaagtccaagcttcctaccacaccaatgccgaaagccatcactgatttgctacaccctggtcagattattggcacttcttgtaggctttacatatgcatagaatattactttcgattgcttaatttgaagttctactctatcaataatttagcacaaaagatcattaaataattaagaacatttcacaagtattttagttcattcacttttttttagtttatgcacctcaatatctctgttttatatgtacagacactagacagggtatgttgtgaatacgacaggaacacgtacctagtaggagggctacaggctagtcctgttgtgttaagataaaagagaaatattaatctagtcctgttgtgttaagataaaagagaaatattagccatacaccttttttaatacaccatttagagaaatactaataacactacattatcactgagttgcactttcttttatgatcagatgaaatccatgtgaattttatgaaatatgtgggtctcattttcggtggatcacattctcaaactaaaaagacccacattaattttattactcggaagaagtgtgttccaaagagctgtcaaaaaaaaaaaaaatttgtgatccaaagagatagtccgttgtacgtaattacgatacagtaaagcataaagcgtcaaatattaaaataaaacaagcaatagggctatggcctgatggtttattttttttaaaaaaaaatctcttcttatatttcacaaatgttcatattaaacagacaatagaatgtattaataatgaaaacggtgtccaactaactatatatctaatagttaagtgtatataacggaggtgttcaaatatcattactcatttcgatgattactcttttttaagtgaaacctgaaaaactatgcagattggaaggaagagaaagacacctctgtggatgtagggaaaggtggagtaaatgttggtgtagaaaagggaaaccaaggaccaggaggtggcactgatgttaatgtgggtggtggagacggtggagtgaatgtgaacacaggaccaaagggtaagccagtgcacgttggagtgggcccacattctccatttgattacatttacgcagccagcgagacccagttgcacgatgaccccaacgtggcactcttcttcttggaaaaggacttgcaccacggaacaaaattgaaccttcacttcactcgctactatacctcaaatgttgatgccacgttcttgcctcgatcagtttctgattccatacccttttcttcaaacaaggtgatgatgaagaaaaaagtaatagaacaatgtacatagataccagattatagcatgttagtatagcaatagtgttatcgaacactaacctatattcgcactcatctccatcagtggtttggtgggaaaaactgttaattcctcattggtagggacctctcaatggactatctactaatgatggactcaatcatcactaatgatggactcaatccatcacatgatcaattttatcataattccacccaaatatccgtaatctagttaaatagttattatatttttaactgtcaattgatgattaaaaaagataattgattgatattgattcacacaatttttgaacaggtgaatgatgtattaaacaagttttcaatcaaggaagggtcagatgaggctaaaactgtgaagaacactattaatgagtgtgaagggcctagcattaagggagaggaaaagcgttgcgtgacttcacttgagtccatggttgatttcgccactaccaagcttgggagcaacaatgttgatagtgtttccacagaagtgacaaaagaagatagtgagttacaacagtatacaatggcaccaggggttaagaggttgggtgaggacaagctagtgttgtgtgtcacaaggagaattacccttatgcagtgttttattgccacaaatcagaaaccacaaaagcctattctgtcccattggagggtgctgatggaagcagggtcaaagcagttgcagtgtgccacactgacacatcaaagtggaatcccaagcatttggcgtttcaagtgcttaaggttcagccaggaactgttcctgtctgccacttcctccctcaggatcatgttgtctttgttcccaagtagaaacacacacgagtcccatttgtgatgttggtgaataatttggcagttttaatagcatgaaatgagctataaaactaaatcgtagtattgcattatgttatcctacgttgtcagcatgtttgcttttacaggtttacgcctgttatctcaatatatgtactagtgatgtattacatgtgctaacatgtgatatatatgaagctttttcattcacatgaaattctgtgtccatggttttcgggggtggatgttgttatttgcacatcaatgtttatttcaccaaatttacctatttttatgagaaatagacaaagcatgtgatggaatgtgcatttgttttggtattctatcatctagaaaggaagtgaaatttgatatgggaattcaataaatcactaaacaaatgaaaaaggattcgctttacaatagctttgaatgatacaatggggagagaagatcatgttcatttttctttccaactcaaccctacaaccagatacttgagtatatacagatccctaaaaaaaattgtattcttatcataaaaaagggtttaatgaaaaatagcagtgctatcagtggctaggcactgaaactcattttattttgaatgacatggacacatcaatattacaaacactcatttgacaccctacctggatcgttttcttctcatgtcacattacttgtgacatctatcacttcgctatcttctatttctttttcagcatatgggtgtacacaaaacattacccttttgtctattactcagcgaggactccagatactatacaccgtaagcctcttcatcataattcttcccgggcattcggataattccccaccataccaaacctcgaatcaattatggagaatgcatcctccaaatactttatccttgggtcacaaaaagaacctttgtgcttcaggattcagccacaaagtggcatcattgaatttattggatgtatatggctccaaagatccccatgttcttccaaccttaagtttgacatgcaaaggaactgcagaagcataaatgtaaatattgaatttttttcaccatacaagcaaaacttcaattcattttaccaacctccattttcaacccccccccccccccccaaaaaaaaaaataaaaagaacgaaaaaaagtcccaaaggaatatatttaatggaatacgaaccaagaagtgagaccgcattctccatacttgtctgtaatagtagggctgcttcttttatcacataaggatcaacttccaacactaattcatcgtgtacctattaacaatcaatataactatataagtagtgaaacaattaaacaaacaagattaagaggatacaaatcctctaaaatttacctgtaacagaatccggcaacgatctttaagcatgtgaaacttggttgctagtgaagaacttgaatccggactatcaaatccagtgacaattgcagagtaaattcttaacattgcaatcttaattatgtctgccgcagatccctgggaggggtagagggagatgaaacaacacaaaatactgacatgttctgaaataatcattctcaaccaggaagagagagaaaattatactacacctgacaaatggaatttacagcttgcctctgagcttttgatttttctgtactgctgccatattttatttttgacaaaaaccgttttcttcccttaagagtctccacatatctggatcatgcatatagaaatgaatccacaattcccaaaagtaacacaagtttcactagaatgtataaacacagtgctatagtaaatcaccttttatcattgataagcagtttccaatatggtttgatgtagagatcacaaacaacaatcaacttgtgcaaattaagagattacatattttaaatattaagaaaaatatcaatttgtaataagacaataatatcttaaatcctacaaaaaaatatcaatttgtaaaaggaaagacaaaaacagttgcagaacaagagtatcttagttattgtatcactgcaaaagggatatttgagttgggatacgcaaaagtggaacaaggtctccttaccctttactgcgacaagacgcaacagcttcaagaagccaggaagcaacaccaggaaaagagcttttgaagttagcaatcttttcaacagcttcatcagaagtgcaatccaattgttctgcaaggctattggcccccataccataaagaatgccatacaccatccttttggtctgctctctctcctgagaacacacagaaacctcaggacacccagtccatcttgctgctatcattgtaaagacatcaccatcaggcttactgagaagttcaacaagtgaagagtctttagagaagtgtgccatcaatctcaattctatctgagaataatctgctgttaacagtaaccagttgtcctgcaattgaaagaaataaatgaggatagaccacaggtacaccaaatatttaaaacacataaaaccagaaagttacatagaaaattaaaggaaaaagcagagggagtgatgatggattacaaaacgacagttctgtattccaaactctaggatgacagtaatgtgcaaaagataactgctggtagttttgtattataaactgcaagatgtcaggttatgtatacaaaatgacttctggtagttatgcattaaaagtacatatgtgatagtaggttgtgtaattaggagtgtgttaggcaagaggaatcatctactatagctaagtcgtggctagtgtacagtaggaacaataagatgaggagtgacagttaggttgttgagagttagttagcctctgccatctgtcagctaggttgttgggagttagttagactctgccagctgtcaacactcaacagctggcaggttagttaatagttttgtataaatagcatcgttctggaggagaggggaagaaaggattgtattgagagaacctgagaagtgtttcagtgttgtaagggaaaagagtgttcttccttgtgtaaagagtgaaagaactacaataacagtgatccctttatttctgcgtgtactgttctgtgttggttcttgtgtgcatctgttctacctctagttgcagttagtaaagtggagaagatttctaacaattggtccaatttttcgaagaaagaatcatggatcgtgatgaggctcgatcaactgcactggaatcttcggttgcagcattgaaaacaacaaccagttaattgaaggcggacgaccactgagttgcagaaatcatccaagaaacaaactgaggtgcttgcgaaggtgttgaaatagtgcgacgacattaagatttgcgcaagatgatgaagattctcatggaacaaaaaggcatcgcgtataatgaagccaataatgcatctaaggagcagaacagtgggttggaggatgaggagtccgcgacggaacccgagctttcatcagtgttggaggacaaagcaagcgagtctaaggaagagtccgcgacgttaactacagcttcggtgctagcaatgccagacttttctcaaccttttgccattgagtgtgatgcttcaggcaaggggataggagctgttttgtttcagcagaagagggtcattgcttatttcagcaaacctttatcagaggcatccttgaataagtcggtgtatgaaaaagaattgatggctttggtcttagccatccagcattggtggccttacctggtgggaaaaaaaattctggtgtatactgatcaaaaaagtctcaaatacttgttggatcagaggattacaactcagagtcaacagaattggcttgctaaattgttgggatatgaattcgaaatcatctacaaggccggtgcaatgaatcaaatagctgatgctttgtctaggaaggaaaatgataaagaaatacaggccttatccaaaccttattggcaagatatctctgagattgaccaagaagtattggcaaatcctgtttgggggaagataatagaagatttgaaggtggatccggattcacatggcaaatacaccctagagaatggaagattatactttaaaggcaagctggtactgccaaccaattcaagctggatcccgcagctttcaaggaatttcactcttccttggcagaaggcaattttcagaggtgtacagaacttatagaaggctagcacaatccttccattggaaaggaatgttgaaaactgttacagacttggtggcagcaggctatatttgccgaagaaagtacctcacttcttcaccagccggttttttacaaccattgccaatccctaatgctgtgtgggaagatattagcctagactttattgtgggattacctaaatctaagggcatgatgctattgttgtagtggtggataggccaagtaaatatggtcattccatactattgaagcatccctatactgctaggagtatggcggatatctatactaaggaagtaataaggctgcatgggatcccttcttcaatagttagtgatagggatacattgtttttgagtaatttctagcaggagttatttaaaatacaaggaacaactttgaaaatgagtattgcttatcatccttagtcagatggccaaactgaggtactaaacgaacctttgagacatatttgagatgcttctgtgtcgaacaacccaaatcttgggctgagtttatcccatgggcagaatactggtataatacatgttaccaaggagctgccaggtgtaccccatttcaaataatttatggtcgaccacccccatctttggcaaggttcattccaggggaagtcctggttgaggcagtggctcaggatcttatggaaagagatgaagcacttaatcagttgaagtttcatctaaacagagctcaaaatcacatgacaaattatgacaataatcatcgccaagataaggtcgcatagacaagcttcaattcctataagattaaatcctaagctatcagcagacactatggcccctatcagttaaacaaattggagcagtggcatttcagttacaattacctgacactgctcgaatccaccctgtttttcacatttcccgattgaaacttgcagtgggagaacattagattgaggaagaattgccaaaggaactacaagctgaagaaaaagggatatgactggaacaagtactgggagcaagaatgtttggtccagcaggagcagaaattccacaagtattgatcaagtggaaaggacagcatgctgaaggagcgacctgggaggacagatcaaatatgctgcaacaattccccgctttcaaccttgaggacaaggttcttttccaggggggaggtattgttaggcaagagggatcatctgttgtagctaagtcgtggctagtgtatagtaggaacaataagatgagaaggagtgacaattaggttgttgggagttagttagactctaccaattgtcaacagctggcaggttagttagtagttttgtataaatagcatctttctggagaaggagttgggaagaaaggattgtattgagagaacctgagaagtgtctcagtgttgtaaggggagagagtgctcttcgttgtgtaaagagtgaaagaactattaataacagtgatccctttatatttgcgtgtactgttctgtgttggttcttgtgtgcatttgtcctacctctagttgcagttagtaaactggagaagattcctaacagagtgtgaagttatgtgccgtttgcagacagtaaattctctttgtaggacacttgtcaatgggatattgtaagagtattatttctgtaatattgtgtgtcaagaatgatcacactaagcctctatttataatcaaaggagtaattacaaaaaggaattaaatccctaaaaatcagctagagagatatattccatattcctagtttccctatttacattaaatcaaatcatatcattgacactccccctcaagctggagcatatatgtcatatgtacccagcttgttacaaatataatcaacgcgagaccctttgagagatttagtgaacatatctgctagttgttcactagagttgacaaagtcagtggtgatttctcccgaaagcactttctctctcacaaaatgacagtcaatctctctgtgtttagttcgctcatgaaagaccggattagatgcaatgtgaatggcagcttgattgtcacagatgagcttagtgtcccgcgtgtctccaaagtgtaattgttggagaacttgccgaagccatacaacttcgcatgtagcagctgccatggcacgatactcagcttcagcgctagatctagcaacggtattttgtttcttgcttctccatgagatcaagtttcctccaatgagaacacaatagccagaagtggatttcctgtctgatggtgatcctgcccaatcagcatccgagtaacagacaattttcgcattacctttgtcttcatataggagtccgcgaccaggtgcattcttgatgtatctgagaatacgcatgacagcatccaaatggctatcacaaggagcattgaggaattgacttaccacgcttactgcaaatgagatgtctggcctggtgacagtaagataattaagtctacctacaagtcggcgatatcttcccgggtcttccaatggctccccctgacctggaagaagcttgacattcgggtccataggagtatcactggggcggcagtcaagcataccagtctcggtgagaatgtccagagcatatttcctctgggaaagagcaatgccagaggcggattgagcaacctcaatgccgagaaaatatttgagcggacctagatccttggtctgaaactgactgtgaaggtgagacttgagtcggcggataccatcaaagtcatcaccagtgataatgatgtcatccacatagacaactagataaatacacagtccagaggaagagtggagtgagaaaacagagtggtcagcctcagaacgggtcatactaaactgaagtaaggcggagctgaagcgaccaaaccaggcacggggggattgcttcaagccataaagagagcggcgaaggcgacagaccagaggggcaccaccagaaacactgaaaccggggggctgatccatgtaaacctcttcttgcaactcaccatgcaggaaggcatttttgatgtctagctggtgaagtggccaatggcggatggcagccatagcaaggaaaagacgaacaaaagtgatctttgccacgggggaaaaggtgtcgccgtagtcgaggccaaagatctgagtatagcccttagccaccaagcgagctttgaagcgatcaatattgccatctggtccaacctttactgtataaacccagcgacaaccgactgtagttttgtcaggaggcaagggaactagctcccaggtaccacttgcctctaaagcacccatttcatccaacatcgcctgttgccaacggggatcactcatggcttcacctgtagacttagggatagacacagaatccaaagaggtaataaaagaaaaataggaaggagacaaacgatcataatgaagagcataagcatataaaggattaggattgcgggaggaccgaatacctttgcgaagggcaagaggaagttcagactcaggcggcggtggtggatgagcgtttggagtaggagatgatgctgtgggaccagtaggtggaagcaccggtggtctgcgctgataagttacaagtggaggcggggcagggatgactactggagctggaacaataggcggaacatgcagatccagaggagcagtgggagtagagaggaaaggggtagactcaaagaaagtgacatcagcagaaacaaggtaccgttgaagttgaggacagaaacaacggtatcctttctgaagacgagagtaacccagaaaaatacatttaagagacttggcagagagtttgtctttacctggagtaaggtcatgggcaaaacaagtgcaaccaaacacacggagaggaacaggataaatgttctcttgaggatatagaagggagtacggagtccgattattgaggacggacgagggcatgcggttgatgagataataggcagtaagaagtgcatcaccccagaagcggagaggaacattatagtgaagtaggaggttgcgagctgtttcaactaggtgacgattttttcgttcagccacaccattctgttgtggtgtgtgagcacatgttgtctgatgaataattccttgtgaggcaagaaatgactgaaagtgggaggataaatattccctagcattatcagtgcgtaaggttttaataggcgtcccaaaatgattattaatttcattaaaaaaggcttgaaaaacagagaaaacatcagagcgatttttaattaagaacacccaagtgcaacgggaaaaatcatcaataaatgtcacaaaatagtaaaagcctaaagatgaacagactcgactaggaccccaaatgtcagagtgaactaaagtaaagggtgacgcagcacttttattgactcgtggactgtaagaagaacgcacatgctttcctaattgacacgactcacactggaaggatgtaagtgtagaaagactaggtactaaaagatgtaatttttgtatgctgggatgaccgaggcgctggtgggcaagatcaggagaggtactagagacgcaagcaaccaatggtgaaagctagtacattccccaagactcatgtcctgctccaatcgtctgtccggtacgccgatcctgaataagaacagagttattaataaataaaacggagaaattaagagagcgagtgagcttggaaatggaaattaaattaaagggacatccaggaacaaataaaacagagttcaaagaaaggtgaggaagtgggtgagtttgaccaatgccacggactttaatatgagagccatctgcaagagtgacagaaggcaatgagtcggaaaaaaacaactgagagaaagagattggttaccagtcatatgatcagaagcaccagagtcaaggatccaaagtccaagggtggaagactgagaaataaaagctacaggattaccagagtgagccacggtggtcgcaggcgaggcagattgctgggctgctcggaactagaggaaatcatgatactctgtggtggaaatagtaacatcagtaggtgcggtaacttgggccacattggccgtcttcgactgctcccgggctttggtgcgacattcagcttcgacatggccaaagcggttgcaataagtacaacgagggcgacttttgccgccacgactcaacttctcgcaaggaattagaggaacattggtaaaagtgaccatagagccggcatcaccaaggggactggtagaggccatgaggaagatattagaaaagggctggacaaaagttttttttttttggagtgcgtgcagcgacgtgtggcggcgcgtgggggcgtgtgcggcggagtcaggtggcgcggtttgggagctgggtcgtcggagggaggcgatcctacccctggaggtcaccggcgaaaaaggcggcctggtgagagggaaacggtgttgaaggctggcatggtactgttcacaagcgagtattgttcatcgcagccaggaaacgctaaaaaaataaacctaaagctctgataccatgtaagagtattatttctgtaatattgtgtgtcaagaatgatcacactaagcctctatttataatcaaaggagtaattacaaaaaggaattaaatccctaaaaatcagctagagagatatattccatattcctagtttccctatttacattaaatcaaatcatatcattgacaggatatattgatgatgggaagggaaagaaagggaaagttgccttcctctagttaaaaagatttaagggaaatgttcacctttttagagagatagggtggaacaaaaggcataaaagtttaaaatcttgggaggtaagggaggggatgttccctctgttcaaaagttcatgacacgggaggggaattctttttgtcttgtttgggagttggagtggaatttaaatttcaaataggcacattaaatcactatatattcctttttaattttatacaccttattatacagatggttaattgcatgtgaagagatttactctacagaaattcaaacaccatataaaaaagaatatcttatagtaaatcattttcagtactgaaagtgctttctagttttttattttaggaattcaattgagtgtttttctgtacctttgcaacaaagatagtcttgtattaaatgatttttcagtacacacgtgacattagttttattgcattcaatggtagtaaaacccatccgagactgacaaaaaaatgtatatgaaactgggctattttatttttaagagacaaactagcatatatgaagtatcattttatacttatcaaaggatgataataataatatataaaaaaaaaaaaactgttttatttgtttaccacttttctctctcattcttttagaagagacaaaaaattattttgcatcatagctctaactatgggacgtgagacctatcccaaattttgtcgttcatttctctcattagaccagaaatacgaagagaggtgagggcattgagttctcttgaaacccttcccccttagttataaaattcccaaaaataaagcttatgttccatgctcaattgaggactacatgattgaaataagctttctgatcttgacgagaatttttttacaaaagcaggcataaaagttccatgattgaaataattttgtggttattttagagaaaataattgcgtggagattaagataagaaactcgcattaataaaatacaatttagctttttgccagagagatggactgtggaagcaaggtatttgctgtgacaattgatggagagatattgaaggaatcaaaaagtcttacatatatgatcttcactatttaggaaaaggctggctgtcaagataggtgtcttgcactaaaagcaaaaccaaagaattatcaattatgggtattaaagagattctaggatgcaaggaccaattgtaaacaggaaagtgtcttctaaaaccagagcctgcgatcaagcaacagaagtttgttttgttttgctttaaaagtgactagaataccagtaggtgtcttgcagtatctttacaacattaaaattcttttcatgatatacaccaatatttcattttgtcagcgtgacattggaaagcccattttacaatatcagcaaacaaagtcttagaaagtggataataggtctaactcaaccctacaaaactggcttataaagtgacgtttgcacctcacttatatacactacttggccatgtcactagtcgatatgggatctccaacacacacccctcacgtctaggactggacatctgttggtggtcctatagcaggcagcacaataggcccaacaacagatcactaagataggctctgataccatcttaaaaaatgggttataggcataactcattcctacaaaaccagctggtaaggtgaggtttgcacctcacttatatacactaactaggccatatcactagtcaatgtgggatttccaacacaaagaacacaagtacagaagaaacaaaaaagtaaagttaaaagcctatcacctgagtaggaacaaagaaatcacgagcattaattctacaataactctcatcagcatcaccttcattttcctcctctttcattttgaagtgtactgcgtgctcaacacactgcagcactcaacaagacagtacataacattaaatgtaataaaccaacttcaaaagtttaagctattaggtgaagacacatgaatcatttatattatatttcaaacatgctccctcattcaagagccctctggaatttatgcgtacacaatggacaaaccgcaaacccatttgccttgtcttgaaattaaactcttcattattagaaaaagaggacatttcacctttactccctgagtttttagcgaactgcgtttgatacccctctattatttgaccctataaaaaccccccaaattattaaccaagaataataccgtgtacccctcccacaaaacgccattgacactttactagaaaaagggcctaccatttcacttgcacccagtgtttcctgcaaattatgccagatactccttaattttattaatacaatacttatataataataaatcattgagtaattataacaaaagttaatgtgtgtatgtatatatatatatatatatatatatataaattaatatgtatatatataaattaatatgtatatatataataatttctttcataatttctttcgactgcagttaacatgttcattgacagtgttataataaggggagtgttataataaggggtaaaagtaatgtcaaataacggatgggatcgggcgcaagttgcataaaacacacgaagtgcaagtgtaaattacttttaaaaaaatgaaagcaaatagcttcatactctggactacttggttatatagaggtttttataccgtttcatacggtgaagaaaattgctttatattgtatttctaacgttaaatatagcagttaactgaaagaaaaagaaaaagaagacatgttaataaaataacccaaacctgaagattaggttcctccattgaaagccgaccagttgccgtggatgtctggagccaatgaccatgtaatgtatacttctgtgtgcttacagatagcctagccagcgaacaaattgatcctaacgtagagttcaacagctttgccattgttcggtgttctttaatgactggaacaatgggatgttcatgcctgaaataataatcaaatttcctagaacacggtttgcaaaaaaagaatacaaatgtaaactcctacatgttgcacacaacgcatattagtagagctgaaaagttatagaacttttaaataccaatcataaaaacatttgtgtaacctccagcatagtaaatatacactcatccagagtgtctacattttagttattcgggagatataatgaatattaaaaaggaaattgaatatttttttcatagatatatgaataactagagaaatgaaagggaagatttcttggttactagaaactatgaacataatttagttgtcagagatgacagtaagtaaccgccatacaaacatattacaagttgcatagcaccaatcctttctaacatgcttcttttgttgcccagttttaatattccctatgaccatcaagaagctaaaggaaaattatgcaaatcacgtaaaagagctacaattacattcaactaattttcttaatgatatgaaagcacagtcaaatgttttatatctgttagttagcatatttaacacatgataaatatataagtagcagttgccaaaaattagggatacagttactataacttgggatttgctttatccttatatatttaatatatttaaaatttataactgagtcgtttgaacatattacacacattcagatatattgcttctatatggtattcaaatatatagtaattgagtcaataaagtgctttgtcaccttttgctttggttcactctaatatttggggtccaatcctgtctgttcaactttaggttactattattttgtcaccttcattgattattttttctgctgtacttggttattcttaatgaaaaattgttacggtgttcttaatatatttcaaggtttctccactgaaattcaaaatcaatttggttcctctattaaaattttggacaatgcacgtgaatatattgtcttctcagtttcaattttttatgacttcacagcattattcatcaaacaacttgtgcactgctgacacactacagcaaaatcaaaagaaagaattagcacttggactactcctacccttcttcaccataatgttcctcttctcttctgaagtgatgtgcttctcatggcatgttatcttatcaactgcataccttcctctgttcctcacaatcaggttcccaattctctcttatacaaccaatctattgggataagacctgattgtggtacttataaaccccctcaatccacacatccttttgtagaggttaaaaatcaaagaaaatggatatctctgtgcaatatgaaactagaggtgtggactttgatatgcaaacctaggagtggtcaatgtcattactcttgtatttataatctaaagtgactactaacagaacaagaaagcataaaaaatcattaaacagattttcttttaatatggattatgggatacaaatgggaaagggaaagttgtttaatacctcagtgcatccaaacagtgcttgctagtactcggatgttgttttcccttattccgcacatcaggtatgggcagcttcaagtgttcatacagcactttagcaatatctgctggcatatttaatgaaaatgtcattccagccagtttataagcttccttctcaagatgctttagccttttaatcaacaatttacgagcctggatgcatctctccaaatcaacaccaattccccaaagctccatgtcagcaagaacattcacctaacatagaaatgttaatagcatcagatagtccaagcaagtaacctgttaagatcccacattagcataggtataaaggcaaagtatcccttataatgactttggaagtcctctcccttaaactagctatatgggttgattggcccaatgtattctcggttataatataatcatttaaattaattgtgtacataaaatcataaagtaaacaagaaggtaacttggtatagctaataataatcttactccgttttccttgattccttttcctaaaccgatcacattctattgtaatatgaaacttcttattcattcattcggattgaaactcaaagggttcattatatacaactagttctaatactctagaatatcccaccacttattctaatactctagaacaaggttgttaaaatcgatattttacctaggatcgggaggggggatgaaagatcgtaaatcgaggatcgtaactctgatcgagatcctacttcaatacctaaaattcttatatataatctatatgcataaaaaactcaataaataaagacacaaacctagattcatatataaatttataagtcataacataataaattcataagtacataacacaactcaataaaaatttataatatttttttaatattaaataatatttttttatagagagaatatttcatattaattaaaagatgggctgcttgaaagaatttaactgaacttgcatagcattgcaatgaataaataaaagattatgttaatgaaaaaaagttaaaaataatcatttggtccttataaatgaaactcatttaagaatcaattcttaaatgaaaaaaaaaatgcatgaaactgatgggttaacactcatttataaatggtcacaacaaccgttacgttaacaacactcttacacaaacccacccctaaatatcttctatgataccaatacgacaaaacaaaactcaccatgtgcatcagtctccaaaattactccgaaccaaaacccgcatttctttagtcttcaattcaatggcttccacacccttctcccctctctgccacttccacaaacccaccctttgcttcttagcttccaacaacccatatagaagtatagaaatagaactgtttgttcttttttttttccctcaaaggaaaaaacgaaaacaaaaaaacaaatttactgcaactgcagggagaagggagaatgcattgctagtaacctgaggggaggtcgacggcacagggcagctagtcgcactgaggaggttgtcggcgcacaaaaagcagctgggtcgcgcagggagatcatcggtaaacagtagctgggtcgcacaaaggagcaacgtcccagcacagcaggggaagtcaagcagaggggcaaggtcgcgggctcgcagcggcaaggcaaggtcgcgtttttttcgaaacgaaggtaaattttagggttttaaaatttgggcgtcgagcttgcatcgttcgggatcacagatcccacgatcctactcgagattccactccgatcttgctcacggacgatcccacccccgatccagatcactttacgccgacaagatcgtaaaatcgtgcgatttcacgatgtagattgcgattttaataacagtgctctagaatactccacaactaattctaatacgcttagaatattccacaactaattctaatactctagaatattttacactcccctcaagttgggagatatatattaatcattcccaacttgctaatcaaatcctcaaaggtgggcttgtgtaatcctttggtaagaatatctgttgtctgctctttggtaggtatatgacaaacatacactaccaccctccaatttttctttgataaaatgacgatcaacttctacatgtttagttctatcatggtgaacaagatttgagcaatattgacagcaaacttattatcacaatacaattcaattcctcaagaagtcttttttaaccagattccttcacaaataccatgggctatgcacaataccctaaagtggatcttcgatccattgccgagccagcccaatctgcatctgtatagatttcaatcatcctcttatgtctcctttgaaagaacattcctcgaccaagggtgtttttgaggtacttgaggattctataagctataggtgtttttccttaggagagtgcatgaattgactaaccatgctaaccgcaaatgcaatatcaggtcgaatgtgagataagtagatcaacttccccaccaacctcggtatggctctttgtcaacttctttcccatcttcaattcccaatttaatattaggatcaactggagtctctgttggcttgcacccaagcatttctgtttcttgcaacaggtctagaatatatttcttctaaaataaagaaattcctgccttattacgagcaacctccatgccaaggaaatatttgagaactccaagatctttcagttcaaactggtcagctaaacactgcttcaaaagagcttatctcctcacaatcatttcctgtgacaattatgccatcaacataaacaattagaataacaattttgccaccatcaaagtgtttataaaataaagtgtgatcagtctgagcttggaggaatcatcttcccttcacagcttgggtaaacttctcaaaccactctctaggggattgtttaagcccatagagagacttcttcaacttgcatactgaaccgtctcctttttcaaaaccagatggaatatactccctgaaactgaaactgaaactgaagggattgttttggaggaatagaatatgcccactgatgctgaggatttgccgattgcaataaggaagggtgttagaacatttacatagaggccaaggtatccattgtctcacttcatgtcctatgataaactgtccagcaatcatagaaatttgcttactcatttaaacactatcactatcccaaaaactgctaatgaagcactggatagcaaagagtggagagaagctatgaaagttgaaacagatgcactagagagaaatgaagcttgggagttggtaaaacttcctaaagaaaagaaacttgttggctgtaaatgggtattcacttttaaatataaggcagatgggacactagaaaggtataaggcaaggttaataactaaggggtatactcaaacagatgggattgacaaccttgagactttttctgctgttgcaaaaatgaactctattagaatattgttatctctagcagctaactatggatggagtctgcagcaatctgatgtcaagaatgctttcctacatggcaaccttgaagaagaaatttacatggaggtcccacctgggtttaactttgagaaaggaaaggtttgtaagctaaggaaggctctctatggattgaaacagtcccctagggccaggtttggcaggtttgctacggtaatgaaggcaatgaggtataaacaaagtcaaggagatcacaatttgttcattagccattcagcttcagggggagttactgcactaattgtctatgtggatgatatagttataacagggaatgaccaagcagaagtagacatcctaaaagggtgtttgttaagagtgtttgatattaaagagctaggcagattgaaatactttcttggccttgaggtggcacattctcgtcatggtattttcatctcccaacagaaatatgtgctggatttattatctgaaactggtaaattgggatgcaaactagtagaaactcatattgagcagaatcacagactgagtgaatctgttgaagatgcaaccgtggacacagaatcctatcaaaaactggttggaaaattaatctatttttctcataccaggccagacatagcttgtgcagtgggagtggtaagtcagctcatgcataatcccaaagaaataatcttagagatgtttaccgcattctgcagtacttgaaaggtactcctggaaagggaattttatttaaaaaaaggggagtaaaggcctatacagatgctgactatgctggatctgtggatgacataagatccacctccagatactacacatttcttggaggaaacataacttggaggatcaaaaaacaaaatgttgttgcaaggtgaagtgcagaagcagaattccgggttatggccttaggaatttgtgaactcctatggcttaaaataattctagatgacctaacgattgagtggaatggacctatgaagctatactgtaatagcaggtcagcaataaacattgcacataatccaatgcaacatgataggaccaagcatgttgaagtagacagacacttcataaaggaaaagttggataatgggacaatttgtacaccatttgtatccacatgaaatcagctagcagatgttctaacaaaaggattaagtagctctacatttcaatctattgttagcaagttgggaatggataacatccactcaccaacttgagggggagtgttagaatcccactgtatattgtatttccttttatagataggatttaaatcccataattaggagatttgattagctgcatattttgtatttatgaccaggaatcattgacccttaattataggaattgacagtagctgcattagtttaggagtttcattttttagattaccttgtattctatttaagagcacatgctcttctatcaatatcataagaaaattatcctttgagagtttttgtataatttcagttttattgaagtttccatgcaatatcaatattagattattagtatgtatagtttagctgaaagattatcaaaatcactttctataataagtgcttggtgtcaagatttacaatgttaatctaatccttttaagagatgccaccaaatatataaagttcaaaacataatacaatatttacattcttcagtgaaggtaaactacatcaataaataaacattaagtctacataaatatatcaatatgcaagataaacaattttttttttttgatcagcaaagataataatatatatatatatatgtaaaagaacgtacaaaaagaggtacaaaagtgatctaacataacatgacctatggcgacgtaattcataaggaatcatgaattaagcagccagaagtctggttaggtcaaaagaaattccccaaaacaggggaaagctatacaatatttctcccccttggtacaaagatgttacccatgttactagaccatacatggaaaggtatattgaatcccttttctagtgttctaacccatgtccaacatgtaaaaatggcatcatccataatcttgtgactattgaagctgtcattgtgaaagatgatgctattcctatgacgccatatggtccagtttaaggctatccaccatgtaatccaccactttgaacagatcccgactagataatagaaagaatgttgacaaaaatgttccttaggagttacggaccatacacctataatagaattccaagccatagattcccaccacagaggcctaattttgacacagttataaaagaggtggcctgcatcttcctcagtatttttgcaaaatggacataatgtatcattcataaccacattcctcctactaagatttgatttagtaggtagtctatccccaagcagtctccatgcaagtgctttaagaggagctcttgtattccaaagatccttgtgcacctgactttgctccagaggtgtcttttgtgcatatagaaatgagtatgcacttcgtacagtatatataccattaggttcagcctcccacaaccagacatcaggttgttgtgggtttatacccatttgccctacgtcttctatgaacttgacagcagctgctaattctgaatccataaaatatctcctccactgaaaatgccattcccatcccaagtgtgaaaatgtgcccatttgctgaatatactgatgatgttgtttggatatctgatacatgcgtgggtatttagccttcatagtgatcccctcgtttttccaatcatcttcccaaaataatgttttttccccaccaccaaccttccatgatatccccgatttcagtccacagcccccatcaatgggaaagcatgttattcgaagatctctccaccatatagattcaccgccaccaccactagcttcagccaaatttctccagcccccatatttggatgtcaatactttcacccataattcctcatgttgatgatgcatattccatacccatctcccaagtagagcttgattaaaagttggaagatctttaatgcccaaacctccacactccactggttggcatatcactttccagctagcccaagctatttttttctgttctgcagcacctcccagaggaaacttcgttgaatacgaactaatttattcaacaccttcataggcaccctgaaaaaggaaaacaagaaaataggcatagaattaagtacagacttaatgaatataactctccccccaaaggaaaggtatttccttttccatgcagcaagctttctctcacacttggtcaccaagggatcccacatctcacaccttctagggttggccccgataggtactcccaggtacacaaaaggtacttgcaggtttctgcaattaaggtatgatgctgcagcattaatccaatagtcatccaccccaaaagccgtaaatctgcttttggcaaaattaattttcagtccagatgccatttcaaatcccctcaacatagccttcagagttttgatatttttggtcgagcctttcccgaaaaaaatggtgtcatcagcatattgcaggatgctgatatcaactaagttgttccccaccttatatccttcaaatagatctttctgtaatgcttctcgcataaggccggtaaggccttcagctactatgttgaacaataacggagctaaggggtctccttgtctaagtccatgttgtggtgagaattccgcagttaggcttccattaaccaataccgaaatggatgccgattttaaacacccttcaatccaagtaatccattttggcgcaaaattcatccttcgcatcatgtagaacaaaaagtcccaatttactgagtcatagactttttcataatccactttaaaaactaaacagcttctgttattcctttttgcttcatccacaacctcattggctatcatcacgctgctcaaaagttgtctgccttcaataaacgctgattggcgataatcaatgactaatggcagaaccttcttcaatctgatggcaagcactttagcgacaattttgtatacacacccaatgagagaaataggcctatagtcgttcaggccaagtgggtcttgtccctttggaatcaaggcgataaaagaggcgttaccacctttagggaagaccccattaacgaaaaattcatccatgaatcgaagaaaatctggtttgagtagctcccaaaattttttgatgaacctgaaattaaacccatcaggccctggactttttccgttgccacacgcccatacagccgctttcacctctgctacatcaaacggtgctgtcaaatccaggttatgttgctgttctagccttttaaaagtaactccatccaggtttagattcaccctgtgaggtgcctcaaatcttcttttgaaaaatgatcgagtttcagctttaactctagatggctccacaatccagcttccatcaaccaaaacgcctttcagcaagttatgtctacgcttccagttcacagttatgtgaaagaaccgagaattacaatcccctccttaatccatttagatctggccttttgtcgaaggatagatgcattggatatggctgccttccacagctcttcctgcaactgttttcttctcacaatttcatccgggtttagttgcctatcctcagtttcagtttctagtttgttgatttccgactcaatagtctcccatttctgctgcgagttccgaaactgagatttattccattctttgagcttcattttaagttttttgattttttctttgagagcaaaacccccccaaccatatatcacagtagaattccaacaatcattgaccatctgatagaatgacttatcctccatccagcaatccaataccctgaagggtttagggccccaatccacagtacatgagctgagtagaacaggacaatggtcagaaaaatttctatccaggatggtctgggttgttgcaggccatttatgtagccagtcagctgagactagagcacggtcaagcctactctttgcagtcccattaggtctgtaccatgagtatttacgtccattgcaaggcgcatcatccagctcaagctcgtcaatccatttgttaaactccttcataatgcccaagtatgcacctgtatgacctatacccacacgctcttgaggtcttctaatgctgttaaaatctccaattatgcaccatagtccctccaattttgcaaacctcaactgctttatactttcccacagctgtcttttctgtgcagtctcgcaaggtgaatacacattgacaattgtgattgtagaatcatcggaaacccatttgccctccaaatataaatatccagcatcaatcaccttgttcaccaacttaaacgtattattattccacaaacataacaaaccaccaactctgtttactgctggattatattcccactgaacatcattatctccccataaagcttgacatagcgttctgtcaataatatcttttttggtttcttgcaaacatatcatatccaccttttgtgataccatcaatcgcctaatggctgcccacttaatccccccaaccccccccccccccaatcctctagtattgtatgagaggatcttcataattgaccactactgcttcccatcctttgtttctcagccatatctctgatctccaggagtgctatttcatttactacctctgcttgattaggactgttaaagccatcagttttgctatttcccattcttctttagcatctttcttccattcatccagattaggacattgggatgatgaggaagaatgcggatttatatgaggttgttgtttttgctcccataccatcacatctttcagcccattgctgggagatatgcttggagatgtatcagactggggttgcacaatgtatgccactgttcggcccttactgagttgcgaagggctattgccaagctgaggaacctccactactttagaccctattagagcatgtaagtgctgttagcttttgctaacagcactcctttgtaaataagctgtagttagcaattagcaaggtgtagttagtaattagctttttattttgcacacctgtatgttcactgaagctgcaatgcacagctgtcagttttcatctacttagtggtgagaggttataaatacctcacatgcacaatttgtaactgattgattcattatttctaataaaagtgaaactcagttactgttcatctctctctctctctcgttcagtttttgtaacatggtatcaagagctaaatttttgcactgatcaagcagtgcatgttcatccgttcagccgttcgtctcagtcttcttcttcgttggaatttttctactgttcatgcgtctactgttcacgcatctacagttcacggtttgatacttcattgtgctggctcttgttctttcatacaacttcgattggcttcgtctgacctaaggatctctctttcggtgctgtctgtcctaattgaagctgttttgaacttctttatcagttcgttactgttcagacgcaatttctctctgttcgcgactttttcggcctcgtgattgttactgttcattcttctgtttacgttcggtctcgattgggcttcgatttatcttttcgtacatctctgtgatgttaggagttaattttggttgatttccttttcagaattgagttttcctaaatctgtttggatcaattctgtttgctgacctagcttctgcttgctcgtggtttggtctgttgttgcttattttttttttttttctctatggcttccgcttccgctccgtcaggtttgggttcacattcctttccaactacgattgctgaaaagcttgatgactccaactatctccattggcgtcaacatgtggaaccaatgttgaaagctcataagcttcaacgttttgttgttaatccggtaattcctccaagatatctgactgaagaagatagtgttgctgatcgagtcaatcctcaatatgaggcttgggaagtacaggaccaaaccttacttgtttggcttcaatctacactttccaaatctgttctgtctcgagttcttggatccactcattcctatcaagtctgggaaaagatccatgaacacttcagtcttcatactaaatccagggctagacaattgagaactgccatgcgtgcagtatcactttctgacaggtctatggatgagtatctcagaaaaattaaaggatttgtggatgagcttgctggtgtaggtgttccagttcgtcatgaggaatatgttgatgctattttggaaggacttccttcagactatgcttctgttattgctgtcattgaaggcaagaaaagaactccatcaattgctgaaattgaagctttgttatatggtcatgagacacgcataaatcgttacaataaagaaactcagctgttgagttctccttccttgaactatactcaaggatattcaacttccaattcacataagggtggtaattctgggaatttcagaggaataaataatcatggccgtggcagtatagctggtagaggacgtggcagtggcaaatttgccaattttcagtgccaaatttgtcttaaatatggacgcactgcaaatgtgtgtcattttagaactaatgcacactttcagcctcatgaatctttagtgttttttgatcctgtcacttctcagcctattccttataatcttggttcatccagatttgatcatacaaggccttctaacacttgggttaacctaatttgaaatctgcaacctctgttcctaatcagcccagtgctatgcttacaaacactgtatctcctggatctggtgctgatcactcctcctggattccagattctggagccagttttcatgtcactggagatcctcagcatataaaacagtttaatcactttgagggacctgatcaaattttcattggtaatggtgaaggattaggtatctatggtgctggtacctcttcttttatttctccttctaatagtcacttcacctttaaattacaaaaattacttcatgtttcttccatttcaaaaaatttgttaagtgtcagtaaatttgccaaggataattctgttttctttgaatttcatcctcatgtttgtcttgttaaatctcaggaaacaagtgaaatcttgctccaaggttcagttggagctgatggtctctattgctttcataatctcaagcttcaggatatttctcctcagcttttatccacttctgctgcttcctcaaaacatacaaattctgatctttcttttccctgtaacagcaatgtttggcacaataggttaggccatcccaacagtcatgtaatgagacttgttctcaaccattgtaatatttcacagtctaataaaaatgtttcagatttttgtgcatcctgctgtatgggtaaatctcatagattaccctcttctccttccattaccacttattctcctttagaactcatatttactgatttatggagaccgtctcatttaacctcctttgctggatataagtactatgtgtcttttattgatgccttttccaaatttacttggatttttcccataaaaactaaagctgaaaccatctctgttttcaggctttcaaaactcaagttgaattgcaacttaacaccaaaataaaaaatgttcaatctgattggggggggtgaatacaggccctttgctactcttttatcatcctatggtatttctcatagacttatatgtccccatactcatcatcaaaatggtgtggttgaaagaaaacatagacacatagtggatttgggccttaccttactgcatcatgcctcattaccctacagttttgggattatgctttcagtacaactgtctatttgataaataggcttcctactgcctctctcaactttgatattccttttatcactctttttcacaaggatcctgattttaggtttcttagaacctttggttgttcgtgttttccccttctaaaaccttacaatactcacaagctgaatttcaggtcacaagagtgtgtgtttttagggtactctaattctcataagggctacaaatgtttgtcttcttctggtagaatttacatttctaaggatgttttgttcaatgaagggaggtttccttattctgaaatattttcaaaagattctagtcctgaaaaacatcttgattcttatttcagtctaaatccaaatttatctccacctgctggcttgtctacttctatacggtctcagcccttgtcatctctgtctattcctactcccagtgttcctcctggtttctctcctatttctggtatcaatcctactgttgttccatctatttctcaacctgtcaccactgttgagtctgagtctacacaaaatagtgcctctgaaaacattgttgtgactgattcctcttctgaatctgcttctgtacctagttctattcctgctaacactcatcccatgcaaactaggtccaaatctggtcttcataatcccagattacatccttccctatttcttgttcattctgaaccaaaaaatgtgaaacaggcattggcagattcaacctggcttgctgccatgaaacaagaatatgatgctttgttgaaaaataatacatgggagttagttgctctacctgctaacaggaaagctgttgggtgcaagtgggttttcagggttaaaaaaaatgcagatggttctgttaataaatttaaagccaggctagttgctaagggcttccatcaagtgcagggttttgattttcatgaaactttttcacctgtaatcaaacctgtaaccataagaattgttctctctcttgctctttctcatgggtgggagttatttcaacttgatgtaaacaatgccttcctaaatggtcttcttgaagaatctgtatacatgacacagccaccaggttttgaaaatgctgataaaaccttggtatgcaagcttaacaaggcactatatgggttaaagcaagctccaaggcagtggtttgacagattaaagtccactctacttcagtttgggttcataagtagtaaatgtgattcttctctcttcatttacactcatcagtcacatactgtttatctactggtttatgtagatgacattataattactggaagctccaaagttctaattcagcagctcaccactaggctaaatcatgttttttcactcaagcagcttggacatttggattattttttgggtattgaggttaagcatctgtctaatagttctattctcatgacccaaagcaaatacattagagatttactgcataaaaccaacatggcaaaagctcactccatctcttctcccatggtttctaactgtaagttatctaaacatggtgctgatatattttctgatcctactttgtttaggtcagtagtgggagcattgcaatatgctactctcaccagaccagaaatcagttttgcagtaaataaggtttgtcagtttatggctgttcctcttgagtctcattgggcagcagttaagaggattttaaggtatcttaaaggaaccgtcggtcatggacttctgttcaaatctgttgatgttagccagcctctacctcttcatgccttttgtgatgctgactgggcatctgatgttgatgacagaagatccacttctggttctgctatttttcttggccccaatttaatttcttggtggtctcgcaagcagaaagttacagcacggtctagcactgaagctgaatacagaagcttagctcaaacttccactgaactgacctggattcatgctcttctcactgagttaaaagtctctttcaccactcctattttttgcgacaatcaaagtgctgtttctattgctcacaatccagtgtttcatagtcgcaccaagcatatggaaataaatgttttctttgttcgagagaaaattctggccaagcagctgtctattgtacatattcctgctttggatcagtgggcagatgttcttaccaagccgctttcttcttccagatttgtttttctcaagaacaaactcaatgtgaaaaatgtttcttctgaaaatttttccctttgagtttgaggggggatattagagcatgtaagtgctgttagcttttgctaacagcactcctttgtaaataagctgtagttagcaattagcaaggtgtagttagtaattagctttttattttgcacacctgtatgttcactgaagctgcaatgcacagctgtcagttttcatctacttagtggtgagaggttataaatacctcacatgcacagtttgtaactgattgattcattatttctaataaaagtgaaactcagttactgttcatctctctctctctcgttcagtttttgtaacagacccatgatcttttttacatttagtacctctggaatatactttcaattttatttgtggcccaattaagttgaggtccaaatgactaccttcaccaatttgttgctttttcaaatcaggatccccacacgtgatatccctatccctgccctcagaaacctcattgaccccacctgcctgtgcattactagaagtaaccatgagtgggtccccctctttcttgtcacctttcgtacaaatttgctgttgaccatctacaccaggctgatttgcctctttatccagtagacccgtctcctctccattgtggggacccgcaccacttttgaactctggactcccttttggtggatgtgggtccctccccgagaagctgaattgttgactgtcatcaggcaaatttgaattctgacagccatgttctatctgcatattatcaccaagccgcacagtgacctgatccacttctggggtctgactttcgtcagaaatgtcacactcagcagcccatttagtgaaagctagccttctcttttcaccaaaggtgtgtgagcaggtcccttcaacagaaatcctattactagccttgtcagcccgcactcccatttacccagtgggtattacctctttgtcggcactgctcctgcctccctgtgcaattccgaccaccggcatcagcatttccgatgtttctgcaaccaccatgtcctccatactatcatactcgcaccctaagctttcatcggaagatctgatctccgatgaagatgcaccagatctccactgcctcgcacatgcttggaagcatgtctcttcgactatgctaatcctgtagacttcgttgtttatagttgccatgatcatgtggttgatagaaggttgccaaggggtttttatgaggaccctagctctatcaagacggttaaggtctaccgtgtcatcatccaacaccaccaggtctcctattccggcaacaatacacctgatgtactcttcttcccaagcgtgtagcgggattccccaacatagcacccataccaacctacagccaaccttcaaaccaggatgccatttttccagggcataaaacatggacactccggtcgtctccgcctctctacgcatttcctccaccttgctgtcattaaggccgatgaggagtatcaaatcatcacccatgtatctcagcctaagatccccatctccattccatagaagctcctcatcaacccgatcatagtcttttaaattagtgagtctgcccacccaggccccattataccatttgttacttcccatcggaatagataagctaacggtggattgagaaggttttccaatcgcctaatccttacgcttaggtggccttctcctccatggctgatttccggttttaacagcttgagcataagagatggttcggttcggggggtgttttggtatctgcgaataatcctccatcagaccctcgggatcttcgtgaaccttggccttccctttatcgaatgcaatactggttttttccgatatccaccttccgcgttgctcatgtgagttcatgttcagctttgttctctgctccctgtcatgtttggggcggtttacatgcatcttcaagcccccaacaatctggttatccaacatcctttccagccttcctacgtcgtcaacccctttaaatctcacgaacccatatcttctacctagattattcctttttctcgggataaaaacctcacgcacatcaccccaccttttgaacacataccataaatctttctcattcatgtcttctggaaaccgggtgaagtaaaaagtcgatacatcactatcctccctccagtttttccggtgagattcccgtctaaatctgctaccagtatcaacaaggtactgatcgtgcccattacccttgaaggtgagatggggtttccccctcggaccatcattacgactctcaaagaacctagacctaaagtttcctctagcccacccagtgtttctctctctaactttttctctcatctctctacaagacctacctacgttcagacctcatcttattcaagtgcttcagtgcattatctgtaacagaaattgcaggggccagagacccagatgctggtgcagctaaaggatattgaggtgggggtgagtgaaagcaaagactaaaaaagtactgagcatggcagaaaaagtatttcacataacacacacaagtatataacaaaattcaaagtatactgtttagctgttgcaatctagttaatgatattaaaacagagtgaatgtcaatatcagaaaactccacgtttttctgcaagataaacaaataacttgtgcaggaactaacttccccaaaaacttaagctgttaggtgacatatgcacaattttacatcgaatattctccttcatgccaaagcgggttgaaattatagataatccacaaccccagctagcagctacattgagctgtgaaacccaacttctatttggtagtatagaggtaccaaggatcaaattctaggccacttggtcatagagattaatacgtaataccatgtcaagaacctcacaaaagataaaatttaacatataaggtgaaggctcatatatctaatataattttttttattttttgtgcatgttgcaggtgttagaaataaaacaaaatccttaagaacggaccaagctgtgttaagtgaatggttaagatgtatctggcacatattgatgaaagagttctaagtaaatccaaaaattgttcaatattagttagatatttgttttattttgataactattcaatattagaatttatattttattgtaacgcatacagacatgcatacaaagaaaattgagtgtaaaatagacatcacacataataccactctttgattataccaaagcttcataaattcttaccaatggggtttctatatccataagcacttcaacaagtttctcagaaacaagtaatttccaaagaacagaacataatgctcgtatttgagcaacccgacggcagcaaccattatgagcagcccttcgcatctgattcctccacctgccactctgattggcaactgcagcgtcctcagaggataacctcttctttacctcctatattatcaacataattgtaacactagtaagatacactatcaaatcatcacaaattgatgataaaaaagtgaacatgtttgtacatttatgtatgcagtacaagtatttacattaccttatccaggtttggactagagctactctcttcatcaggccaaagaatccaagccacaatgcacatatcaattgcatctttaacatgtattgggggcaataagacataagaattgtctacaacttcaaggtacatagtttttccaagtgtgtccaagctaccaaatctctgaactgtaaatgctggccttttcagcacctgcatctgaatcttcaaattccaggtgaactttctgacatttattttccctattattttactaattctgttccatctagatctagcaatctctagatcttgcttagaattagaagatgaaactttcttcttatgactgcatgcactcaaggataaacagctatcttttttactgtcagacaacagaatatctctgggaagattaatgtagtacacagaagagttttcccaacaaacagctatgccatgtatttcaaagggggcagtagagtgcaattccaatcgtttgatataatggatatcaaaatagaactctggcatagagtcccatagatccaaaaatgaatcaagtccgccaggactactaactgcattaatgggacctttctggctggaactaccagcattaccacaagccaaatttccattcttatgtcgatcctctgtacaacgagcatagcacccatcatgtacaccagatttatcatttggtttctgcaattgaacagagagaatggtcatgtctgcatttttggtatggtcagaagtcctattgagttcatccattttaggtcctgcaactggaacactggacaagctacatatcatcctgcttgattttccttctacagaagccacagcaccgttaacagataattttattaaatcttctctttctttatctaaagtaaatttattagtattatcaatgcaatctgcatcaacaaaactatgactagtatcagttgtgtcacttccagaggtacttccagttccttgcctgatagaatcacaagcagcagtagataatatgcgaggagcaaactgtgggacatggaacccaagtgatttaaaggctgagaaagcagcattacttgcctcctcagctttatcaaaaacaatcttgcgagcaccattctttatcttttttgctataccaaattggaagcccctttgtgcagaaccttcaaaagaaacaacatcctcaatatatgaaaagtcgaaagcagcttcacagactccaagttaaaagattgatgtaatgaatttttttttttgtgatcggcaaagatataatattatatatatgaaaagaagtacaagaggtactaaaaatgttaatccagttattttagttccatatttaccatatatagtttctagggataatcaatattatctcaaactcgaccaaaatatcaaacttaaaccaacagaaaagaattcagataacttaatccacagatcaccttctgtggcccatgatgaagattcaaaaagtgcttttactatctcaggaatggatgcctcagaaattgcatggggtgtacgtaaacctgctttatagagtgatctggctcgagaaccctgcaaattgaatgaaagaaacagggcataaggttactagtacaagccaataaaaatagaagttatattaaggagtatgtcaagctatcatagaacttgagcatgcttactttaacatagggaatggtggtgagttctacaatctctgctttaactccaaacgatacacggttttgaaacttagcaactaagccttcaagatcatgccacccaagtcgctcacaaaacacagcaaccatagatgcaaacctaccagcattctcttgcaaggcttgaaccattcccctggcaactctgaatgcttcacaaacctcacccacaggaatttcctacataaaatcacgtttattcaagaaacaatataagctctaatgaaattccaagcattagatggaaagggaaaaagagagatgaagacaaaacagaaaagagtaacaataattactgatgagactcttaatacataaagctggcctaatacccctattagcctatttatatgaataacgtaggtatagtgcaagttcagtgcagtgtgcagtcactactagccaagcccaatagcactgacagcatacaaagaagtactctaacataggatgtgttaatattgaaacacaaaatactaaattgcatagcttgttacagatgaatattagagatagctatatacaaggggtcctgttatattagtagttcttcaattacacaagcacttaaacaagaccatcgatataacaggagatatgctttgtaatataacacattgatctatcacatatcggatctgttaagatgaagaggaaacaagagacatataaccaaacccacacacagcaaaggctctacaacatgcactaaaaatcaaaattacaagaatcactaagtattccaatatccaaattactataattaaaaaatactattaacctatctagatcatgtacaatttttccaacaagatctaatattattgacagtcattctctcttttccactttttcctcctcttccacctaatcaaatcattttaacaaaatacatacaaataaaaggcaacttaaaaacataatggttctataaactacagcttctaatgggcttagaaacaatgacttgcaactacaatcagacagaaagcaaacacttgggaaaggcaacaaaatgagaagatagctacattgatgcacaaccaaaagagcaggctgacaagtagtgaagcagaggaaagatggactctgctgaaaagatacagggcacgaatgcaaaagcaattatggaaaaaagcacactgcaaaagagacacatttccctggcaacaattataaacaagataacttaaagaagaaacatattcaaaacaccaattgaaaacctcaaacagaatcaattacttcaaaattgagctcaggagaccctaaagaaaaaggaaataacacgagttctcaaacacgggcctgctaataaacagatcatttaaaggttgctcaagcaattcagacaattcagtcatattagtgtattaagtaagttttacttgttgattcagttagagcagctgttattctgttagaacagctgtgattttgtttattctgttattctgttagagctgttatttctgttactttgttttctctataaattgagaaacagaatctgttgtaatcactttttcattccgaatcgataatatcttctatcttttttcttccttctctctctctctcaaactctatgatggtatccaaagcttgaggtccatccatggcgacaaatcagaattccgcttccgctactccttttcatccaatttcttagaaattagatgattctaaattcctgctatagagacaacaggtagaacctgtcatcaaggctcataaacctcagcgtttcgtggcacgtcctcagatcccgattcgctttctcacagaggcagattgtgaagctggaaatgaaaattcagcatacccagattgggaacaagatcagattctcttgtcgtggatccaattgagtctttcagtttcaatcctatctcgcataatcggatgcattcattcatatcagctttagggagcagattcatgagtattttcaaaagcaaacacgtgcgaaagataggatatttcaaacagaaatcagaactacaatgcttgagcagaaaacaatgcctgagtttcttctgcgcatcaaatgcatagtcaatgtgcttggatcgtgtcgacatcctgttcttccacatgaacatcttgacgtggtttttgaaggcctactagaggagtacggttcagtaatctcaatgatagaaagtaacatcgaaccacttccgattggagaagtagaggaactgctgctcgcacatgaggcacgcatgaaaaagtttcagaagtttgctgcttcaccttcaattaatgttgctcaaggttacaattcatcttcgaattcttacaattcgtcctcgaataatttcagttcagaaaatcgatccaattattttagaaatcgtggtggcttcaatcgtggcggtggctaaagtcgtgcagacaatgattctgacctggctacagtcgtggaggcaatgactttagccacggtcgttatgcaaattttcagtgcgaagtttgctacaaatttggtcacacagcagtggtgtcattttcgctatgattctgattttcagccaaaagcgactctcactctgatggaaccagtgtttaaaagaaaatcatcgaacacctttggttcataacagaatcagggaactaattctaacagacacccaacctagtgcaatgctgtttaattctgaaaatcaagatcctaactctactacttggatacctgattctagtgcatcgttccacgtaactagagagtctcaaaaatccagcagcttggttcatttgaggggccagaccaaatatacattggtaatggccaaggcctttctattgagccttctggttacactaagtttatttcccctattaatctagagtctctctgtccttgaaacaattattacatgtacctgccatcactaaaaacttgtgttagcaaatcttctatggataacaatggtttctcttattatatcattttctgtttttcagcaatttaaaaccatggctgaactccaatttgataccaaaattaagagtgttcaaacagattgggaagctatatttagacctcttacctcatttcttcaaacccatgggatcattcacaggctaatttgccctcacacacatcatcaaaatggtgttgtggaaagaaaacacaagcatatcattgagttaggcctcactcttctcaaacaagcttctctccctttaaaatttggggattttgccttccaaactactgtttatttgataaacagacttcccactgcctctcttaaatttcaagttccttatactgttttgttcaacaagtcacctaattacaattttttaggaactttgtcttagattctttagaatgtgagtttgggcctaactcaacctcaaaagctagctcaagggatgaggattgcccctcacttatatactctatcttggctttatctttagccgatttgggacttggatttttccctattagaacatgtaagtgctgttagcttttgctaacagcagccctctgtaattaggctgtagttaacactttgcttattgcacctctccctgtacagctgtcagtacagttgtcagttctgttattttcagttagtggtttttttattatttcagttagtgggttagcatcagatcaagaggttataaatacctcatttgtacaaagcttcaggtaattttttataacagagaaataaaattcagaacttctttctatttccactctcttttgtttattttgttcaacatggtatcaagagcaaaatctttgcattgatcgtacagtgcattgatccctttcatccttcgttcaatctcatagtcctgtttggatcgtgttctgttgagtttgttactgttcattatcgcggtttctctgattcacgatagcacctccattgcggatgcttctgttcacttgagagcttgtgattgatcctgttcttgcttgcgtttctcttttcggctttatctatgctgtttggtaatggtttcggctcatttactgttcgtgactgggttcttggtgaattcgtttggctcagacttgttcgcttctctctggttctttctgtttgtgtttctatgcgtgttcattgttcattaatggcttccggttccgctccgtcaggtctgggtacccattctttcccaaattctgtagctgaaaagcttgatgactccaactatatccattggcgtcaacatgtggaacctgtgttgaaagctcataagcttcagcgttttgtggctaatcctgttattcctcccagatatctcactgaggaggacggtgttgctgatagggtcagtcctgagtatgaagcttgatatgaattcaggaaatagaagttcttgaatcttcaatcaaacacagaaaatactgaataatatgctgaatctttatttctaccaagaatagcttttacaatgtagtagaaaaaattaagagtgataaattcctaattcccaagagaccattgtctcttacagatatttcccacccaagacaattattttccacacacccactaacacccactgctactctatttataacctattcaacaaaacactcactctacttattacctaactacccctgcacttaattatttttatttctccttttgtacacttgccattccctaatattattattttcttctcttggtatcaactgctgatctgtatcaataccaccctccctaaaatcaaacttgtcctcaagtttaaaatcaagaaattgactctgaatcatgtcatattcttcccaagttgcctcttccttattctgtccctgcatgccaactgaagtctggtggctttggtggtgggagcattactggttcagtaccttccttcagccctggtccatggttgagctgtcaaccataaatgcaagacccttgtttttagtgtcacgtagggaaatgactctgcacagctgcatagtcctaacctgcactaatctcctcaaaaatgatttcagaactggattcatatcaccttggaaagtagctgggattgtagcataattcaatagaatctgttctggtccagttttcaaagattttttaatggccctggatgaaaccatttcttgtgatagacttgggttcccataaataaccattgtctgtccatcaacaccgaattgcatggttagtttcctccagtttaccttcacctctccaagtgtctataaccaagccactcccaagatgatgtctactctgcccaactcgaaaacagagaactctcccctgactgtgtggactcccaaatccaacaaaatgtcatcacaacatccattggacttcagtttctgctcgtcaccaagtctgaccccgaaaggctgtgtttctcgaatcttcaatcctaacctctgcgtcaaggaccttcccaaaaagtagtggcttgctccactatcaataagcacaaggactgaatttccatttgtggtcccttgaagcttcatagtctttggttgagttaatccatctggcgagaacaaagataattccatccatcttaattctttctcactctccctttcttcctcatcgatattatgcaattggatgtgggcagcttctaaattttcttccgtatcacccaattcatcttgctctcccattatcatcaccctaatgttcttctctgcacatctatgcatgggtccaaaaggcaggccacactggaaacatttaccttctgcccttagcttcatatattcagaataagggagattccttaccggattatctcctcgctgaaacagacccgtgtttcctctctccattgatggggaagggggtgttcttgccgcaggtttgtcacggaagtgggttccccgatgggtttctggaatggagttgctttggttcagtccattactgttttgggccttgtaagcaaaagctgaaccggacccacttatgcgagagtttgtcctaaccttcgtatccatgctggaccaaagaagttgcagcgattgctcaatgtccctagcaagatccatggctctgcaaacatcttttgggtcatggatacgcaccctactccacagctccgccttcaagccacccataaaaaatcccagaagcaactcttctgcccccattggaatttgggccactaaagattcaaaatcttggatgaacttgtccaccgaagctccttgcctcaatcgcgaaagctgttcataggcgttgcctaggtgtcttcccccaaatcgtcgcatcaaagctgttttcagtttcgaccaagtctgctacggatctttcttcatcaagaatcgaaaccatgctatcgttggtccttccatactgacgaaagccatcggaatgcgctcatcttccaccacatcttgcatttcaaagtatgtttctgcgcaagctatccaacccaaagggtcatcgcctacgaacgttgggagttcgattctcttggtaaaagaacgacccaagattggttaggtgttggatcctccggaattagcttcatccgaggagtctagcccacgtttctgcaccatgtcacgcatgaattcacacatttctctaatgctgtccaatttcttgttcaccatggccattgatttctccaactcttcaacccttgatttggaagatgccattgctatggaccacggcagatcggaccaattgatatgaatttaggaaatagaagttcttgaatcttcaatcaaacacagaaaatactgaataatatgttgaatctttatttctaccaagaatagcttttacaatgtaatagaaagaattaggagtgataaattcctaattcccaagagaccattgtctcttgcagaaatttcccacccaagacaattattttccacacaaccactaacacccactgctactctatttataacctattcaacaaaacactcactctacttattacctaactacccctgcacttaattctttttatttttccttttgtatacttgccattccctaatattattattttcttctcttgggatcaactgctgatctgtatcaaagcttgggaagttcaggactagaccttgcttatttggctctagtctacgccctccaagtcagttctttcacaagttcttggatccaaccattcctatcaggtttgggaaaagatccatgagcaattgcacaccaagtccagggcccgtcaactaagaactgcaatgcgtgcagtgtctttatctaataaatctatggatgagtatctgagaaagattaaatggtttgtggatgagcttgcaggagttggtgttcctgttagacatgaggagtatgttgatgatattctggaagggcttccttcaaattatgcatctgttatcacaatcattgaaggcaagaactccttccaatgctgaaattgaagctttgtaatatggtcatgagacacgcctaaatcgttataataaagaaacccaggtgttgagttttccttccttgaactatactcaaggttactcaccttccaattcacataaggcaggtaattctgggaattccaaaggtgcaaacagctatggccgtggcagtacaggggctggcagaggatgtggcagaggcaaatttgccaactttcagtgccaaatctgtctcaaatatgggcacactgccaatgtgtgtcattttaggactgatatacactttcagtcatgaatctttagccttttttgatcctaccacttctcagcctattccttattcttttggttcatctagaccctcaaatacttggatagatcccaatttaaaacctgcagcctctgtccctaatcagcccagtgctatgcttacaaatactgcctctcctgggtctggtgctgatcactccacctggattccagattctgaagccagcttccatgtgactggagactcttagcatatcaaacagtttaatcactttgatgggcctgatcaaatattcgttggcaatggtgaaggattaggtatctacggtgctggtacctcttcttttatttctctttatgatgatcacttcacctttaaattacaaaaattactgcatgttccttccatctcaaaaattttttagttgtcagtaaatttgccaaggataattttgttttctgagtttcatcttcacatttgtcttgtaaaatctcaggaaacaagtaaaaccttgcttcaaggatcagttagagccgatggcctctattactttcacaatctcaagcttcaagatatttctcctcagcttttctctacttcagttgattcctcagcaaatataaaatttgatgtttcctttccttgtaatgttaatgtttggcacaataggttaggtcatcccaatggtcatgtaatgagacttgttctcaatcattgtaatatttcacaatctaataaaaatgtgtcaaatttttgtgcatcttgtatgggtaaatctcatagattaccctcctctccctccacttccacttattctcctttggaacttatttactgatttgtggggaccttctcatttaagctcctttgctggttataaatactgtgtctttcattgatgctttttcctggtttacttggatttttcccataaaaactataatagaaaccatctctgtttttttcaggatttcaaaactcaagttgaattgcaacttaccactaaaattaaaaatgttcaatctgattgggggggtgagtacaggccattttttactcttttatcatcctatggtatctctaatagactcatttgtcctcacactcatcgtcaaaatggtgtagttgaaagaaaacatagacacatagtggatttgggtcttacattactgcatcatgcttccttacctctgcaattttgggattatgcttcagtacagctatctatctaatcaataggcttcctactgcctctcttaactttgacattcctcttaccactctttttcacaagagtcctgattttaagttccttaaaacctttggttgtgcttgctttcctcttctaaaaccttacaatactcacaagctgaattccaggtctcaagaatgtctgtttttagggtactctaattctcataagggttacaaatgtttgtctccttctggtagaatttacatatctaaggatgttttgttcaatgaggtgaggtttccctattctgaaatgttttctaaatgttctagttctgaaaaacattttgattcatatttcagtctaaatccaaatttgtctccacctgttgggttgtctacttctatacaacctcagccctcctcatctcattctcttccagctcccagtgttcctcttgggttttctcctatttctggtactagtcctactgtttttccatctgtttctcaatctgtcaccactattgaatctgggtctgtacagaatagttcctctgaaaatattgttgtgattgattcctcttctgaatctgcttctgttcctgctaacactcatcccatgcaaactaggtccaagtctggtcttcataatcccagactaaacccttccctttttcttgttcattctgaaccaaaaaatgtgaaacaggcaatggcaaattcaacttggcttgctgtcatgaaacaagaatatgatgcttcgttaaaaaataatacatgggagtttgttgttctacctgctaacagaaaagttgttgggtgcaagtgggttttcagggttaaagaaaatgttgatggttctgttgataaatttaaagccaggttcgttgccaagggcttccaccaagtgcaaggttttgattttcatgagactttctcacctgtaaccattagaattgttcgcactcttgctctttctcatgggtggttatttcaacttgatgtaaacaatgctttcctaaatggcttacttgaagaatctgtatacatgacacagccaccaggttttgaaaatgcagataaaaccttggtctacaagcttaacaaggcactttatgggttaaagcaagctccaaggcagtggtttgacagattaaagttcactctacttcagtttgggttcatagggagcaaatgtgactcttccctttatatttacacccatcagtcacacactgtttatctactggtttatgcagatgatattataataactggaagctccaatgtcctaattcagcagctcaccactagacttaatcatgtgttttcactcaagcagcttgggcatttggattatttcttgggtattgaggttaagcatctgtccaacagctccattctcatgacccaaagcaaatacattcgggatttgctgcataaaaccaacatggcaaaagctcgctccatctcttctcccatggtttctaactgtaagctatctaaacatggtgctgatatatttcctgatcttactctcattagaccagaaatcaattttgcagtaaacaaggttttgccaatttatggctgctcctcttgagtctcattgggcagcagttaagaggattttaaggtatcttaagggaactgagggtcatgggcttctgttcaggtctgctgatatcactcaacctctagttcttcatgccttttgttttttttttttttttttttatcagcaaagataatatgtatatatatatatgataaagagtaaacatagtacaagtagtaccattacaaaaaaacatctatagtcccgaaccaacctatggcagcctaatacatgaaagtacatggattaagatgccaaaagtcggggtggactttgcgttgccccaaaaaacaggggaatctaagtactataccccccccaccaacaaaagcctctctcatgttactagaccagaaatgaaaggatttgtcgaatccaagctccccattcttgatccatgaccagcaagagaacaaagcagatcccatcactttaacaggattaaagctttcattgtggaaaacaattctgtttctatgcctccaaatgttccaagtcaaggccagccaccataatgaccatatatgggaagtgagccctattttctgaaagaaaccaaattgtgtgaaatgcagtctcggaatctcagagaatgcccccaagatgtttgcccacctcatagattcccaccaaagcaccttgattcggtgacagccgaaaaataagtgtgctccctcctcgtcgctgttcctgcagaatggacagagggtgtcgttgagtactatgcttcttctctgtaggttcatctttgtaggaagcctatccttgaacaatctccaggcaaagcaatgagctttgctgggagcttttaatttccacatgtctatgagagtttcatcttgctccactgctattccagcccacttgagatacctgtatgcgcttcttactgaaaaatgtccatttgggtcaggctgccagttccacgtatcttgctgatgaacttgcagattgtgctcctgtatgtcttgtagaaactgaatagccgattcaacctccccttccataagaggtcttctccacctaagatgccattcccaacctgaaactgttgcgcatcccatttgctgaatgcagttctgttgttgattggatataaggtatagtctaggatatttgtccttaagtggtacaccctcattcctccaactatcctcccagaatagtgcctttgacccgcagcccaccctccaggatatcccacccatcagcccgttcgctaccccattcccacggcatgctacgctaagatctctccaccaaattgactccctccctaatcgcccatggcctaccagtttcctccaccctccgtatttcgattgtagtaccttaacccacaaattatcatgttggtgaaacatattccatagccacttaccatgtagggcgtggttgaatgaggttaaatctgagatgcccaaaccaccacactcccttgcttggcacaccaaatcccattttacccaagccacctttttttgatcagcgttcccaccccacagaaatctcttttggatcctctccaatctagctatgaccttctttggagccctgaaaaaagaaaacatgaaaatagggatggaatttaaaactgatttaatgagtgtgaccctgcccccaaaggatagatatttgtgtttccaggctgctaatttcctctcacacttcctaactagatcatcccatgtctcatatcgtcttggattagccccgattggaattcccaaataggagaagggtagagtcataacgctgcaatttaggaaagaagcagcactgtttgtccatgctggatccatgccaaaagttgcaaatttgctcttagcaaagttgattttcagccccgacacaagctcaaagcatctcaacatgaccttgattgttttgacattttctggcgtagcttccccaaaaaaaatggtgtcatcagcatattgtagaatgctgatatcaatctgattgtttcccactttgtaaccagcatacacgttcttgcgttgtgcttctcgcatcaacccagtgagaccctcagcaactatgttgaacagaaagggagctagaaggtctccttgtctaagaccacggtgcggagagaactcctccgttgggctcccgttgatcaacacagatacggacgcaattttcaggcaaccttcaatccacagaatccattttgagcagaatcccatcctcttgagcatatagaatagaaattcccagctaaccgaatcgtaagccttctcatagtcaactttaaatgtgaggcagcttctatttttccttcttgcttcatccacaacttcatttgcgatgagtacactatgcagcaaatgcctcccttctatgaatgcagattgtctatggtcaatgaggtgaggcaatacctttttcagtctgttagacagcaccttcgccagaattttataggtacacccaatgagggatattggcctataatcattcaagcctgtggatcctgccccttaggaatgagtgcaataaaagatgcattgccacccctcgggaatctgccatttacaaagaactcatccaaaaagcgaagaaaatctggtttgataacctcccaaaactcttttatgaatttgaagttgagcccgtctggccccgggctcttctcattgccacatgcccatactgcatctctaacctcccctgcttcaaaccttgctaccagagcctcgttatgatgttgctcaatggtcctgaataccacaccatccagcttaggcctgtcctgatacggctcctcaaatctgcttttgaaaaaggagacagcatgttctttaaccctattaggttcctctgtccagcaaccattgaccataactcctctcagcatatttttcctgcgtttccaattgacaatcaaatgaaaaaaacgtgaattacagtccccttccttgagccatctgttccttgctttttgccttagtaaagaagcattggacatagcagccatccatagctcttcctgcaacagttttcttttctttgcctcttctgcagataagattctatcatttgtatcaatctctaatctgttgagctcctcctcaatgcgtttcagcttctgttgtatattgccaaaatgggatttattccactctttcaaattttgtttcagagctttgagcttttctttcaaagcaaaaccccccatccactaaacctgtttgatctccagctatcgctcaccactttcttgaacgatttgtcctgaaaccagcagtccaacaccctgaatggttttgggccccaatccacctgtgatgattttactagaataggacaatgatcggagaaatttctgtccaatatgtgctgagttgaatccggccatttgtccagccatgcagaggaaacaagagccctatccagtctgcttttggcggtcccgtttggcctataccaagtgaactttctaccaacacagggaatatcttcaatctccagctccgctatccactcgttaaattccctcaacaaaccaccatcctaagctctcgagcaaatccccaccctttcatatggtcttcttatattattaaaattgcccaatatgcaccatagtcctcccacatgtgcatttttcagttgtcgtagatcctcccatagtttcctttttaacggagcctcacaagatgaatacacattcacaatgacaattttagagccatctgtaacccatacaccttccaaaaggataaacccagcacctaggactgtagattgtagtttaaaggcctcctcactccatatacacagcattcccccagctctgttgtttgctggtaagaattcccagtgaacctctgaatccccccataatgcttggcaaatcttagcatcaatgctttctttttttgtctcctgcaggcacaccatatccaccttctccttaaccaccagttttctgattgcattccactttacccccccacccagccctcttatgttatatgatattagcttcattgattgtgctgactaatacccagcctcatggcctcaaccacgtctctttcttccaatattgatattgccttcatcatgtcagtctgattattgcatgttacaccaagtgatttagccaatatccattcactctctatatctgatctccacagctccttgaccaagttgccatcctcttctaacgagtcagaagaatccaagttcgatgtcctttccccccagcagcagagtcatttaatctgttgtgttgctccccacttggagacaagagtaatggtgggttagtgacatctcttcctatcaccggaagctgcccatcatcaaattcttggtttttatctacttttctattgggctcaggctgcttcttgcaccccctgcatctggagtataccctccatggaatactattttggtttctcagcaagttgggccatgttccttttggcccaattgtttgaatttgctgtcagccccccagctattttcgggtcccacaggagaggtcattttgacctgagcgacactttctccagcaagtatcatctgtttgctgcaagcctgtctatgtgggtcctttccatctttgtagctaaagggattttctgctcccaaatccccagccgtatcttttgtctctcccgaaagcatgatttgtccagcctgtggaacgtctgctccttgctccgttgctttttcctgtttcgtacccgcatcgtacttgagagtgacttctgcctgtgggctttgtccggtgtctgagctttttcgatggaccatcagtccaagcagatggctctgaccctcggttaataagcgcgagttgccgctggttccgtccgacgccgaaaccacctccctcgccggctgtgtcatcggagtttccgccacatagctggtctccggtgtatcttcttcaccgaacgtagtggagccctcctctgattgaaactcctcctccgatgaagagtatctctccctgaaacctctgcacaagttcgagcatgtctcttccgagatgtttatggtgtacgttgtcccgttaatgtgggccacaaccttgtgattgattgtgggcgaccatggtgttttcatcagcaccctttgccctgtcgagacggtgaatatcagtcgtgtcatcatctagctccaccacctcgcctattccagccactatggtgctaatatgttccttcttccaggcatgcagtgggattccccagcatacaacccataccagcctaaagcccgtcctaaggtttggactccatttctccaaagaattaaacaggtacccatcattgtcttttaccgccctcatcttttcctctgctttggcgtcgcttagccccatgaggaggaccatatcgtcgcccatatatttgggtttgatgtcctcatctccgtcccacagccactcttcttcgattcgatcgaacgccgatagcttgctcagtctgcctacccaaacctctcgacaccacttccattcctcctccggtatagatatctgcaccgtcgatatagatggtgtagctgttgcgagcgacctccgccatggttgcctgtatttgttcgttgtaaggacctgagcataggatggcttgcggttctgttgatgtcttttgacgcctgacgtacccgcatcgtcaacatccaccttctcttttcctttatttttgtctgcgttgttgtcctccatcacccttctctgaggcttctcattcctagccgtaacctcctgcttccttggtctgtcgtgtttaggaagattaacatggagtttaaggcctcccacaaccaagttgtccagcacaccttcgagcttgcgtatgtctctgacccctttaaaacgtacaaatccatatcttctgccacttttgttcctctgtttaggtatgaagatctcccgcacatcgccccattttttgaataccgaccacaactccctttccttcgtgtcatcaggaaaacgagtgaagtagaaagacgttacgtctgccgcatccctccagttcttcttattgtcaacccctctccttgttcccgctgctaacccttttccgacgagtttgagacatgaggtatcccagtttctgtcccaggtcttacctctgcgatttactctcacccacccagtggcaaaagaaccaaaagggtgttttttttaaaaatatttaccgataaggtgcgttttcaaaaatatttgcaaatctggtgcaggagggtacctatatttacaaatctggtgctgtgcaacatctgggcgtgttgtaacatgcctgatccaggcatgttgcagcagcaccagatttggtagataaggccccccgctccgcattacctgtcatatgatcaaaagcccctgaatcgagaatccaacgattactaccattaacatggaatgtcgtaccttgttgagcaacaggactagttgcttcagcaaattaaggcatcaccttctgaaattgctcatactcagccttggagatgaaatcatcatcagaattaggagaggcacgaaactcctcactcgtattattagaagagtccataagtcacctcaaaccaaaagaaggaaggccttttttaataaaaaaataggcttcagagttacagaacgataacaagaaaacttgctcttgataccatattagaatgtgggtttggacctaacgcaaccccaaaagctagctcaagggttgagggatgtccccacttatatactttatcttggtactatcttcagccgatgtgggacttgggtctttcccaatacactccctcacgcacagcacttttgtgcttggtgcatggataatatggtggatggcccaataatggatctaggataggctttgataccatattgtaatatgaatcttcttattcattcactcatattattcattccttcgtattgaaacccaaagggttcattatatataactaattctactactctagaatattccacaacttactctaatactctagaatattccacaactaattctaatactctagaatattccacaactaatttataatattctagaatattccacaccctataataaacagcaacttgatttcaggtcatgagtgattgttccttggttattccacttttcacaaacctacattctaagaaatactaactactaaaacaatataaactaacacgaatatttcttttcatgacaaaaaaacactaatcaagaagaaaatgaagataattacaataaaataagaatgatggaaccttctttacataaaaggaaaacatgaacattacataaaaaataaaaaataaaacatcaatgcaacatagttgtccaatccctcaacatatctgctagggagtctcttttcaaaagatcatgcgttatatatcaaatagaagtaaaatgactaattttatctcaaatcacttaatgtaggaaagaaatctcctaaaatgagttatgccccaaccatatgcaccaaggtgtagcaaagattgcatattttccactaaaattctcttcaattctagtaaagccattcaatcaccaaaaatttggctagagaacagccaacattcatcaaaactcaaaggtcaaagtatactcaactattctaacaaaacaacaacaacaaagcattatcccactatgtgaggtcagctacatggatcacatgacaccattctcccttttttgatgattttctccaacatcctttttggtctccctcttctccttttcccaagctaaaaatcatgcaatctactcttctaacaggcgcctcttgtggccctttttatacatgcccaagccaccttaaccgattactgtcatcatttcctcaatggtgccaatcttctatcatataatatcattctgtattatatcttttattgatgaccacacaaataagggggggaaataactagaagccaatcggtgatcaaaataaaagatcaacaataaaaccaacagaaaaccatgcagtagataaaataactttatagagataaaagaatttcaaacactatggtgcatgacacaaaatgtttgggcactagaaaaacagcaacgacatgtaccaaaggatgctcaaatattctaaataaaaaagaccagatttaaaaggagggaattagaagccaattggttatcaaagaggttaacaataaagccaaccaaaaagcaggcagtagtatagaaatttctaaattttttgtgtgtaaaccattggtgaggaatgcttggttttttgtgggtaaaccattgctagaatttcctttgggatatgagtaatagttacacatgcaaagagattgaaaagctctacatgttggcactttttgccttgatttgtgtttggttgcagtcctatcatccgatgacatctaccaagaatgattatttattctcctttcttttcatcttctctattctctagaaatattctttttagaaattagtaattgtagaaatatttgagtcaatgcaataaagaaaagcacctgaactagaagtgacaaaatgagagcaacatagaatcttctacagacacgaagtgtttgatcatcatagttagttgttgcactggaaatcccaagttgatttttttgttgattgtgcaatgatcttgtattatctcttgacttgtttgaagcacgtagtggtgcaccatgtgccatatacatcaagaatggttctgtcacacctactcgattgccaactgactgcatgcataacataactaattaataatacttgcaaatatgccatatttttttgtaggaaaaaaaagctattccctagataaattctggttaaactaatataaatcggatgaacttgaagcaagtctagtaacatcttttgccaaaaagcgaaaggaaattctgtttaacgaaaaccaacctggtcaagcggagacaatttcacaaaacgctcatagtacaattcccaatctggctcaacatcaacattgattggtgtcaccaagtaaactaaatgcaagtcagatgcaaggacaaatccttcccttgcccttgaaagatcggctaacacaatctaagaaatcaaaaacagtatgatgattatactacaaattacatacccatattttcaagtctccaatggacaatcaaaacacttgaaaatatattggaaaaatgaacattttttttttatgataattgtataaaagggatatatatatatatatatatatatatatatatatatatatatattagctatagttctaacctagtatttacacggaaatagtcctaccatcatcacaagaaataaaaatggtaacaaaaattaaagggatatattatatacacacgatacacatcaaatgtccaatcatcatatttttctcatgtcaaccccccccccccaaaaaaaatgcttttgaatgaatatctatcatatcattcccagcttgcaagaaagaccatgttttagaagtttaagatggataaggtaggagagaaaacaaagtgagatatgaactgaaatattatttactaaaataaaagttaatctcagtcagttacaagagaggtatatcttgaacaaaaataactaactaacagaaaactactaactgtctaactacctaggtgctgttagcaaaagctaacagactttaacacagagaaatacaaaattgtttttacagttttaaatacacattctaatatccccctcaaactcaaggggaatggttttcaggagaaacattcttcacaatgagtttgctccttagaaactcaaatcttgctgaggatagaggcttggtcagcacatcagcccactgatcaagggctggaatgtgtacaactgaaagttgtttggctagaagtttttccctgacaaagaaaacatcaatttccatatgctttgtgcggctatgaaaaacaggattatgagcaatggagacagcactttgattatcaccgaacataacaggagttgtgaaggaaacttgtaattctgttagaagagcatgaatccaagtcagttctgtggaagtttgagccaagctttggtattcagctttagtactggatttagctataactttttgcttgcgaaaccaccaagaaattaaatttaggccaagaaatatagcagatccagaagtggaccgtctgtcatctacatcagatgcccaatcagcatcacagaaagcatgaagaaccaatggctgagtgatgcaagcagactgaaacaaaagcccatgaaatatagtgcctttaagatatcttaaaatcctcttaactactgcccaatgagagtcaagaggggcaaccataaattggcaaactttgttgacaacaaaactgatttctggtctagtaatggtagcatactgcaatgcacccgctactgacctgaacagagtagggtcatgaaaaagatcagcaccatgtttggacagcttgcaattggagaccattggagaagaaatagagtgagcttcagccatattagtcttgtgcaacaaatcacggatatacttactttgagtcataacaatagactgattggataggtacttgatctcaagacctaagaaataatccaaatgcccaggttgcttgagggaaaaagcactgttcgatttagttgtaagctgttgagtcagtgtagtggaactcccagtaataataatatcatctacatacacagaagatatacaacatgcacttgatgcttgtaaatgaaaagagaagaatcacatttacttcctacaaaaccaaactgaagtaaagttgatttcgttctatcaaaccactgtcttagagcttgctttaaaccatatagagctttgttaagcttgcaaactacggacttattggctgcctcaaaaccaggaggttgtgtcatatacacagattcttcaagaagcccattaaggaaagcattattcccatcaagttgaaacaatgtccatccatgagagagagcaagagtaagaatgatccgaatagtaacaaatgtttcatgaaaatcaaaaccttgaacttgatgaaaacccttggctactaagctgaccttgtacttgttgatggtgccatcaacattctctttcactctaaacacccacttacaaccaatagcttttctattagatggtaaggaaactaaatcccaagttttattttgcgacaaagcattatactcttgttgcatagcagcaagccaatctgaacttgccaaggcctgtttcacagattttggctctaaatgaacaagaaacaatgaagggtgtaatctaggattatgaataccagatttggaccttgtttgcataggatgactgttaccaagatttgaattaggtgctggatcaggataagaggaggattcagtgacagcaacaacctccgaagagacatgaggaacagatatagaaccagaagcagtaactggttgagacacaggggaaggaacagcagggtgctgaacagatataggggaaaaaccaggaggaacagatggagacagagatggagaaatatgagaatgtagagatgtagacaacacaggaggtggagacagattaggagtcagactgaaatatgagtttaaatctttgacataactagtgcatgaaggaaataagtcagaataaggacacttcagctcattgaacagcacatccttagagatataaattctgccagatgaagacagacatttgtaacctttctgagaattagaataccctaagaacaaacactcttaagaccgaaaattaaatttgtgaccatgataaggctttagtagaggaaaacaggcacagccaaaggttttaagaaatttaaaatcagggtccttataaaacagagtggtgagaggtatagcaaagttaagagaggcagtaggaagcctattaattaggtaaacagctgtagtaaaggcataatcccaaaactgaagaggtaaagaagcatgatgcaacaaggtaagacctaagtccactatatgtctgtgttttctctcaaccacaccattttgatgatgagtgtgaggacaaatgagtctatgagagataccaaaggaggttaaaagggtagagaaaggtctgtattcacctccccaatcagattaaacactcttgattttagtattaatttgcaactcaaccaaagatttgaaggactggaaaacagaaacagtttcagctttggacttgataggaaataaccaagtgtacctagagaaagcatcaataaaagatacatagtatttatatccagcataagagggtagatgagagggtccccagcataagaggttagatgagagggtccccacatagacctgaaacaattttatttgatggagaattgttacaactattgagaacaagcttgattacatgactatttggatgccctaacctagcatgccaaaggctgactggactaggaaaagaaatagcagaattacaagaaatattataacttttatttaaaacagtgagcattttggacagactgtttcctaatgctgaaactgaagtagacaacagatgaggagagatgtgctggagcttgatattttgaaaatagtatagaccatcagctccaacagaaccttgaagcagaactttatttgtctcctgagatttcagtggacagaaatgaggatgaaattcaaagaaaacagaattatctttagcaaactgagttagcagatttctcgagattgaggacacatgcaacaaattttgtagtttaaaagtaaaaagactctcattaggagacataaaggaagaagaaccagcaccattgatactcaaaccttcaccattgcatatgaatatctggtcaggaccatcaaaatgattgaactgcttaatatgttgtcactcaccagtcacatgaaaacttgcaccagaatctggaatccaagtagtgctagctggatcaccaccaggagagtgagtattagtgagcatagcaccaggatgattattgggctaagcagcagatttagaatttggattagtccagttgtttgatgttcaagcagaccccaatgcgtaaggaataggctgaaaagtagtgggatcaaagaaagcaaggaaatcatgaggcttaaggctcatgtctgaacgaaaatggcacacatttgcagtgtggccatatttcagacaaatttggcactggaaattggcaaacctgccaccaccactacctctaccagaccccccaccactgcggccagaaccagaatcagaaaagttactacgaccatgatagagagcagaataggtggggacaagtgtataatagaaggaaagctgttagtgagaaataagaattagttaactaactgaataaactgtcaattagttactaaagctgagagatataagtagagaataggagggaagaggggttaggcatgtaaacagtaggaggtggtgtacctcgaatacactgaatattgtaaccgtgagttctatgcaataatattcactctattcattttcgtcctctttgaattctgttttctctggtccagttctatcaactggtatcagagctccagattctggggcttggggggtgaatgggttcgaagggcaacaacaaaatggaagcacgaattgatgccatggagaaggcgatggaagatacgcgagagatgttggagtcgcgatttgggtcgatggaggctatggtgcagcgattggcgatgttgatggagaaattgtcaagggggcacgacgcgcgggagggagaagccagcaaggtcatgaggcggaacgagagtgtaagccgaccgcactggaaaaaggtggagatgccggcgtttggaggagacgacgtgtatgggtggctagctcgaatcgagcggtacttccgactacagggagtggacgacgtggagcgaatggaggtggtgctcgtcgcgttagagggagaagcgctaggttggtttcaatggtgggaacagcggaattcgaaccaatcttgggaaggattcgtggctgcgatcacccagaggttccatggaggtatggttggtaatcctttccagaatcttttagctttgaaacaagatgaaactgtgcaagaattcgtaagtcagtttgaaaggatggtgggtaccataaaaggactggatgaagaaatgttggtggagatttttttaaaaggcctgaaagaagagataagtgcagaggtcaggttgcacaatccaagaaatttaatgcacgatccaagaaatttaatggaggttatagggaaagctagacaggtggaagaaaaaataagagtgttggccaaactgccaagaaacagtggaagaggggtaattgggcaaaaacctagtttttgggggcaaaggaattggaaggaggggcccaatataaggggaaaaggagttgagggtggtgtagccaataaaaatagcaatgaagggtggaagggaaaaagaaatttccacaagttgtctcccatggaggtaaatgaaaaaatgaggaagggagaatgtttcacttgtgaggagaaaataccatcctacccacatatgtaaaaacaagcagttaagagtgatgataatggaggaagaagaggaggaagaggagttacatgaagaagagaaagtagaaaaagaagagctgtatcaactaggtttacatagtattgaggggttcaccactaaaagatctttcaaactatggggtcagctgaaagagaaaagggtggtgatattaatagattgtgcggctactcacaattttatttcatcacagctggtgaaggagttgaaattggaggtgactgcaactaatccatattcagtagaggtgggggatgggcataaggtgagatgtcaaggaatgtgtaaaggcttagtgattaagctaccaggattggatataactcaagattgttatctgtttgagttgggaggggcagatttggttttaggagtagaatggctggctagtttgggagagctgcgagctaactttgagaaattagtgttgacagttaaggtaggagacaaggaaataaatctgaaggctgaaccagaattaatcagggctgccattagtatgaaagctatgcagggagtactgctgcaggaagatcaaggatttttggtagaattgaaagcagtggaggtcaataaaggtggcagacaagttcctgttgatataagggaacaattggagcaattcaatgaggttttccagacacctcaccatttaccacctcataggagtaaagatcactgcattaacatacagcctgggaataagataccaaatttgagaccatataagtatccctattatcagaaagatgagatagagaagttggtgagagatatgttagcagcagggattattaggacaagtattagtccttatgctagccctgtgatattggtgaagaaaaaagatggaagctggagattttgagttaattatagaatgttgaataaaatcactgtacctgataggttccctatgcctataatagaagaattgttggatgaaattgggggagctgagtggttttcaaagcctgaccttagggctggttatcaccaaataaggatgaaagaagaagatgtgcagaaaacagcttttaggactcatgagggacattatgagttcttggtcatgccttttgggctaacaaatgcacctgctactttccaagcccttatgaatgaggtaatgagaccattcttaaggcaatttgtacttgtattttttgatgacattctcatatatagtgagactttggaggctcatgttatgcatgttaaagcagtgttgcaagttttacagcagcagaagttatatgtaaatagaaaaaaatgcagttttggacaaaggtcattggaatatttggggcatatcatctctagtagaggggttgaggctgataaaaacaagttagaagcaatgactcagtggcctaaacctaaggatgttaaagggctgaagggttttctagggctgactggttattatagaaggtttgtgaaaaattatgggagaatagctcaaccattaaatgctttgttaaagaagaatgctttcaagtggggagaggaagctgatattgcatttgaacagttaaaaacagctatgaaggatctgcctattctaaaggttccagatttctctaaagtttttgtgttagagacagatgcttctggaactggattgggtgcagtgttatcacaagaaggaaagcctctggctttttggagcaaagctttgacaggtaggggccagctcaagtcagtctatgaaagggaattgatggctgtagtgttagctgtcaagaagtggaagcactatttgctggggaaaaaatttatcattaaaacagatcagaaaagtttcacatttctgaatgagcagaagctgttgaatgaagatcagtttaaatggaccaccaagctgattggatatgaattcgacattcaatacagacctggaagagagaatgtggtagctgatgcactttcaaggcagtttgctttcactgctatttcagtagtgcaacaagaagattgggaagattgggagaaggagctacaaaatgatcagcaagtgtttgaaatatacaaaggcttgttaactaaatcaatggagaaagcaggatatgaaataaaaggaggaaaattatattacaaggacagattggttctggcaaggaattcaaccagaattcctgtaatattgaaagagctgcatgattcacctgttgaaggacattctgggttttttaggacattaaagagagttgctggtgtagtgttttggcatggtatgaagaaagatgtcaggcaatatgtggctgagtgtgaaatatgtcagaggaataagtcaagtactttatctccagcagggttattacagcctttgcctatttcctctacagtctggacagatatatctttagatttcattggtgggttaccgaaagcaaaaggcaaagacactattttagtagtagtagacagattgacaaaatatgtccattttgtagcactgtctcatccttttactgctaaagagattgctgatgtttttataaaggaagtagttagactgcatgggtttccaaagtcgatagtttcagacagagatagcctgttcatgagtcagttttggaaagagctgtttaagcaaacaggcacacagctaaagatgagttctgcataccatcctcaatctgatggacaaacagaggtggttaacaggtgcctggaggtgtatttaagatgtttaactggtactaagccaaaacagtggcctgacatgttagcttgggcagagttttggtttaacactaattacaacatatccacaaaaatgtctccttttacaactctgtatggacaggaacctccactgttgttgaaaggtacagatttaccttctaagatagaagagattaataaattgacaaaagacagagatgagctgattcaggaactgaagatgaatttggtaaaagctcaagaacaaatgaagaagtatgctgataaacatagaagggaagtagaatttcaagaaggagattgggtgtttttgaaattgcagccatatagaatgaagtccttggcaaagaagccaaatgagaaattaagcccaaggttctatggtccttataaggtggtacagaaaataggagaagtagcttataagctagagctaccagaagatagcagaatacatcttgtattccatgtgtctttgctgaagaaagctattaagccaacttctgtggttcagccattaccaagtgttttgaatgagaattgggaactacaagtacaagcagagcagatcatgaaaacaagaataacagcaggagggaagcaggaagtgctcattaaatgggaagggcttccacaccatgaagatagctgggaaagttgggaagagatcagccgcatttttcctcacttggaccttggggacaaggtccatcttgaaggggagggtattgatagagagcagaataggtggggacaagtgtataatagaaggaaagctgttagtgagaaataagaattagttaactaactgaataaactgtcagttagttactaaagctgagagatataagtagagaataggagggaagaggggttaggcatgtaaacagtaggaggtggtgtacctcgaatacattgaatattgtaaccgtgagttctatgcaataatattcactctattcattttcgtcctccttgaattctgttttctctggtccagttctatcagaccaccaccatttcaactataggcacctcttgagccagcagaatcactatatttgtaggaattaggatgagaatagccttgggtgtaattcaatgagggagaactcagcacctgagtctctttgttgtaatgattgaggcatgtctcatgaccataaagcaaggcctctatttcaacaatagaaggagttcttttcttaccttcaataactaaaataagagaagcattatcaaagggaagcccttcaagtagagcatcaacatactcctcatgtctgactggtaatccaactccagcaagctcatcaacatatccttttatttttctcaagtaatcctcaatggttttaccttcaagagtgactgaaggcattgaagtgcgtaactgacaagcacgggacttggtgtgaaggctgaaatgttcatgaattttctcccaaacttggtaagaatgatttgaaccaagaactcttgatagaacagacttggaaagagttgactgaagccaaaccaggagtgtttgatcttgaacctcccaagtttcatattcaggattaaccctatcagccactcgatcatcttctgtgaggtacctagggggaactacaggatttacaacaaatcgctgcagcctatgggatttaagaactagttcaacatcttgacgccagtgaaggtagttggaatcatctaatttctcagctatggagttcagaaataactgtgaaaccacattcatagaagcggaagccatggattaactgacagcgagtttgaagtagcacaaatgaacacccagaacagaacagcaagccagacacgagccaaacacgcgccagaagttgaacccaacacaaaacaggaacttgaatcgaacagaagcaccagaaataaaccacgaaagatgatttcaagatgaaatcgaacttcaaacaccaccagcaatcgcgaaacaaaaaacacgaaccaaaaccgaaacaatatcgtgaacaggaacacaatttcttgaacagatgaacagtacgaacccaagatcactaactaaatacaagccagctatggttatcttgcaattagcagtcatatgaaagaaatggactgtgcttttgccattttggttttctgaagtaatctctgatatatttgctttgagttagtagaagagacccatcagccactgatttgatttctatgccaagaaaataatcaagttttcccaattgtttaagagaaaaattggaatgaagcttgttggtgagttgctgaaccataacattggaggtaccagtaataatatcatctgcataaacaaggatgtagatgatgtgtcctttgtctttataaacaaacaaagaagggtcacatttaccagctgcaaacccaagctataaaagagttccttttagcctgccaaaccactgtcttgaggactgtttaagaccatacaaagatttatttagcttgcaaaccaaggttttatctgaactttcaaagccttgtggctgctgcatgtagatagtctcttcaagatagccatttaagaaggcattgttgacatctagctggaacaaattccatttattagtgagagcaagagtgataatcaacctaattgtgataggttttatcacaggagaaaaagtgttaggatccaattgtaagatatgggacctggagtcccacattagaagtatcggattctagtgtggggtttataaggccttgggctctccagctacaacagctagcttttgtggtgtgattctctcaaggtttttatcagaatattttggaagaaactagattgctgaatgctaagcttgttgacacacatatggtttctacttccaaacttttaccaaatcagggggagccactttcagatatagagaaatacaggcgattgattaggaagctaaattttatcaccaccacccaaccaaatatctcctttgtaagtggagtgggtcatctgcttaactctccctgtgtagtacatagggatgttgtcatccatattctataaaaaaatcaaaggagctccaggagaaggtctcttgtttgaagaccaatgttatcaatggtggaatataaccgaagcccaaaattccaccatataaacacaccatgctgccatagtgggctgcccttcacaaattgcctatggcagttggccaaaaatctgtcttgccattccaccatggtggccatggcaccaccatttagcaaaattgatgaagacaaaggtcatactcgagttgtaggatatgcgaatgtagattggttaagctctcttgtttgatatgagatccatctttgtatattgtattagtaacttgatatcctggagaagaaacataatgttgttgcaaagtccattgtagaagtggagaactgaaacatgactttaagcacttgtgaacatatttggctcaaacaagtgttcaaagaactacagtttggggagacagcatagatgacatttttttgcactgatagtgcatcaatctctctgttcacaaatcgcgtaccttccgtgatctcgtccttgttcatctgttcgaaaattacgtttgggttcttgctgttcattcgttcaagaaatcgcgttccttgtcaactgtcaaggactgaaacaaacataatgaaggtgcctaagattgcctcaatgtagatggctactatggctgtgatgtaggcaagctaaagattttcacaaagaagcagactcccaaatcaaaaggtccgataccaacttgaaaatatataagaaaaatgaatattttattttcatgataatgataattgtgagagagcacatttatatactagttttaacctagtaattacagggaaataatcctatcattataattacaggaaataaaaaaaaattatacggaactattctgtacacgcaataaacatgccaaatatccaaacagcacatttttcacatgtctaatatattcaaacaaaaaaaaaaaaataggaaaagccagactgcaataaacccagagtggattaagaaggggggaaaagcaatggcactaaataaacatggagagagagaaacttacaagtgactcttctggacaaagagaactgccaaaagatgcacgtccaagaggtgtggtactgtagagtttagtgtcttcattccattcaagaaattttctttggcacaaccatcgaagggattcttgtgcagatttcaccacgtctagaaatggttttgtagaatttaaaagggtacatctaacataccggttaatatcgctagcagtttgaacaattcctccagccactacttctaagattgcatgggtcattccattcatgtcttctgataaacaggaatgtaatggaggacagctttcattaagcagtcccgaaaccttttttagttcttctggtttacagataagtatctgtgtaagtcaaaaaacaaaaaaccactcaactcagacctaattaattaaaacaacacagcagccaatgagacatagatatgcccaaataaactatgatatcaatgtaaaaaaagaaaaatgagggaaagagagaaaaaaacatatgttaagtcaacaacaagagaattcaaaacaaaaaaaaaaaaaaacaaaaagaaagagtaacacgtatgcttatgcttagtaacacttagtagcctggaaaaatcacatagacactaccatataatagttaaaagcataacaaaaaaaaagtcatacactttctccttttgtatcaattccagttcgaccagcacgaccagccatctgtttgtacctcgtcccatctagaaaatcacaaccaattctaggttggcggaaaattaccctcctagctggcagatttacaccagctgctaaggttgatgtggcagttaagacacgtaaaaggcccttccgataacaagtttcaacaatctctcgttcctcaacctatgaaacagcaaaaaatggcttaggccttgaaggttggttaaatgaaaataactttttcattatctacataaactggaatcaaatatcaacttctgctacccaaaaaaagcatgcaataacagttctagtggaagccatgacataaaaaagaaagaatggaagattaccgtaaggccggcatggtgaaatgcaacaccagaaggaagagtttcctctaatatggggtccaacccagcagggcactttcccaaggagttaatagcagaagtaatatcagcaaactcacaatcattagcatcaacagtaaagcttttaaggaactttgcaatgtgccttgcagttgattcacaacccttccggctagagcaaaatattaaaactgagtgtccctcttgaacaacctgaaaagaatatcaattgttcataattattcagttttcagtattacaatgtttagaagttgcagttaagactctagaccaccaacctcattacatagttcaacaacatgatccggatctttaccaccaagttcagccgcttttgagattattctacaaagttccatacttttgttgtaaatggaattaccaacttttatatattcttctagaggaactggccggaactcggtctggtatagtgctgccttgatgcaaatttgagacagatttataagataatatcaaaaaaagaagtattcatacaaatgtgacgtcaagtatgccagcaataaatagtcatcattttttttctgtcttctgttcgttcttccttcacacatacaggtctgtttctcttccttcataattcactatacagactttcctaattttaaatttgaagttttcttattttaatttcaccatcatctttcattttgacttcattcccatgttcttattttagagtatgacctgtttattatgaatttctttaattttgtctattttgggtaaaaaatatatttttaagtatttatttagtttttattataatatctgaaatagtggtcatcctgctatctgctatcctactatagtgttctcagagcaggccactatccagggttgatcattatgtgatttcacattttagcactttcctatatcttctctttcttctatttcatcaataatcctaaataaatcactaatgtcactaaatttggttttctgctaccaatgggtgttcaggtgatacatgcttgattcctcttatgcaaggtttttgagccttgagtatgaaaaaaacaaaaacagcagagagctagcctcacgtgctgaggatgttcccaactcaaacaagattgcctccctatggaggaaaactgtggtcctacaccaaaaaaaaatgattttctagtaaaaattatagacggatggttcaattaatatttgcaaaatcttatttcctctatttccagttactgttcaattgcttgtagcatttctttctttcaaatgtataattcagagtaccaaacatgctgtagctaacatagcaaaattaggaggaattaggtcttttaaagaataaatatcaatttatataaagttatgctgatcaagtttaaacaaattaactcaattatacaaccaaaagtcacaacaaaacacgacagttggccaagagaaagaggaagcccaacaattgctctatatgttcatgagggtgcggtgcttgtgattatgcttacttgaagccagtcagcaactgctgcaacatttggcattgttgcactcattccgacaatttgcagaccttgggcaggatcagccttatcactgcttccacctgaactttctccatcacttgattttggaataccttcccctgatgcataacgaagctttgtcaacataagttcaagtagataacctcttcttggatcaccaacctgttaacagatgtagacaacaataaaccatgagaaccatccaagtgtaccatttgctgttcagctttcataatagtccgatagaaaaatacaggggaaagtagcatgtaatagagctcatgacataaagagtaatgattgatgataccatatgcagttcatcaattacgataattcccatttctgatagacgcccctcttccaataatctattaactagtgagtttgccttctctatagtgcagacagctacagaagtatctttaggaagtgttccaccaccttggtttccataataactacgaacatgtttaccaagtggctcaaggagacgttcaaggtgttctgcctacatgaatccaaatgaaaacacaacaagtaaattcaaaattttgaaatattttaaaactgaatgcctcaaacaaaatccacaagaccatagccagaaatgtaatttctaaatttaaggggcaagaaaagagaaccttttctgcacaaattgatacatatggaagaacaagtaatgccatttttccagttattatcaccctccgcagcattaaaatctcagcaacaaaactcttaccagcactgtggcaacaagaaaaacatttaatacatgccttcctcaaataaaagacagaggtatcacgagaaggacagagtaaaaacagaaagtgaaataaaatatcaaaggaaaacaaaaaagagacaagagaatcacgtcatgtcaagaactgaaaacataatggagaacatgcaccagaattacaaagaaacagcataaagaattcagcaatcaatgcaagagaaaaaattataaaatcatgtatggattcaataagatgagacgttcagtacagaaaaagaaacatgaaatgaaacaatgacgttgtatatcaataaattaatggtcattaccaaaattgagactctagcattctatataaaagaaatctatcatgcacttttccacctcgtttgaacagaaaccataaaaccatcccctcccaaaattatatattccaccccacctaattccataacttttaaataaatgaataggacaaaaacataacataaggtttacattaattgctattttgagagagaataaataccttgtagatgcacaatatacaagatttcttctctgtaggacaccatccactcgaaggcaatcaacctaaaaaatggaaaataaataaaaagccttattaaacttacatatgccagaaacaataagattttaaaataaaccattttaaagaaacttctcagtagatacattaaactccggaaagccacaacttttgaaaagaaattaagataaaacaactagtagaagaaaaaaaacaaagtagcagccatgattaacagaaggaattcatttatttagatggtaaagcactacaaagaagtgatgacatgagaagaatcttcatataaaatgtgtacctgccaactgtaaagccttgagattcctttctttccatatatgctgcatatttcaggaggaagccagctgtttaggtcaaaatgatcattaagtgatacactagttgaaggagtactggcttcatcagatgcatgtgcactaatcgatgtcctgacctcattgtggggtgaattagatgtcatactaacattatcctgacaaaaccttttgcctaatgtatctactaaagtattctcttgcacttcattcatcttttcatatgtatgacctatcatagaacatgaatcatactgtttaccagccacacaactaacattgattgaagcaccaacacggcagttttgcaaggtattttcttccaaattgttgtcctcaaacgaaaaatcaaaatgtttaacaggaaggctggatgcttctttcacagaatcttttgtgtgcatcccaactaaccctaaaggagcacccatttccctattccggattctgtttttactttgatccaatattttccttggtttgccatcgtaattttgtaaattgcatgagttcttcatctcaggttcctcttccaccacattactttctcccataaccttagaaggatcattacccatgggaacacacaaaccatcagcaagttgaattgcctcattccaaaatgcctctccaggcgaaaatgatgagctgccacgtgttgactttggagtctccctaacacctgctttaacaatcaaagaccccggtgtgtagtattcagccaatttcattgatggtttaggtgtgttattacatttcctaaagcctgtctcaaagccagtagtatcaccaccaccaccagaaacctgtctctcagaagccaaagcatcaaaacaaataaaacatataccctaaatcaatcaaaatatcaatctagctataaaaaaaatccaaagtgacgagtttgagcttaaccttcatacaagagccaggaacacatcccatactattattattaccaacaccagacttgatgtcttcatcgatcttcagaatcgacaatgtattttcaccaccaaaacatagctcactggcagtgtcattattcttccccagtaaaacactatttccccctactaatgttggtgaaccatgtctcttgtgatcatccactttcatatcggacggcaaacccacactcggatgcaatacactgcaagtagcataattcaaaagctaataaacaaacacatacacaagtaaaacaacacaaaagagaactaaaaccacgaagtaccaacaccagtcctccatgaactaaagtggaggtacccaccaatctctattcatttttttcaaacagatagagtaaactacctgcaattcaaagacaaaaagtcagcagcaaactgtttcttctccaatttcgccacaccctgtccaagtgaaatttcacttggctgaatagattgagaatctccacacccttgacccaatgaaacagtatgcttattaagctcattgtcaagagaaccaccaatctccgatgtcaagtttctcttaaccttaacagtgtttgtgtcgccccggccatcaccaccaccgtcctgtgacgaaaccaagtaaccatccaaagtgcctttggcactcggagacgcatcagccccatgcctcgcacctttttcgaatctcccagctttaggaacaggcgacgcagctttcctcttcttcgaaacgtaaaactgcccacataaatccaataacaaacaaacgcaagcgaaaaaatcaatattagtaaaattaaatcataattcgtaaaccacagttaagcagcaaagttcaaaaattgtttaattcaatttttttgtatgttttgattttgatatgagaggaaggtaatgcggaacgaaacggcgttgtgtagggttggggaaacggaaacgaagaaggagaaggacctgatcgattcgagagcgatgcgaaggagaagccatgtgaagaacgagaaggttgggttgtgttgtgttgcgttgttgttgtttttctacttcttcgccttgcgctaaccatgagaatgataatgcatcatacgacgtcgcataatgcgttgctttgatgcttcgcgagcgccgagtggaagagacacgacgaaccgagcggtttgtgctctttggagtggcgctctcactgaaagttgcaaattgaaattgaaattttcgggggagtgggctgtgtttgtcttccgggtaatgttatacctacaaccggaataggaaaaatggaaaatactaacgtttataccaaaatgagaaatattaagttgtttggtttgataaaatattttttatttttatttcttgtttttattttttgaaaaaaaattcattttcaaattttaaagtttaaaaatatgtttggtttaattttttattttctgttttcagaaatgtgtttggtttaactattttcaataaaatttcatgaaatgattttagtataaagttaataaataaattttaaaaatataatatgtttcctgaataagaattattaaaataattatactatttattttaaaaaataaacataaaaattaatatcaaatcttaagtctcacaaacaaaacaaatctatacataaatcatgactaagtctgacaaaatagaaatcaaatcaattttttcatgacctataataattttccacatttgatttgcaatagtttctcgaacttgtctcattttagcaacttggttggcatccatattaacaccttcttggtctacacttaaatcttgttcgtctgtaattaactcttatttgtcatattgattaaaaagtgtatatatgctctgttgcagtatgataaaattatgtatagtgcaacaagcaatacggatcagtttttgtcttctaacaagataatttggcatcattggaaaccttgcttttagtattccaaaacatctttcaatggtgttccttaacctctgtctacgaaatggggcaagataaccaggaatatttggcaatccaaagacaacaagataaaattggtttgtaaaataaagaatgcatttattcaataactcttcaaggttaaataaagaaaatttaatattaaaaaattcctccaaagggttttggaaaattattttaagaatttaaagcatccataaacactcttgcatcatttgttgtcccttccctgccaaaataaacaaatgtgaataacataccaaatcgcatattgccaacacattttgtgttaccaagatttttcttccgcaaaaagcaatgtgtttagatgcaagtacctaagataaaacaagtgtaccataatggcaccaatacaattttgcataaacataaataagaattagtataaaaagaaagaaaaatgttaaatattttaaatataagaatagaaaatactttaggtttctttcaatataaggatgtggagttgtccaacttctttggcaaatttacctttatcttttagttattagttgattttttctcaattgagtgatcgttctaatgtaatgaagtcttctaatgataaagtcttctcataactatcacatattctctaaaaaatttctttatttcaaaatattcaaatacattttaaaaaaaaataactaaatatatttagataaaattggatattcacacctatgtataattctcaaattaattaaattcttagtaattttcaaagctaatttctacaactctttttaattattttaatttatcacaaacttaagtgcaataaattatttaaactaagaatcaataacaataacagagtaaaaataaaacattatttattttatttttttcaattaaagaaaatttttaaaaagtagaggattttatacatataacttcaacaaggcaaaagaacctaaataatattttttttttatatttaccaaaatggggcgctttccaaaatatttacaaaaatggggcactgtaacatgcctggattaggcatgttacaacgcgccggcgtgttgtaacatgcctaatccagacatgttacagtgaccccatttctataaatatgccccccaccattttctcactttccactatctctctagaagtgctctaccttctctctagagtttttcggtggatattttgtgcagcgaagctctgctgaattgtgaagttttccagaaacaatcctgcgaacaagtaagtggatttaattttttgcctctgttataatatttttagtgatgttgttattatttagttatttatattgttaatgatgcatgtacttattttttagcaaaatagatgttaggttacttaataattgttttagtttagggtttaggatttatttattagaaaaatgttaggatgatgttaatttgttagtgacataaatttaggtagatagacaattgtttaggtatttggtactgtagtgtttggataaaatgattagaatttaaaatttagggtttgctgggcatggttaggttgtgtttagggtatactcatgtgacgatagtttgtggttaagggtttagggtttggtgggcatgagacatgacgtttgggttagggttggggtagggttgggtttcatggtcatgtgacgatggtgtgcggtttagggtttagggtttggttggccaggtatgtgacgtttgggctagggttggggtagggttggtgtcatggtttcggttgcatggattagggtttggttcagggtttggggtgcagtgattagggtttatggttttaggccgaaccgggtcaatgaccgaaccggttttcacaactacggttttaggttttggtttttgggtatagtgtttagaaatttgttgttttaatgattttgtgaattgtacataattgttaacatggatttttatttttggtgtatgaagttactgataacatggccgatttatctggatctgattcgccgcgctctgtatcagatcatgaggctgagccgatggatccaacatcttatgtggttcctacctcgtacagatagggcgctttgcataggcgtactcagcgcacccatgtttcacaagctgtgtggaacgagggcacaatacaactactaaagactcgacatggcaagttatcgggggggccagcatatgacaatattcctcaagtcatttctgatatgctgcgggacgctggctttcttcatgtcgcacacatgcgacatattcaggtatgcaacacctcatattagtaatcaaattttatttaacgataactatagttgtcaattgattaatgatattgttttagattgatgttgggctgattaatgatctggttgagcgatggaggccagagacccatgcgttccacatgccacatggagagatgactatcacgttacaagatgtggctggtattttgggattgcccacggctggcaatgtcgtcactggagtgactttgtccgattaggcggaggtcattgaggatgttttcggtcaagaacctgacgacgaaacagagctggccggtggatatctacgactggtttacttcgataggcattttggggattggagtgagttggataaagattttgtcaatgtgacgcggtttgcaaaggcgcacattgcccgccttattggtgcatggctgttcagcgatcgatctggaggtagcatgatggcagcacgctatatccctttgttggctggggatttcccagagatcgggggatacaactgggcctctacggtccttgcacatttgtttagacagatgtgcgagtgtgcagatgcatccagaaaggacattggtggataccatatgctgcttcaggcatgggcgtagctgagattcccaccaattgctccatgtattccgtagcctacggaccgacattcgcattttggataccggtatgtgtcactatatgttcattttataacaattttaacaattaagccctacattgtttaatgttagttattttgttaacaagtttaacgggctaccccggcttagcccgcacaaggtggtctgtaacgcctctctttgctctctcgtgtttgattgattttaattaaaaacttgtgtccactttgtgttaaaattagattagtataaatttttcacgaaatttcttttcgcattgcttgctaattttaatagttgtcagtaacataaacgatattccttccctcgttttatgcaaataaaattcattaatacatattgatttattaacagtccaagtacagtccaactagttttgtacagacagcgtattacaacacggcgtggcaccaaatacagataaacagaaaatcacaagcacagcataaagtacatccagcttctttgtctacagcttatgctatcctgtttctctgctcgcccaaatgaattggggtcatcacaggtgtcaaccacagacacaactcgggtaagtattttaataaacataattagataatcaataggaaacagaatagtatatcaggtacataatagatttaaattaaacaacggatatatgaggtatcataaataacatttatagaacaattatatgatgaatgatgcatggtttcttatttaaatgatgcatgactgagatctcagcttctcataaaatcaacatcagtggccacagtcagatagccccaatcactggtccagaacttgcatgatcagtcaggatgtcacagtggtgcacaggaaagtcacccacactacatgtgatcatcatgggtggcgtgagttccccactgccgaagcatcccccagctcagactcctcactgtctgaacgctcatactcagttcctctaactatctgacaaacaacttcacggtttaaccccccgcaaggcatcaactccacggattaacccccgcaaggcatatgcgtatgaaaatgcatgaatgatttattttatccagtctttaaacatcattacaactcatggcttttcacataaaacttttacaccttagtctcaatatacagccatgatttatcacaacatttggaatccataaataatcccaacatctttaataatacgaggattcctacctttataattttctcaacattaaaagcataacatcacccaacaacttgcctcgaaggatcacatacttattttatttctttgaaatctttcatcaaacacttgatgtgctttatggagcactcaacataacaaaacaacatacaacacattaactacagcaacatatatgtacagcaatttacgacaacatactaatgatatacaacaacagcatacaactttattggattaatttacagcaactaaggaatatatatataacagcatataacatacagcttctaacaaccttatatacagcaatatattaacatacagccccactaaattaacaacccaacgtcatcaaatacttaactatcaagaccacaaaattaatccttttaattaactattttcattctagacttaattaggtatccaaaacatagcatatagatttttaagttcattgaggacttttatcaaacacatggtatgcctaacttaaattttcataaaacaagcaagaacatggctttaatcaaaaagaatggaatcctaatcaaccatctaattcatgtttattaaaatactccccataccttggtttcctaagctttttggacagcccacctcctttgaatttgaagaattcttgctcctagagtggctagtcttcacgtggacttctaggattaggcttttgtgttttgtgttctaggtaaagggtattaagatgaaagaaaatgaacaagcttttgggtgtatggtgcacggcctaagctctcttagaactgcccatttctggtcctacacccctttttataggatggttaaagcttaaaatatcaaaggatgatgattactaactttccatgtggttagtttttcattggctagccattcttcatgttccaagtggcctttttcttgatttttctcaaggtttcttcattcttcttgatggtacacgtgccatagcttgcttggagagcaaattctaccaatttacgtggagtagccaagcttttaagggaatttcgtgctttcttcatttcttgaatcttccaaaacccattttactaaaatattgattctggattcattaaccgttggatcttcttaaagttttattggtatattcctaacttaaatatataggttttgaccgttgggatctttgaaataatgcttagaatttcctccgtgtctaaagaagtcaagaggaagttttcttcaataaaaatctccttaaaccattattacttcctttacacatgcttttcttttattggctaacaaatggcttgcttccaaatgcacatgttcttgagttttccactgcctacttgcttcttcatccatcctcatgtgccaatttaatttatatagtcaattccatgtagcttgattccatacggttggtgtttccattttctttattttctatgtcttaaatatcttttgtatgaaccaattagaatgagtttagacttttccacattccatgtaatcatgttttgacctttcctaaggcttttctcccttaatctatattttgcacggccaagtctcatttttaagaccaaacctacacaatttatccttttatgtcatgtataaatcaattctagtttcctattggtccattacactttttatttaaaattactaaactaatttgttaaagaagtctatttatcctataattaagagaaaattccatagattatgttcatctttttcttataatttttctgatatccgagttagtctaaattaagtttcttttcaaattaccttccaaaatttctagaaattctaatttagggttctttgcctccatccttgctgataacctgttatctaaaagtattttatcctatgctcaggttcctattaatttctaaggtcatcttggtcaattttgacctagggacattttggtaattttacccttcaccctaggggtataattgtcatttttaaaaatgttcagggaaactctgtatttgttaccctaagggtattctgatcatgtttcaagcatcccagagtatttgtaaagtttcctccttaagacatcttgctaaaatttctaagggcaatttggtcattttcaaaaatatccagggatatttgcgtcatttccctcaaatctttttatactgcctctgatcacattttaccctaatattttgaatacagaatatcaatccccttcaaaaatttggggtgttacatggtctactacaggatgaccttcgatgccctcactcgggataatgtatgtatagtgattgtttagtaattgtaagtttgcacttgtggtacatgtgattacataaaacaagctaacttttttttatgtgcaggttgtctgggaaccatatggggactacgatttcgttggtgcatctgaccatgagcgattgttgtggatggcatcaacgccgattatctgtttccacacagttgaagctttccagccggatagatgcatgcggcaatttgggagggataagccaatcccacgtcctgccatgaaacttaagggtgtgcacgacttttcactgcgtggtaaacaagaggaaaattgggttcgtaagctcagatcgtttatcaggcgctggcagcatagggaagagcacatcgacctccccccccaatccagggcttaatgtcaccaaactatgagtacatggtttggtacagggaaaatgggaagcggtttatcaccaaggagggtgccaaaatgggtcgtagtgtaagtttcgttttgatgaattttttttgttatttacattaattatcataattgacatagttgacactggtgtttatatatttgaatttgaatttataggtcaatgggatagagatgctctacttcgcgacacttaggcagaatagggcgacgttcgacttcgattgggctaatcaggagttgggtcgcctaatgtctgtcttcacacaaagttgttaggtggaggaggctggaccacaagctcccgagacgtagcttgagaaggagccataattgtctcttcaagttggtcgtcgcagaagagagggacgtggtctagatcgtcgacggttcagtaagtcctcagcccattgttggtcccggtcctgccgccctgggttgttataggcctccaattattgaatcgacatatgggagccaggtcttttatcatgatcctattgagcatattgggtcctactattacgaggatgttcctccaccgggagacacacagacgcagggccaatttgtagacgttggctttgggaatgtccccgctaattggacgcataccaacgtcgatcagatgctcatggagtttgatatggccacaacaggttgtgggggttgggcaacagatgcaccatatgtgcctgaacctgctaagcatcctatgccattatatgcagaccagggcactccatgtccacctccatatgtcccatcatatgaggcaggcccctctcaggcacacctggccgagccaggcagttcccaccgacctcgaagacggaggcaacctaatcgacaagcgtgtcgtcaacagtggccaccaccgtcttagttttagtcgcctgcttgtaccattcgtttgtaccatttattttaatgatgtgtattgtaactattatgtatgttacatttgtttgtgctatttattttttttaaatgatgcttagtgtaagtattagttagcttataattgtcgtggaatgcacgaattcatgtgaatcccatttttttatgcaaagaacagtaaagtcataggtctgaagtaaaaaacaaaacaaaatgttcatttgtaataagaacaataacgtaaaacaacatattcagcgcacatttctcattccatctgcatgtccggtttgctaaaaatggctaaaatttcaattggacaaaaacgtttctagtagttcgattctgctatgatcttcaacacgtcttcgtcgcttgtcaactcttttatgtgatattcgattgtgctagtcgaatattgtgcatggcgtggatgtcaaaaaaacaattttctcaccacctgtgacatgtgaatcccatcaagggggaatccaaccggcgcaacttccttgatgacaaccttcagtatttccatggtgcatgcagaaggaatttgaaattgtattgggtttgctccagtaaaggcataacccacacaaccggttcttcggggtatggtccactttccgttgtaatatagcatagcatcatgcgttggaacgattgtggattgaagtaggtttagtatgccatcgggtgttctgtggatggcatataaaatttcaattgggccagaactcgacatattgtcactgcaccttaacattctgcaaacatcatcatcatttgtgagtgccacagaagtaaaaaaatagtgctgacctgcatgcagagatggttgtcgatagtagatgttgtcaacaacatggtcatcacgaagaataagggtttgatgcatactactcttcagggtttgaaacgaacagtcatcaggaactcgcattggaattggagttgcacagcggaaagaaacccttgtttagtcgtgcttcgttgatccattcggataaatgaacgctaattttgaattaccaatgttctgactgctggtttctcctaagaatgtcatcgtatgcacattgaattttgagtgctgagcatgtgagttatatagggctcaatggcatccaacttgggcgtgttcagtcacgtccaagttgggtgtgttgaatgatggcctatttattaggcgtgttcagtcacgcccaagttgggtgtgttgaatgacgcctatttgttaggcgtgttctgtcacgccgaagttggacgtgttgaatgacgcccaacttgggcgtcttcaagacgtgtttagtcacgcccaagttcggcgtgttgaatgacgcccaacttaggcatcttcaatgacgaccaagttgtgcgtatcatgtcagaccttgtttgacagcgtgtagtgaacatattgttacatcaaatgcatacattatcagacaacaaaaaatcaaacatgattagtattaaaacgttataaagaaaaagttaatacaaaactaatataacataccgaacaacgttgtacattaacaaacaattaataaaaaaaacatacaaccactcagaaaatcatgaagtccccccacgactaggacaaactctccggttgtgcccaacttgcttacaaatgccaaacctcatacgtctctgggatgttttaacttcatccatatcgttacgtattctagtggaccttggacgacctttggcacgcagcattgatttgtcaggtatgatgattggaccttcaccaggtggaatggcccgttcattccctatcgactgccatggcactgaatatgcctgcaccaacatacttacaaggaatgtcgtccacgtactgaaaatgattttggcggacatgtaaagcagtagctgcggcatgactgcatgggtatttgaatgccttgaacttcccacactgacaaacccaatcggcaagggacactgaatatgacttgtcgcacccatcatccacctgaaataacgttcgagcaacgttatatctgcgtacatggtgccctgaagccaacgactgattacgcctcattgcttcaaccacatttttgcaatatcgttgtgaatgctgaagctgttcgacagccgcctcacctctgtctacaaaatactgaaccagtcgggtgtacgtgtgtttgacaagagttgtgataggcatgttcctggctcccttcaacaccctgttcactgattcaaccaagtttgttgtcatggggctgtatcttctcccctccacatcatatgcacgtgtctatttctccttggggatggaatcgatccattccgcaacctcaggactagtctcacgaaatcgcgcaaatgcgatgtcaaactcgaccatagagggtgtataacctgcaacatcaaaaaatacatcaacataattgtctttacaaatttttgtaaaccaaaagtatgataaatatcaatgtttttagtcacctaaattcatgagggccttcttcagtcttgcatccttgaatctttgattaaaattactgacaatgtgtcgcaggcaaaacacatgatgcacaaaaggtggttgccaaccaggatgactttgaacggcagatataatgctcctgtggcgatctgaaatgaggcatatattttgcatgtgagtaacgtggaagcgaatgttagaaaagaagtaattccaagcttccagcatctccccctcaacaatggcaaatgccaaagacacacattcattattcccatcctgagttgtggcaaccaacaattttcctttatacttgccatataaatgagtcccatcaacttgaatgatgggtttgcaatagttaaatgcctcacaacactgtccaaaagtccaaaaaatacgatgaaacacgtgctttgcccgtaccagtcgatttgcaacgaagtaatcattcgtctgaatatcaaaatatgaacctggtgcaaaacgaagcatgtagttacaccacctgggcaagaatgcataaggttctacccagtcccaataaaccattgccattgctttctgcttcgcataccaagcctttcgataagaaactttaaatccatatgtgttggtaatcctctccagaaccaatgagattgacactgatggttcctccttaatcattcctaaaaaaacaaaagtaacaatcacatcaataacatgctttgagaacaaataagttttctaaatgcataacagtgaattaaaacataccaacaaccagtgcagcaattacgtcagaatcaagctgcctgtgaccctgtgaaatatgatcatttaagcaattgtgttttccaccccattttgaaacaacccacttctcacggaaaactggtttaataaccctaaccctccaagggcaaccatcaatatgcgcaacacacttcatggaaaacttgtcaggcttgctctcaaccacagttgcttcttgatgctcattcatcaagttatgcttcactgctatttgcgcttcctttttcaagtcaaattcttgtttaacaaacaaaccatcccctagttgccacggaccctgcactgatcttcggagaatgccctctttctctttaaagaaccagaaccgctaaaagagtcttgttcgggtgggtaactccaatcaatatatgtataatgaggaattccttgccagaaaggaatcacctcagcagctgcacattcaacttcagtttaattaacgatatcaactaaaaagcactagcaacacaaattcttaccaacaaaatgaatcacttaacatttataagtatctatctaaaaagtaactaaaaagaaaaagccctaaaccccaaccaaaccctaaacaccatgtacgcctgcaaaccctaaacccaaatccctcacccgaatacccaaaccctaaaccccacacctcaacagaaagccctaaaccccaaccaaaccctaaacaccatgtacgcctacaaaccctaaaccctcacccctcacccaaatacccaaaccctaaaccccaaccaaaccccaaacctaaagaaaaagccctaaaccccaaccaaaccctccaaaccataaacaccatgtacgcctgcccacataaccctaacccatcatccaaatacccaaaccctaaaccccaaccaaaccctacacctcaacagaaagccataaaccccaaccaaaccctaaataccatgtacgcctacaaaccctaaaccctaacccctcacccgaatacctaatccctaaaccccaaccaaaccctacacctcaacagaaagccctaacccaatccaaaccctccataaccctgtactatcaatcctaaatcctaacccctacctatttaacccaaacaataaagcacaaacactttcgattaaacagcattcacctaaacaattttctatataaaacaaaattctaccatcctaattcatttagtcatccacgtaaaccctaacaaaataacatcatttaatgcacattcaaaaacatattaataaacaatataaaacaaattaaatgagaaatatgctacattctaattgacatcctcagctaatttaccttgttctggttgactagaaccactctccgcatgatcacgactttgagatgtcccgacattaacatcttcctaatgcaaaccagcatccttatcctcatccgacgcactagcatcctcctcaagaagccgatcttccattgcgatattttcatcatcgtcatccacttcatcgtcatccataacccaagttgggtcatgtgaatcctcctcagacacgtttacctctccaccaacaaatgatgctcctccaacagcatacgatgcccctccagcagcatatgatgatgtatggtgtggaactgcctggattggtaaaccaacatcctcaacttgtgtaatatccacgtacaactccaaaaaatctttccttgcctggttgcaaaattcatccagtaccaactccacgtcttcatcatccattatttgaaaccccatgaacttctcgtgttgccataatcttcccatcagtaaagtgatacattggttgctatttagacataatttttgccgtatcttttcatgcaattcactaagtgttgaggtacgcttcacaaaggttcctcgtgtttccccttcaaaaatgacaccctgttggacttgacattttcttccattacaatttaagataacgcgaatagaatcagcacttgaactcatgcttctcgtcactcaaaacaacttcaaaaatctctggaaaaaatgacaaaacactagaatagtaggtagtttagcaaagacacagaacactggaaggccaactatgagggacaaatggtggggggggcatatttatagaaatggggtcactgtaacatgtctaatccaggcatgttacagtgccccatttttgtaaatattttggaaagcgcccctttttggtaaatattttaaaaaaatattatttaggttcttttgcccttcaacaaagttatgttcacatccaatttattatttatgacctcattatcttttgaacaaagagaaaaaatatattcaaatttatgaggtttcatgttttgctatgctttctctataagataacgggttccatactttccccattggacaatgataagactattttcactcatcttatgcttatattttatgaggaaatatggtgccaaaaattttagaatattttaagtgattacactactaaaaaatgattttttacgacgcacattcgatgacgattcccaaaaaatcattgtatataaggcagtgataatttcataaatatgtgatttttcaacgaagacagttttacaaaaatcgtcttggaaactaccattctaagacgattttgtaaaaatcgtcttagaatggttgtcattccatgatggctttccaaaaaccatcttaaaaggctatcattctaagatgattttataaaaccgtcttagaagtttgtgtatttttaatttttatccacacattctaagacggtttcataaaaatcgtattagaagtttgtgtatttttaatttttatccacacattctaagacggtttcgtacaaatcatcttagaagtttgtgtatttttaatttttatgctagctctttatcttgaaagaaggtgctatgtttattattcttaatacaactattagccttaggaatcatggatttaattgacaacgttatgtataatatgcctatgacttagaaaatttttcccacaggaattcaacattgttttttcggattcgtttttccagtgatgtaagggtatgtgttttttaccggcttcttaatgtctcattctatttggtgatgccattataatttgtacattcttgtcattgtttaatttccttttgggaatatttggtaatttgctaatcttgcttagcttcacgagcctttagctacaatcaattaacaattagcaattaggattaaaatcattttttaaatgtatgttgatcgatacttctttttaaccttgtgaaatttcaaaaagatattaactaatagaacaggttcgtatgaaaaacccataaaaattagccacaacctatgatggattgataggatagtatccaacatattgatgtgattattctaaaaatataagagatacatgtctagctatttataaaaattcataagcttcaactttttaattcattgttaactagaatactcattcgagcaataggaacacgtacatacaaaatactataatctccaccttgttgaagatctaatacatgttccacacatttcttgtttataactccttccaggtcatgatggtgctcgtgctactgagtatgtcaagtaaaacctatttaatactttcattagtcaccaaaaattcatttctgacaccaaatcagcaataagtatgttgtctctcgcctgtcacttccaggtccttatgtctgatgttctctgatttgctaaatccaaagaataactttttttcctaccaaaattttatttccacagctgatgcatacaatcatactaactttgagttgttgaaattaggaaatagccatcacagagatgcaggatcaactgcttccactgctattttagttggtgaccgcttgcttgttgcaaatgttggggattccagagttgttatatgcaagggtggtaatggtaaaggtgtaggctttatacatactataatattgtatgcatattttgtactataatatattttatgtctgatatgaaagtaatttatcgtatagcaggagaaggaggcacgagacatagagcttccaaacattagatgggaggtttttgagctgatgatgaggtcaaataaattttgcattaatgtgctttatgaaagttgtactgtgaaagcttgtaataatttgtggacaacttaaatctttctccagatttatatacattggatcaatagatatttctcaattttttagaaaatacattctaagacgattctctagaaaccgtcttagaaagtctacattctaagattgtttttgcataaaaccatcttagaatccttaatttttttttataaaaaaaagacattctaagacaattttctagaaaaccatcttagaaattggacattctaagacggtttgagaaccatcatgaaaaatcttgactttccacgacagtgacttcaaagactgtttgaaaatcgtcgtaaaaagccccttggaaccatcttgaaaagtgactttttttagtagtgttataagaaaatgtgatgccaacaacaagttttagatttgaaaagttactttttaaaatttaaaacttcactattattattttttctccatacattaattatgtaggcaaaaagctattatgtgggacaaaaataatgtagttaattctaataattttaaggttaattttgtaaaatgttacaattaaatacaaatttaatgttatcaactaaattaaccaactttatgaatagatatgaattagatataagtgtcttacatttaagagacaaaggaaatgtgtgtgtataatttactatgaaaaatttatgattcaagtgtatgagtacggttacacgttactaattcaagtttaataacatgtaaaaagttcttcataaaataattaattactaaatacaataaatcaatagaataatattaatgggtgaaatataatatcttagttcaagaacaaaatttgttatttcacttcttcaaggtttttagcatgaatcatgatgataagttgttcattatattgttatttcatttagattatttctagtcaaagcagtaatataaaacatattttgttacttatgttttggtttacatgtttcattttgtttttagctaacaatcacatcattgccatgtcaaaactagcagagttagacacaatttcatgtaactatatgttgtttatataacatggttttgcacttgttcattgttgattcaattataaatatgttaacttgtatttaggtctcaagacggttttaccaatggaattaacaaccaacaatattgaaagaatgattacaaatctcatgtttaagagcatgaaattcaactacattctccaattacatcatcaacaaactctattcaacatgttattgaaagtaatagtgatctacatggaaacatctcaaaacccttaaatatggaagaaaaatcttgctatttctgaatgacgaaatacctacactaattgaatgtaacaccccggatgtctccggcatgttatcatcaatgatatacataacacgctatcagcgttaactaagcgcgatgcggaagcgatagaatcgtttatcttgattacattatgaatggaatataaaaaccatatataaaaagaacataaaacatgcccctgctgatccagataaaacataacaacactataggcagatacacaacataatcatacagagacgatcaggaggaaacatacatatatacatcctcatcatctgtacatatacatgctcaaaaacaagatcacagctgggtcatacattataatatgtacaggaaatgggtatacacataccctacaactacacagagatataagactagcttcaacacttgaagttctgctctggtcttctactgcagcctcccatccagcctatcaagtcactagggcctcctgccctgaggtagctcctctcctcaagaagcacctgaaaaccacaaaccccacacagagtgagacaaacgtctcagtaagctcagggttctgggaatcctccctaaccctggttcaccaccaagcataaacacaacatataaacagagctgaggaaatcctcctagctcacacatacaaagactaggacaatatcctagctttcacacatcccagccatctgggtccataactggatgctctcagcatcagaggtattccacctcatcttggctctctcagccatctcacagagatcaaagccatcatcatggcatcaatatctcatctaggctctcatagcctgtctcacagacatctcatagaggtacctatcatagtgtctctcactagacactttccatactagagaggcaccgcctctaaccacacaaacattgcctgaggagatccctccactcaggactttgagaatacaaatatggctcatctaagaggccctaggctctagtcccccctcgggaagccctctcttagagatacaacatatctgcctatcatctggcctggtaaaaccctccaggactttcataacacatgcctgggcaagaacattcatatagggcaatcacctccaggactttcacacacactggcctgaggataatcagtcaggacttccaacatctttacctaaggaggaacattcacacagttccatctgtccttaggacttaggtggagagcagtggcacctcccaaggaatctcagctattccaaggagtcctcaaactctacctttggctagggaacctcaactagcctgatactcatccagtatcttctaggttccatcacagaccatctcatgatctgcattctctcaaaaggcccacagcctcacacctgccatatcaggtgtctcataaccctcacactgtttcagtgtctatcctaggattcatctttctagaacagtctgagttccactctaagtaccgttcttaaagcccttccggcttccaacacatataattaatcaaacaggccactttggcctttcattccatagcatgcataatatatatatatatatatataatcaagcaaggcatgcattcgtcacccacttgggtggtaaacaagagaaaaggctaatccccagaacgatgagcttacctagctagccgtgcctcttagctctagcctccactgatggtctgctcctctgacacccactgtgtcaagccctaccaaggcatactagcacacatcacagaccatacaagcttcaaacatgcacaagctcatatagcagtcatccactgcatctgggaaaggaaccacagtccttcccatcaacccagtccactactctaaggttcatcaggctcatccatcacaagcctttccatagactatcagtggtctatcacagatcaaccatggcctcagagtcattccagactcaaaccaagccatcaccagtgagcatcaaagctctctcaacccaaactctcagggtttcttgggcttgaacggttcacatcacaggacaccgttaccctggccctttcaggcgcaacaagcccatcagtaaggctctggcatgtctcatatcaaatgactcagcataacttacacatgccaccacagagccaaaatccaaagttatctaaatcaaaaactgaaagctattccttcatcaattcatcgctctgaacacatctctcaacaggaccctgggctaattctatccccagctcatatgggtcactattcataaaaacccacaggatcaaaattaaacggagaaacgtgagtatcttacctcagtgacgactcaaaagacctcaggacaacttcctcaagctctagcgtcctttatacgttgtgggtcctcgccaatctcaagttctctgagtgtttcctctgagaaatcactcctcactcaaaggggtttttcaagagcagaaattgaaggattcaagctttcaaaggtttctctagggattaaaggtcatagggaggtgattaggcctagatatagggtcccaaaaagcttggaacagccatttatggaggttggaggtccaaggaggaagaagaagctattttccccctctttttcgcgtttttggccttatatagtgcccctgaccgacatgcggcgcccttggcgccaccttggcgctgatggccccaccttggcgctgatggcgccaaagtctagtgcatctggcgcccctggcgccactccggcgctcttggcgccagttttcagcacctgtggcgctcttggcgccacatgtagaattagcctatgtacccccggtagtacataggcttgttggcgcggtaccttctgttcggcttaattctcctattttcacctgctaaccatcaattctagactaaaacacctcatgaaggcacagaaatgagggtcattacattgaaaatcttgtcattattttgattttctatatcctttagcgaagcattgcccattgctttctgaatgacgaaatattgacacaatatatgataggatcacgttcacttcaagaaaaatatttattatcgacaaaatatttcccgcggaatgtattatgtcagaaatgtttaaattaacgacggaatttactgatgtaatgtattccattggaaaatgtttgaattacaaatggaatttacccatgacaagttttctataagaaagtataaactaccgatgaatttttatccattgattttattctattgaaaattaaaatattatcgacggatttttctgtcagaatacatgtctattggaaattaaaattttatccaaaattaaaagaattcaaccttaaccagaccctcaaccacttccctttggtgaattttgaaagcttttgcactcaccatcacaccgccattgcacaagctccaccaacgtcacctcgccgttgcatgaggtgccaaggcctccatcacgaccatcctctaatgtcacgcctaggttaccatcgcgcgcttgctgcagtcacacatcgtcgggtcatcctctcatccacatcatcgcgatgccgccattgaaccctaatcgtcgttgcacatgccgccacgcccacttcataggtagaaatatggttttaagctattgctaatgcaactattgcccccttcccccctcctctatactcttgttctcattaatacagttgcaactatattttattcacaccttaatgaaatcgaaattgatcttgctataaccgattgcaactatttcaagactacacatggctgaaaataaaactagcagcaaaatcctaatatcactcactcgcatttgaatctttgactgagattgaaaataatttctagcaaaattaaaaaatactgacaagttgaggatcaaatttaaacaaaaaaatatttagaaaccaaattaaaaattgtgtaaaagttcatagaccaacatattgaaccttaaaattataggcactttgactaatctatcaaagagatatattaattgaaaacaaatatgatgcatgtagagaacggagaatgaactgcactttgatgaaaaaagagaagaaagcatgaaaaatatcaaatttatgaaatgctctaaagttataataaaaataataataataataataaataaataagtaaataaataaataattacacaatttactactttgacaagaacaaagacagaaagagtaaactcacactactatatatatatatatatatacctatagatgtttctactttgataatatttttagcttcctatgcaataacgatgcttgaaagaaaatggaggtgaatattatgcatgttgtgttcccttaaatttggagaaaatcaactaaggaatgacatgatcttcaataagactatcaaagttgacaaattttggatgagaaagtaatttgtgagttgcataattgttaatgtttgcatataaaatgtgagaccaatacttataaccattctttggtcttttgaccaacaaaatggagaaacatttgctctattaattgatatgattattggtattaatacgatatcaatatagtattattcaccacattcaagacttgatctctttgtgtcgatttattctcaatttgcttcttttcttcaatggaagactaaaaatactcctattttttacatcctttaaattaaggtccaatgctagtttgagaactttatttttttcttcttgtgctccatgatgcaacgaaaaattatttttgttgtgtatttagttgtaatacacaaccaaaacaacttttcattgtatattaaaagtttaggttttttattaaaaaaatatttttcatatttatcaaatccttgtgtatcaaaacatcatcttttatgaaaattgagtgtatttagcaatagtatgaggtcatttggcaattatcttcactaagttatagttcaataaaattgctttaagattttcttcctacactattcaaaactcccatacatccagcaaaaagagtgaaaaaccaaaattgtccttcacttaaaaactcaaataaggattgcaccatttcggcttcctgcaccattaaacttccttgtaccattcagcctcttcattgcaccatcttctcctcctctttgcttaaatcctttggtgtttcttcctacacccattgacaatcctccgccgcactatgcttcatacggataggtgttaaaaaattaaaaaacttaccttcgctaccaccgcaacacccaccacgaagacgacgacgaagccaaaacaatgcaactatcgaaccataggtcttgaacctgtgacctttgtgttattagcacgaccaataactaggtagcctgagagcaagaataaataaatgtctaagtcttctattggtctatgagttttaaccaactgagctaataggtcaattatgttcaaaataattaatattgttatatataacactaatttttttaatgtatatttaatacacatataagttaataagtttacataataaattttgtaacacttaattttgatataataatttttttacaaatataaattttaaataaaaatcacaggtttaaataaaaatcataggtttaatatacattaaaatatgtaaaaaaaaatactttactagatcaaaattaattgttacaaaatttattatgtaaacttatatgtgtattaaatatacattagaaattttagtattatatatagtgacattaattatttttaactattagttcagttggttaaagcatcgtgctaataacatgaaggtcgcaggtttgagacaagcacgaaccattatttttaaattatttttaaagcatattttaacataatattgaccatatggattggcaatccatgtggactactggtaagggtattttcgattttctctcacattattgagtgtagaaagaaataagctgagtgcatgaagaaaaaacctgaattccatgtttactcaacaactaagtccaaactcttgagatttgtatttttcttttgtgattgtaatggagataattccttaaataattaatgggtataaacgtgaattcataaggacaaactttccggtttcataaattagggtgcttttattaattcttaattgtgataaaatgtttaggaattcgcttttaaaacaaatagataagtaaaaaaaataccaagaaagtctcacttaatttattaaataagatgcataagatattgtgaattcaccttgggagaaaataggtttctcacgttaaccatcacccggtaacacatgacgtgaaagtgagatgccatacataattctttgaatgttactaatctacacattaatgtaatgttttggcacaaagccatggaccccttattacatgtgcgtgattgtttggggcttgccaaaagtcacacatagaggtaaactagctatagaaatcgaacacaacacaagtctccaaagcgtgtcattggtaataggccattaccaaatgaagtggagcgagcatcctaaactatcatggagtgaagcgcacaataaaaaactgaagggccaagagtatataaatttaataaaataaaataacaatttgttcatatgtgcgaaatgaaatgtgacttcaataactaccatgtcatgttagcaatcagtggcggttccagaaaattaatcaagagggcactcaataagttcaaatacatatccataaaaataattacagaagatgggactagacagatgatggcttttaccgccttatttgaaggaggggaatatggagatagcttgaacttttatggcttatacaagatagaaagcaccttgtcacaaatatttgtgatgggggcacagggaagttcaagaatgcaagggggtttgctgaactaagagctcttatcctaccaggacagatttccactaatggtgcagagacactgctgaggatcacgatctatttgaaacactaaaactttagtgtggaaatgtaaaagcatctgggtgttattttattacggatgagtatgagattggtcttgtatattattatcagtttaatacattgtttacagaatgcatttgaaatcttagttgtaatcccaagaaaccttatggtgatttctttttttctttttaaatgataaattatatcacttggagtttcgattttgatttttgaatacaagcagaactgcagaagcaataaatgccatagactcagacaatgaaaggttacaagtaaaactaaaataataattaagcaaaacagtcataagctattaatatcatgagagttgaaagcctaagatatggtgttgacataagccataaagcaaaacaagtatcatggaaaataatcaggaaaaacacagaccaacaaagagagagggtttactgcatatgaacatgtaagaaagtgctatttagtagttcatatatatactcaactctaccggtttacactatgatcaacaatgcatcaggagttcataaacaacttccacgaaacccatttctatacatcaaatagaaattttgaagttaactttggcaaaataaatctatacatacaaaatgttgaccaaactaaattaagggttgaaaccatgagatatttttaactatatgaaaatccttttattactagaggtagctctaaattgttgttgacataaattatagagggatctctattgccaactaatgattcaccttcagttaaaccaatggacaccattaatagacaactatcaagtatcaactatgatacaagattagatgcgaattttatgataattacctaccaatttgcatgcagatcttcacatttcaatacaagctggtgacattaacatgagaattcaatgcagcttcatcaagcccgtagagtgcatctaccaagtgcattcgaagtgatgcaggaccttttgggaagatggaagacccttttagccagataaacagaatatccactcacaaattttcaccgcaattaagaacacaagcaccacctagaaatttccaatctttgggaaaacccttttgaccaaatcaatacaaaaacaaccagtgacacacattcctcaattttccaaactttgggacaacacattcgagaaaaaaaatcagcagattcacgatttggaatatactcatttctcatttttcttttctttttacacagtaacgatacaacaaaccatggaaaaaaaaagaaagggcagaaaaagattacacgaaccctggtgagaggaaggagaggtcgaggtgctcactgctccgtgcttgactgcttgaacgagaggaaggagaggtcgaggtcaaggtatgcagagtggactagggtagtttgtaaaaaaaatttaaaaagaagggtatttttagtattttcatctgaaaatttaagggggggcacttgccccccttctcttatacctgggtccacctttgtcaaaaacactctcccaagagattattgatatgaccaaactaccctcgttccccagaaggtgaagttcctaatcccttttttgtgtgggtgttaccactttcttgtatttttttcacactatataatgtggtgtatgtacattttttcacgtattaattttagctgaagtatttggatacatgtttggtatatgggctctattcaatgtaagcacgaagaatcatggaccctctcaatgttaatgagcccaaatctaacaaggctaagctttttttttttacacaaacaaggctaggcttaaggtattataaagatgttcaattgatattctggtcattgagcttaaatcaaggtaggctgaaacttttacttaaaaaacaaaaaatgttaggctaaaactaaaaaaacaaaaatcagaaaaaagaacgcaatgaatgtaatttagttggtagaatacacatctactgtaatttcccatgataagcatgtttagatattttatagataactgtttttaaacttttttctttttctcttacagtcaggttcacaggtgagattgtgttaggtgattgtttccttactcacactcatgttccattgtttaggttaattgtggtttttttttattctagttgcttcaaattttgtattctaaatgtgttaaatatatttttggttgtggttatgttatttatattccatgttttgttcatatagaaactcaaacactatatatatatgtgtgatttttgttttcacctaaaacatgaccaaaattattgctactaataatagagatcattctaagattattatgtgattcatgaatgtttgtattttttcttaaatatacagagcatgaattatattctttgaatcgtcgtcggatgtatgatagatgttatagtggtagaagcaatttgaaagagtcttttgtcaagggggttgaagagtttgtaagcaaaactagtcagcaagattgttatcacaatgatggggagataagatgtccttttgttaaatgcgattatactaggattttggaggatagagttgtgaagacctttacaaaaatgggttcaagcttaattattggattatgactgatcatggtgaatacatgtcgcatgttgatttaaatgatggaaatagttacattgatgctttaagtagtgcagaatatgtggctaggtggacaatttatctcaatgcaagatatggtgtgtgatgctctcaggcaacctaaaacatttgaagctcccaactcaaataatatgcaagagcctccaaatgaaaatattcaaagattttacaatttattggtggaggcaaatgagtcattgtaggaaggggcatcagactcaaaattatcaatatccacgagcctttagcttgcaagtccaattggaatgttctcgaccagtgcttaaaatttatttcaaaaatgcatttgaatgtaacacatataaatgagtgttttccaaaacaaagttatgatgctaagaggttagtatcaaagttgggattggaggctaagaggattgattattgtgtggatgactgcaagttgtaatataacaatgatggagagttaactgaatgcaaattttctaagaagcctagcatcgtcacaagactattggaacaagtaataaaaaaccagttccagttaaggcgatgttctatttgcctataataccaaggttgcagaaaatgtttgcaacaatgcaaactgcaggacagatgacatggcactatgacaatagaagttgttcaggcatgttatgccatccctctaatggtgaagcttggaagcactatgatctggtacatctagattttgctattgatccatggaatgtgtgacttagtttatgcatacatggatttaacccatatattcaagcatcatcttcaccttattcttgttggtcaatcattgttaccccatacaatcttcctccaacaatatgtatgactaaatcttatatgtttttaagttgtgtcgtaccaggcccatttaatccaacagttggtattgatgtttatttacaacctttgattgatgatctaaagaagttgtggaatggtgttctgacttacaatgtttctagaaagaaaattttcatgatgaaagtagctttgatgtggactattaatgattttcctgcttatggcacgttgtctggttgggggatacattgtagatttgcaagtccgtattgcatgaaggacacaaaggtcttccaggttggcaaatggggggagaactttttggtttgattgtcatcgtaggtcattaccaagtgatcatgcatttagaaggaacaaaaatgccttcaaaaaggggaaagtagaaagggatgagtcactgcctattgaaaataataggaatacttcacaacaaccaagagggggggttgtaacaccctcatatttacatgcacatttgtaagtttttctcattaaattatcaatgtgcacttttattttacaaaaattagtttaaggcaaaaatgacgaaaatgcccctagacattttaaaaatgaccaaaatacccttaccctaaaaatgaccagataattttgggaatcctgtaggaacttgagaaaaggacaatatacccctagagaacaaattatcaacaaagcagataacaagaaactatgaattagaatttctaggaattttaatagaaattttgaaaagaactcaatacagactaactcgagtatctgaaaaatacagaaaaatgataaatacaatctatagaattttcttttaattataggacaaatagatttctctattaagttagtttagtaattttactaattaaaagtgaaattgaccaataagaaactagaattaattattacatgtaataaaaggaaaaattttgtaaaattggcactaagaataagctttggccgtgtaatgaaaaaaccaagggagaaaagcttttagaaaagtaaaaaatgagtacatgaatgattaagaaagcttgggaaattctattggtccatgtggaagaggtcatcaatgctccaagatattttacaaggaaaaaatttatcaaaaagcaaggcatcacacggtggaaggaaaaatcaaaggggatgcctcaccaattaaagtgcacgtgaataatgaaacaaggaacaaggaggtggtagaacattcatgaagcaagacacttggaagacaataaatcactagccaatgggaactaaacaagtaaaagtaagtcataatcacttaaggaagatatttgaagatttttttaaaaggcaaaggctaacacttttgtataaaaagcaagtggggaccgtgcacatgatggcaacgtacaaacccctaagccttgtccctttcaaagcaaaattaaaacactttcaaaaccaaatcaagaggtgatcgtgcacttagcctttgcatccttttcactttgaccttcctatcactttcaagttataccttcatttaaaagaaaatcaagaccactaatcctagcaagctcacgtgggaatcaagggaaaaagaaagtaggagctgtccaaatttaggaagcaagcaaggtatgagaagttctttgataagcaaggtttaactatgaaacatgttatgatttataatcattctaaaagaaatttaatccttatttactatgtgtggtaaattgatttaaaaagcttaagattatgacatgaatggacatgtagttatgtgatttgatttttaagattaggaatgattaaatacttaaacctaaaatgaaggataagtaatttaagtagtataactattatgatttaaatgaaggttaagtagtatagctattgttggaaaataattgatttggttaaggtaaataaatgattaactaaaagaataaatttaatttaacttagtaaatttaaaacctttgagtattatgatcttagttaagtaaacagtccctttaaaaagatagtattatatagcaaatgtttcactaaagtttatgcttttatttaatattctagaaatccctaagtatacttattaaattttatatgttgtaatcatatttattatgttaacctattttaataaatgtttaagagttgatgtattgtgatttgtgataaactcgttgtcgacacgcacaaaaacaattttactaagctaattctgtagcacagagctaacctaggtcgacttagagacacgatcaatatggttctagcttcaaatcattggtaataataaggggggattttgtcaaacagttggtatgcgtaaagtaaacatgcaagaacacaaactaaaattaaagaacaatgcaaaaattaacaagattatcaaggagtaaagtaaaatagattagaaagcatcaatctcattcactaacccaagcaattcgaatcatcatcattctcataagttgactctatcatgaacattcattcaatctcaatagaagcagttcaatcgatcccactcctaaattaattgaaaccacaaccctaactgaactatcattcaattaatcttgtgattatcatttgaaattaagacatgaatccataatcctaattcactttaaatcctaaatgcattcataatcaagaaaacataatagaaactgaagaagaaggtgaacattcaagtagaattcgaaataccgaaccggaactccaattcttctcttgcttgagttagatccttggattgattagtgatttagcattccatgatgatcaacaaggaaagccccatgaaatgagtacagaaaaatggaagaataacaaaatggaaatgaagaagatgaagaacacttgagagaaaatgaagaacaggcttttgatcctaaaaactaaagaaaagaaatgtaaaacttgtttattgaattgtaagtgtggtgtgcaagtttcactaaagtcactaataaatatagtgactgagttctgcaaattaagtgggccacaaacaaacccaacaatctaattatttgctatttacaaccatgaaagtcaaattcgcagcccaaaattacaagtgcataggtgataacttcaaagcttaaaatgaccctctaaatgatagaattggcctcaggctatttctagaaaacttgtagatcttttgttatctttccggggactcctagaacactccattcggagattggtagcactctataggccctgcacaagtcagatacgtcaagtgagccaaaaatccgaaaatacgcaacaattagcaagtaagcctacttacttgcctaagccaaaactgaattagaacaggaaaataaaggtcgaacagaggtcaaataagctaagaaagatagaaaaatattcaactaaaagcactctatcaatttgttatgagaaatatatggttaaaatgattgtgaacccttgaatgaatacaaatatttggatgatttgtatggtgtgaggaatatagttttacatcgttctttcaagtgtttctgcaaccaagattgattaccatgtgactaatgaaatatgtttgtttaaggcttgagaatcgtgtggttgatgtatgatttataaaattttatgtgatgaatgaaaagaagttgtataatcattatctatatgcctttgaatatgttgacctttggtttataaagatgctaaaggaagagtaatattgatgatgacatatgaaaatgattattcatgcatgtttcattcatatgcatatgccctgcgggggttaagccgcgatgttgagtataataaagaaataagctaaggaaacttaggcgttacaggggtgagttggttgaaccttggtattttaaaacaaattcaaattagagtttcaggatctttatcactttcaaaaccaagaaaccttttactcaatcaaatagctcagtcccaagaaatcaatagatcaaaacagaacttgttgaacaatgaatatgactcaaagaattaacgatcaatgaataagatgagaatagagatataaaaataagaacacaagaaatttatactggttcacttcaaaacatgaagctacatccagtttcttctaattcacactgaattagagttccactattataaaatattcttacaagcttttacaagaacctcccctttatcaaccctagataaagaacggaaatctaaaaccctattagacttctaaggagaaagattcagagaacactactctgatctttaatctagagaacccttctctagtcccaagcaagaagaacccaattacaatagccaataccaacagaatttaaaaacagaattacaaccaatgagttaaggaaagaaacaacctaatgatccagtgaatgacatgcaaatgaatgaacaaatcaggttgaaagacaaaaacaatctcagagcatcctttttccttaacctttgaaacaaattttttgcttaaagaatcactcaaatacccatgaatgttttagatgaagcaagaactcatagaacccagaaaatcactttggaagtgtttagaaagcttgtgtatactcagaaatacgaattgatcaagttacaaacaaagccaagcttcacttctatttatagcataaagttgtaactaactgtaatcaattacccgctccaaataatcgattaaaacgagtgtgtaattgattaaattaaaatataatcgattaaagtgttatagaagcattctgggttttcaacatgagcaaaataatcgattaatatgagttgtaatcgattaacacatagatatttattctcaaagtgaactgtgtaatcaattactggatatggtaatcgattaagttaggaaaacatgaatttcagtttgaactaaataatcgattacagttcctgataatcgattattccaggaaggcttaaaaactaattttaactaaataatcgattacagaagtttagtaatcgattaaaattcataacaaagcagttcagtcctatgcaaaggcagaataatcgattaaaccgataggtaatctattaaaatgtttatgcaggttttccagatttgaacgaagaacaacataatcgattaacacttttatgtaatcgattaaaactgtgaaaaacttatttttcaaaaaacctttcaattcaattaaaaccttagttaaatgttaaaagctttgtttgatttcaatgaaacacttagttaaatcaatgaatgaatgaatgaatgcagggatcaatcagatagctttccttttacatcatatttcaattccaagtcttcaagtcttttaaggatgttgaaagctcaaaaccaatcttgaatcaaagacttcaaaacttcataaagctccccatgtatccaatagtctccccctttttggctttgaacgtgctaaattcttgattgaccatttgttgaacttgaagcttttaaaggaaaatgatcatggaagactttgaactttttcaaacctaaaaatttacactttctttgcaaagaacaagtgttaaagcatctgattccttttaatcaccattcattaagttatatctgactttaaattgctcattttattacttagcttccccttaatttatcaattaagtgaatgttcaatttctgtagaaattttgcagaaaaatagggatgaacagagcacaatgcagagcatgacaaattcaatcaatttcaatcaatttctccccctatttggcttatcaagtcaaaaatataaatggcacagcggataacacaaaagagaaatagaaagttattacattaatcattaaaaggatccattacaatgattaaagaaaaagaacaaaaaacataaaaaaaaacataacaaggcttaagaaagctaaaaggattcagacccttcatacatcagttttgtttccaaactttatagcctagttttgatttcttctaaggctgaattagtttcagccctatgttcatgaagaagagagaaaaggccatccatcttttgaatcatcaaggattcaaaggcactgtagacaggttgtgcaggacctctttcttgagcctctccttcatcatcatcttcaacctcagcacctccagcaggttgaggttgttggccagccatctgccaaccttgaggagtcttcaccatccccaattttgtgagatgcttctccttaatcatgctattgcttgagttggtgttgtccaccacttcattagacacatcaatgttgaaatagtctatgaatctagacacaaggacaacataaggaaagggatagttcataagcctcttagattttagcattatctcctcaatgatgagaatccaattcatctgaattgaattcttgagaccatacactatttgcaggtcatcatcagttgcttgggcatggtttgtggctctaggagccagaacatatgtgataatgaaatgaagcaacctgtcctcatgagtcatgggactagtacctagcctatgcctgagttgcatattgggactaatcaacattcccctatatgtatctattctgttgtacccctctatatcttcctcaaatttcctctcaccctcaaaagatatgccagcaacagcctcccacacctctggagttatctccattaccaccccacaaacttgagacctcaaagtccaatccattgatcctttggcacaagtgtagaacactttcaccaatttaaggtagtaagtacccttcatctccactaacttccttaatccttgagtctcaaggaatgcaggaaactgaaatccctccccaatgaaccattctaagtctaagtgtttagggggaccttgatggagtgcttttagttaaatatttttctatccttcttagcttaattgacttctcttggacttttatttttccattctaattcagtttttgtcttaggcaagtaagtgggcttaattgctaattgtagcatatttttggattttatgctcacttgacctatctgtcttgtataggacttatagagctctaaggaactccgaatggagcgttctagtagtccctggaaagataagaaaaagatctacaagtttgtcagaaaagccgaggctaattatgtcattttgagggtcattttgggcttcgaagtcagaatcactgcacttatattttggactgtgaatttgatttttatggttataaatagtaaataattagaattgatgggttttattcatagctcattcttttcttcagacttagtcactacatattagtgacattggacaaattttaacagacattacattatattccatttaataaaaacaatttacatttctctcttttaagtttttaggatgaaaatccttgttcttcattttctctcaattgttcttcattgttcttcatcttcttcattttcatttttctattcttccattttcttgcacttactccatggggctttcactgatgatgatcatggaaggctaaatcattaatcaatccatggatccaacccaagcaagaggagaattggagttctggtttagtatttcgaattttatttgaatgttcaccttcttcttcaatttctattctattttcatgattataaatgcgtttaggattgaaagtggattaggttatggattcatgtcctaatttcaactattactcaccaattaattggatgatattttagttagggttgtgatttcaattaagttgggagttgattcgattgaactgtttctagtgagattaaatgaatgttcataataggataaattcacgagaactatgatgattcgaatagcttggtttggtgaattggattgatgctttttaatctgctttacattacttgttatcaattctggtagtttttgtattgttctttaatcttagcttgtattttcatatgttttaattgttgcacgcaaactattcgataaaatccccattactgttattagtgatttaaagctagaaccatattgatagtgtctcttagtcgacctaggttaatcttgtactacagaattagcatagttaatttgttttggagcgtttcgacgaacgcatatcagacctataagctttgtggcattgaattggagataagtcattttatctctttctgcagagaaccaatggtttaacctactaaccactgggttagaggtttcaccagttgcctttctcttagaagtttttgccctcttagaagtagacatggtgcagggtttctagacataaataacagaaagaaatacagagagaaggagtgagtatgggtgtgatttttcttctgcacaaaggctgtattcatatagttctttgggctccaaaaggtttgaaatttgaataatatagcagttgggacgaattaagtcactgcagagaatttgaatttgaattaggtgggagttgggcagttacaatttccaagaaatctgtcagattttgcagtaactccatgaataatcgattatcttcttgtgtaatcgattattccgtgaaagaaatcacgttttgcagtgatggtaatcgattaatataacttgtaatcaattatttctgcacaatgctcatgaaaaagataactagtaatcgattatttcatattttaatcgattatctcaaaaatgtttgaattttaaaaacacattgaggctttggtaatcgattaatttgattggtaatcgattatcacagaaggttttgaaatttttgaaaaatgcatttccaggattttaatcgattaccattcaccgtaatcgatcaattcaatgaattttgctttgaaaaaggatgtttttaatcaaaataatcgattaattcgaacagtaatcgattatcacaggagaaaatttaatttttgaaattgtgatttttggaagaataatcgattaccaattcttgtaaccgattacatgagcgcaattttcattctgattctcaatttaaatgattttaatcgattatttcgaagcttaattgattattacaggagaattatcagttaatatgaattatgcagtacaacttgggaattttaggcttatggtgatttatggattcaaatggaaatcatttcacatagaaagacaaatatcaattaagcaatcatagattagactcatccaagattcctagcatgttgctaagtacatagaatctatctctagccagtggtttagtgaatatatcaactaattggttatgagtatcaatgaaatcaattttgatattacctttttgaacatgatctctgaggaaatgatgccttatctcaatgtgcttggtccttgagtgcattattggattctttaagatattaatagcacttgtgttgtcacacaacagaggtatttctttcagttcaactccaaaatcttgcatttgttgtttcaaccataggctttgtacacaacaacttccagctgagatatattcagcttcaacagttgacaaaccaacacaagattgtttcttgcaatgccatgaaatcaatgaacttccaagaagatgacaagtgccccttgtactttttctatctaacttgcaacctgcaatgtcagaatcacaatatccaataatattaattgaagcacctttgggataccaaagatcaacttttggtgtagccttgagatatttgaggatccttttgactgttgtaagatgggactcttggatttgcttgatatcttgcacacaagcaaacgcttagcattatatcaggtctactagctgtcagtaaaaccaggaggttgttcaacatatatatcctcctcaatgtatccatttaaaaaaagcacttttaacatccatttgaaagagtttgaaattcattaaacatgcataagcaagcaataacttttgatgctctttatatttttaggttataaatgagcctataaatgtaagaaaccaacacttaaaggatttattgtatggtcctatgagttacgttacagaatgacacacatactttgttaatggatacaaattccatactcaagcatggactgaggggaagaaaacaataaatagtggagttcacgtaaaagggcattacaaaagaatgtgaagatgatttctatgagtcattcaacatctataagagctaaagtataatagtacaaactatcctaagcgagtagtattattttattgtgacctgtttgatccaatgagtagaggtacaataattgatcctaaatatggcaccgtggaaattcgaatagataaaagatataatctatttgacccattcatcatttcacataatgtaagagaagtgcattatgtgttgtacccaacaataagaagggacatgcgtggttggtgtgttgcaattaaaatgaagccaagaggttacatagaattcgataatgtagaagataatgtatcttaccaagtagagaaaatgtcacatgtcaacaaagtcattgaagttgaaattatttctagattgcaagatttaagaggtggtgttgaagaagtggaccctactaatatgtttccaaacgaagcagaatcaaataatttcaatggagaatcaaataattttgaaaaagacaatgaaggggaattagaagatgactttgaagtttacaattctcaagaggattagacaaactatataatttttcttgaaattattgcctttgttatggaattattttagttttgtttttgagtgacatgatgtttcttacttagtcttaatgtttattattagtatcatcattgttttgttgtgatagttgaacactttattagtgttttttttgtgtgtgaaatgaaattatgttaattatctaattttaattcatcctattatatttgattcattatttgtaatattatttttctatatatagatatgtcatcaagaggttctgaccttccccgaccccgtcacatgacaatagtgtgaaagggacaagtgggaagaaaaaatgatatgtagttaaactactaccacctagagatagtctgccatcatctaccccatccccgtcttctgtatttatgtcaaccagattttctaatgttgcacgtacaccatctccatatctgactaaagctagaccatctctgattgatgcacgtggaccgtcctcggtacctacatccaaaccatccccatccctaactgtagcgaacatgcctactgatgaagacgttacaaacttggccatggaagccccccctaaatgatcatcctacgattacacttatcaatggagtgtaagtattaaaaatttaaataactatcattatatatcatacatcattttacctttttatttttcatgaattattttttctatttaggtttcgtccatctaaggttgcggcaaaggctatcacattatccattaggcaacaattcgctaacccatggcctacataggaaacaattccaaaaagatcatcaagaacatttcttccaacattttaaggtaacttattcacctcttaatgaattagttcaatggctgaaatgggtagctcatgttttagggtttttttccatttgaaaatggggtaatgctttttcttttggaaataagatttgataacaatcagttcgttctttagacttcaaattatatgtatatgaaaatatgttgtttgtcttgtctttggttgaatcttggaatatgacagactgaatatcatctcgtattggaaggaatttaattaggatgataacttatctgtcgtttttttgtggcttaattgatagttttaatattcagaagcattggaagtgagagaggttttcttcaagtgattatgatgtggttgtgttgattcaagtgaagtcaaacatcaagaatgaagaatcaagcttcaaaaagttttggacattcaaacatgcacaaaatgatgatactcaaaggaaagcttgaagaatcaatctgatcatatgtaaaagggaagtatatgatctgataatccatgtgtgtgtgtgtgtatcatgcatcattcattcatataagatcatgtggataaataaacaactaaaagaaattgatttgaaaggcacttagaaattaagtttttggaaaaatcaaataacacataaataatcgattacaagaaatcaagcatcgattattttgttcttcgtgtcctttagaaaacaaagtttgaacattgtaatcgattacatatcgttttaatcaattactctggcttttgttgaaaaatggtattctctggtttaatcgattacataagagtcttaatcgattacctgcttgtacttacattttgagaaaatgtaggctgtcgggtttaatcgattacttcatggaacaatcgattatattgttctttatctaaatccagaaaagctcataaacattttaatcgattacagtatgtcattaatcgattacattatacaaattggaaaatcatgtatctcgggcttaatcgattacgtatcggaataatcgattaaataactcgttcttggaactctgaatgtttcataagctttttaatcgattaccatcttgatttaatcgattacaaatgataaacaatcaattattggagcgtacttaatcgattattttcagttaaataactgttataaatagaagtctgcgacagaactgaaaaaataaagagagagaaaagaataagaactgaaaagcttagaattcgtgtgctattgatatgtcattgtagaaaacgatcacaaacaatcaagatattcatatgtgatagagaaacacatagaaacttcaattgattcatgtgggtgtgatgatcaagagttgaagtttcatcttgcaatctagtttcaagaaaagctgcatatctgtggtgataatctgcatattcatctgtgattcattcattttcattcatcaatggattatcaggtaatatcttttcttggcttttgattgtgtaaacaatttctttgtaaattgggaaaagtattttctgttgtaatttgtttcttgcaagcaaaagagatagggtttctctgtaggattcacttgagtagggttctcaaggtgaagggttggtctttaagaatctaatagtgttttagatttctgaatttcttctagggttgaaggaaaaaggcttgtaacattgcttgtaaagatattattgcaatagtggaactcctctctagtgttgagttggagaactggatgtagcctcatagtgtttggggtgaaccagtataaaaatctgtgtgttctctttaatctcttagttcaatttcgaattacattgtttgtgaatcaatatcattgctcaagttttgagatactctgttttctggtgctcttggaaggggaagattgattgaaaactgattttgttttaaagatttgttttgaatctgaaaattggtttttattgtgataaagatcatgtggcttaaaactctgaggtgaaaattttaattggataaggtttcaaccaattcaccccccctcttggttgtttgaagtgttcctttatttttcaggttgttccttccacatgttgaacatcattaatgggtaatcaatttataagtgagaagaaaaaacattgcattcatttgtggtctatatttatatccttcatttatgcccgaaaatcaataataagtaatgctacttttgttttatttaatctaaaattgtaaaattgatattttgctaaccgtgtgccatttcataactttgtgatactttagagaaaattggtatggagactcggggagattgtgtctggaatgatcttttatcacattgggatgcacttggttactgttccaaatgtgcacaagccaaaaaaaataagcatatgaaaaggggggtgtatccacacaagtggttctattagcttgcatgataacaccattcacttggtatgtacattaaaattataatacatacatctttgtacttgtttaatttactacttaatgtttattttataatatttgtaaatagtaagaggagcttggttgatctgcatacattgataaggtctttcagcaaactcatttatgaaaggatactggtcaatttgtcgatgatagatttaggcatacacaggtgagaccattatcttgcatgcttttttatttttaaaatgtttattatatttatgaaataatgactatttttgaatgatcagaagattttgaggcttgactatcttaagttaggtatggtgttgcgtcaagtgctggtgaatcacaaatcactcctttagaccctattgaagaacacagacttaggactccatgatgggttgcaactatgggaccaaagcgtaagggacacctttacggtacttgagatcttgctcgcaattataaatgtggagatgacagcttcatgcagcatatgcaaggatcttgcagtgtcactcaagattcagcggagattaatcgactaagggaggagctttgtcaatcaaaggaggaaatgcatgtattttagtcagttgtactcagttcctaccacctgaagcacaaaacattattcatcaacatcaacaacctgactagcagtagcaggaccaggaacaatacgacaatgaccaaccaaatgaccagcaacaataagatgatcacgaaccagatgatcaacaacaacaagacgatgaccaactatatgaccaatagaggcactctaacattgaatattttgattactgacttagcaacacttattactattgacatattagacattgtgctttcattttggatttattttgaatttaagtaagtttgttttatcatttgttttggatttatggatttgagtattttattaattacatgtatgtgttaatttaaatattgatgttaaatactataaataaaaaatattattaatttaccgatgttaaatactaagaaagaaaaatatgaaataataaattcctgtaaaaaaagacttaccgacggatttaacggcgaaatatattcgttggaaattttcgacgtatctattcattgaaaatttgtgatggaaagatgcatctatccatcgaaaatttctgacaagtagatctgtcgaaaaaagacagtcaatatttctgatggatatatccgccagaaattactaatgaacataaaattaccgacaatggggttactttacggatttttgtcgttgaaaatacccttttttgtagtgttacaactcatggacttggaataatttttccactcaccgtctctaaggccctcatatggtggcaaatagaaataactatacatcaatgacttacgtttctcctcctgtgttgttaccaaagaaacaagtgtttccataactttgtcaccttcctccagtgctagtattgacgataatgactttcaacaaattcttaggattgtttgcaattgcaaggactttggaacaataagagtaatctattaaaaataaaatactattattatgtaaaaatgagtgaaaattgaggataaggaattcaaatatacaaaattatgaggtgcaaaatctaaagaatggatatatttacatgtattttcttaaaatgagaggttgtatgtaacatcattgttaccatgtaggtcctccattactagtttgcatttcttgctagcaaatttcttttcatgttgatcttttttttttttttttttggttttatgctctcaaaaactagaagtcttgagaattctttagtaacttctctttccacatgagaccaatatcgcttatgttgtttggaaatttttatattgtctttccaatctagtatacaagcaacattcatgttaaaatttgatgacgatgtgacctgtcaacaaatttttgggattgtttgcagtgactgatttgaggctctaagggtatgagtgtagtcaatttagaaaataaatttaacaacagtaaattggaaaaaagtaagtttaaatacaatatacaaattagaagatgaaaaaatataaaaaataaagatatttacatgtatttttctcaagatgggaggacgcattttccactgattgtgtgcatttcttgttggcaaaatttttatattggcgaccttcttgtttcatactcacaagaaactcaagtgtggtttttttttttttatcctcattcaaattttaagtaaattttctttatatcaaggaccttggtcgcttaggtggtttccaatactttgtactttccatgaaggcttgaatctacacataagaggcaacaaattaatttagaatgtgattatttgtttaaagaatgtgaaaaacaaactaaaatcaaagaagaaacaaagaacaaattaagaaacctgataaatggtgagaatcggaaatcaaaaactaaaaatatgcgagttgaacttttccaccacgactattaacaaaatataaatgtcaaaagggtgcatgttttaataatgattatataaatttataataaaagattagattaaaaaaatgtaatctataagaaaaaattggtattaaagattttcttttattaataaaatatttttcattgaagttttttcttaatattttttttaaatgtgatattaacgattgtaatgtatgataataaaagaggagcttagactttcttttcaatctagtgtgcgagcgatattcattttgtattttgtcattatatgagataaaatgagtagattgaaagagaaattaatctctaaaatatatctttatttgtcaattaatctcttgtcaaattaattcatcaatcagtcatttgtcttaattaaactaaagtggtaatattttataatattattttatttttcatattataatagtataaattgctaccatctaatgttgtcaatggacttatttatactatatacttaaagtatataaaaagtaataataaatcaagaattgaggtcagctgaaataatgaaacaataacatattaaaatagtaataaataatatattattttcctttaaatttatcataaaatattatttatatagttaagttactctaaggatatgtttagaagccagggtatacctacataggatatatctatcttatcctattttaaatttttaataaaatatttggtgcatgtataggatataactcttttattacttatcttaattttagatagacaagctcttaggagtgtgcttgatattgttaggttaattttttagacaaattaatataaataaaaataaattaaaatatagttaactttaaaaataactccaaatatgtaaattttgtgattcagtttggtttgatttgatgttttttaatctattataataatttaaaatctatcaaataaatttacataattattatatattaatattttaaaaatataattattttttattaaattttgtttaacatattttaattgaaaattattattttacttcaatttagcattaatataaaataacatcaaatatttttgtaacataatagtaaattatacattatttggtatttaacaatatattatatatcattttttaatatatcaaagtaaaatatacatcttgattataaagtaaaggaaaagtaataaatcatagttatatgatttgtgacagtttaagcaattaaaaatcatcacaaataccttttttgaaattaaaaaacctaaactagtaatctactacaaatattgatagcttgtagtaatgtatccatagtatatgttgcatgggtattctttacaaaatcaaagtaccataaccacatactttcttaaagggggttatccttaaaggcataaagtttaatatttaaatataaagaatttacaaatgcaacataatgagtgttcgaaatcaaactcaaactgttgtaaattgtcaaatcgatcaaaaaaccaaaattgattatactaaaaagtacaaacaccgaaaactttaaaaatgcaatttttcgtgtttgatttagtttttggttcttgttatgaaaaccaaatcaattcaaaccaaactacatactatagttatatttattttatttaatgattgtttagcattatgtagtattattttaaaattttaataactattatttgacttatagaattatagtgtacttgtatctatagcaagtttgtaacatgtgatttttattgcagtaattagtaagaagtattaaataatttatatcatttcctttgcttggatatgggtatggtatcaaaaactctctagagtaatcgattaccatgcattttcatcgattacttggtccttaaagtctatttcaatgaaacataactgacatcttatctctaattcaaattcaaattttggttcagtgaatcgagacactcttggaattcgagatagctattatcaagtttttaaaattcaaattttaaacttgaaaaatctctataaattcagattttcaaagcctaaaaacctcacacctgaaaatcactctccctcttagcaaaacttagctaatcttttgataatcgttagcttagcggttgtcttgtttagcttctggttgtgttgtttttattctctcacattcagcagttatctttgatgtttaccttcatgttctcagcttcaattaatgaataaaattttctttatgttgtttacatcttcattttcctatttcattatcactggtatattttatctttgataagccaaaagggggagaaaaatgaacataaaatgaacatatgaagggtgctgggtgaataaaagaatagaatataagtggagaagaatgataaactaaatgataaacgataaatttctactatgatttaagtgagcataagcattgctcttaatctaacatgatatgaaaatacataacaaaagggggagcaatgcatatgcttatgatgttttgagtttatgcaaggaacaattaacacctggtcttggctagaggcttattattttttcaggtctcaagtaaaagctcctggaaactctctcctaaaaagaacactaaggtacaagatgttcaattaaagtttggcatgatcaaagccaaaaagggaaagattgttagagtcagggggagcttaagaggatcaagaagctaagtctcttaggcaacaaagtatttaggcttttttacatgccaaatcaattgattggtagctgtaatttgtgtatgtttaagggagactacctatgatccatggcataaagctcatacatgtttttgcatccatgtttttataaaagcataagctttgtgaaaaagctttttcgaaacataaagttttcatggttgataaaaagccaaagtgttcaatgtttaagtttttggaaaaacattttttctctgctttaatcgattaccagcaaatgataatctattacttaagctctcaagaacactttaatcgattacaagagtttgataatcgattacactacacaaagtcacagaaaagtcttcctgtgatagttggttacgatattgttgtaatcaattacttgacacatgtttagaacaaagactttatgtgataattgattacattgcgaattaattgattacattgctcataaatcttttccagaaagtttaagaacattttaatcaattaaaagagttattaatcgattacatgagtgaatttaatcgattacattagtgaattaatcgattaatgacaattacaaattgatttctataaatagttgttggatgttttgaaaagatacaacgaaatatcaaagtacttttataagctttccgaagtaagaaaagattccaagtgctaaactctgttagacccacaaatcctcaagcttcaagatttctataaaggattcctttttgtgcaagtttcaaaagtcgctttggaaggaaagttctgaagttgtttctttcaccactgattcaagtctgttaatattttgcatacatcatcactgaatcatcaggtggtttcctttcttacaacttgtttgtaagatcttttgaatttccttttgtgcagctataaaaatattttttcttaaggcttttctagaataggtgtttctaaagatgagagataagttttctttatgtcttgatcacaaagattttgagttagaaatctcattcttgatctttgtgtgattgagggtggttgtaaaaagcttgtaagaaacaaattgttattagtagaactctgacttgttggttagaagaactggatgtagcttctctaggttgagaagtgaaccagtataaatccttgtattaactacttgatctttatcttttcttgccgttattatttgtcattcattggtgttgcatttcacaaacaacataaaatgtttttgattgcattctttgagtagtggtgtttgattagttgaaagctttcttggattgttttgtgatactatttttttaactatgattgtttaagaatttttaattgtctaaaatcaatcaattcaccctctcctggttcttgtgtgttgttcatattgttttcaattgaagcattggggagtcttgtggattgtcctactgagataaagtatgatgacttcattacaaagttttgaaattgcttgctcaccatggccaatgtttgttgattatgtcaaacacacgtggtttattccccacatacaaagatttgtaacaacatggacgaataaggtgatgcatctaggaaacactacaactaaccggtatgaaaattgttaatctatattaggtattttaagaacacattaatggatgaaaataattatttgcctttttaaatgcagggttgaatctgcacattggaccttaaagagactactccataatagccttgcagacctatgtagtgtttggggtgccatgaacaacatgatcactttgcaacacagtgaaataaagacatcttttgagacaagcacacatgtggtcgaacatgtttttaaagttaccttatacaagagactaattggcatgatatcaagatatgcattaaacaatattgttgagtatgagcaagtgaattatgctagcattgacaattctcgttgtggatgcattatgggaactactcaaggtctcccatgtgcatgtgagctagctagatatgctgttgatagcataccacttgacacaatccatatgtgttggcagaggctaagttttttagaccaaggtttatttgagcccgaagtccgtttaacccaagagacggaagccatatccaagcggtttgaagatcttgatatatgtggcaaagtgactctaaagagtaaatttcgagaacttgcatatcttgatctaacttcgatgtgtactcctcttaaaaaggtgaaaacaaaaggtgatcaaatgaaacaaatgaccaaacaacaaagatcaacgaagcgtgattcatcttatttttgagtatgtggatgcatatgttaatcataatctgatacatagtcaatgaaataatgcaaaatcatcatcctcgcccaccaccatctctcccatatgtatccctcctttgtcttgaccgaacataaacattttcgtgcttagtgacacccctggctaatcttatacacttgtctgttatagtgtatgcatcagttctagcagtcaccatcattatatctaacatgtgttgcaagctttctgctaacttttgaaaatagcctaagacaatgaaacaacgtgaaaaataatattggaatatttaagaaaaattttgcttaatagaattgtaagtatattataccactgcatgtcgaggcatttcaacatcaacaggtgttgttgcaagtggatatggcattgttgttgtattctccgtcgacacaggtggatgtggcataactgttgtaggatcatgcaccatgagaggatgtctaagaggctccccaacctgtggcaaacttatgaatgggtgaaatatcatataaaaccactccatatagcccagagcatactgagcaagaaattaacaaactcctattgatgcaacatattgtgaaaagtacattcatctatcatcaatgtcatttgtatatagcgatggagaactatggagtggaggaatggactgaacatagccaaattgtcgtaataccctctctggtaaatgtttaaaaatatatggaccccatctgatatgtccataaaatagtgaaatcaactaaaattatttgaaaccacaatgatcaccataaggtattcaacaaacaacatctgctgtcaacttatccaaccacttatgataggtgatcagtggtaatgccttcccacacttctagcgacacacacttggtttgctctagtggtagtcctcattagcaatcatattcccaatagttaggaaatgcttgtagatccaagactacacatatttaaaaaaatgaatcagaaaatgttaatagtacatataaagttaaaaacaaataacaatgataaaaatcaatataattaccagcaagagagtgatatatcttgcaagatgtttagccttgtgcttggacacataattcagattctcatacatatgtactagtgtagccgctcctcgtgaaaactctccagatttattaaggtcacgaaatgagttccagaataccacactgatatgtgtgacactcttgttagcaaacaatgtgcaacctacaagatgcaataaatatgctctagctgctagttgataagtgccacaaatcagtagaaaataggattcaaacatggcacttattcatcatttttgtagatgtaatcacaagataaccctagaaacctagttaaatgatgatgatattaaggtaagctatgcttttgtgtttcaagaagctttcgtccaattaattgattcaattttgctaggtttgaagattacggaagagccaagcttgcgaaaataggagcctagggtgaactaagcaaaggaaagagcctcaaacagcaaattaggcccaacagacaccaaggcccaagggattcttcaaggttaagtctttagctcgcccaagccaccaattcatgtgtattctagtcgcctgggcgacccacactccccaaggaaccgccctagctcgcccaggcacctgaaaataggctattctggtcgcctgggcaccccaagcaggcaggagaccatttcctataaatatgggacgaattttgggagcaaggcatgttcctcacttcattttctctcctaaattcagttgcttgttcaaatcttttgtttcttagcttcttgagtgagtgtagaacttagggaagtgaggttgagtgacttgtgtaaggagattctgccaaagagaggatcgatgacgagcttagtcggtgattctctcgaggaggttctgcccatgttcgcttaagcttctctatagattggacgtactcttcttatccctatgctcttttaattatttatgcatcgttctacttcttgttggtaatttcattctacgcttaatgcttgattctacttgatcactagggtcacgaacttaaattcctaagtgagactggaaagtaatcttagggtttgaacttaatgaaattactcgttacgttacgttgctaggaatagagcataatgtttcgatcgcattaaacacgtgaatatgatcttaatgcttggatatttaattaagtatgcgatgaatcgatatttagtaaaatatccatagggcttaattgcgaggaatcgagttaagtttacctaaacgtgtgcgtcaacaagaatagaaaatgcatagataaaatcaattaaagggataagcaagacgaaacccaatccaatacttacttgacttgtatccgtttatttattttatttcccgtcatcgtttatttgttttccgttatcttattttacattttctgcaacaacaacaacaacaaatgaatcttcgctttttatctgtatataactactaaactgttaattttaaatcaaccgacgtaaacccaaatccctgtggagactaaattttataaattcgaaacttacagcgataacaacggtacgcttgccgtggtgaaaattcctaacaagtttctggcgccgttgccagggatttggcttgtttacttaaattgtttttaaattttcagtttagtattttcttgttctttattttctgtttttgtatatatttctttgttattttaaaaacctctgtgcttaacaaaaatcttgtagtttctttcctttccctttatgcgagataagtctgcagataaatctcattttgatccggaaatctccaaaaccgaaaggaaacttcgaaagaaaaagaaacaagagactgataagcacattgagggaacttcgtctattgatccttcctcaccacaggtaaaagataatatggctaaccaacaagggcccaagcattataatagcatagttttccctccgtttcacaacaaagttgtagaattgaagcctgcactacttagcctcattggctcgcaccctttcgccagactagaccatgaagacccatatacgcatctatctactttcatggagttgtgtagcacgatgggagcaccagacgaggatgcagaagctgtctatcttagagcttttcctttctctttaacaggtaaagcaaagacttggcttcaatcacaacccaacaagagtctaagcacgtgggaagccttggaggagaaattcatcgttagattctttccgccttcaagattcatcagtgcaaagtctgccattgccactttcgctcaaggaatagatgaacctctctgtgagatttgggaaagatttaaatcactattgaggagatgcccgaaccacaattttgatgacgccgctcagttgcatatcttctacagtggtctgaggcctcaaaccaagatgatcttagatgcttcagctggaggaaccatgatgtcaaagagtcccgaggaagcaatcgtaatcatcgactcaatagctgcaagtgattattagtctcaccatgataggtcacccattcagaggaaaggcgtactaaagcttgatactcaaagtgctatcttggctcaaaacaagctcttgacccagcaattagaggccttaaaaaagcatataggccaacttcctcaacttcagcaaggaggatcacaaaaaacacatcaagttcaacaaaaattgagttgtgacttctgtggaggcaaccatcagaatggccattgttcaatatctagtgattttccacaagaagagaaagttcactacatgcaaaatcaatcaagacctcaacaaagctatgaagggaattaccaaggttatcgcaacggtccaggttctaatcaaccttttaatacttataatgcttataatgtccccactaaccctccttttgcaagttcttctaatgcttttccaaatagaaatatgccacagcaagatcaatctgatagactgacaaagctggaagatactcttactcagttcatgcaagtgtccatcagcaaccaaaagaataatgaagcttctatcaagaatctagaagtgcaaattggacaacttgcaaaagcagtagctgagcatggaggaggatctttctcagcaaatactcaagttaaccccaaggagcaatgtaatgccattatcacaagaagggggaactgtggttggtaggaaagaagaagaagaagaaaaagaaaaggatgaggaagaaaccaatgaaagaattgaaaaaaaagtgacaaatgaggagaaaaagagaaggagtgacaaaggcaagacagtcttaaccccaccaccagtccaaagaatgccatatccacacgctccatccaagaattcaaaggaaagggagtacaagcgttttcttgacatctttaaacaattacaaataaacattcctttttctgaggcgttggagcagatgccaaaatacgccaagttcatgaaggatctccttactaaaaagagaagatacaccgatgaggagaccatagagttggatgcaggatgcagtgctatcatccaaaagactctcccagaaaaatcgagagatccaggtagctttacaatccctgttactattggtaatttttctgtgggaaaatctcttcttgatttaggtgcaagcatcaatctcataccattatcaatggttaagaggatagaaggggttacaattaagcctactaggatgacgctgcagttagctgatagatccattaagcatccatatggcgtcattgaagatgtgttggtgaaagtcgacaaattcttcttcccagtcgactttgtagtaatggacatgaatgaagacagtgaagttccactgattcttggcagaccctttatgaagactgccaaggtgctgattgatgttgatgaaggaaagctcactatcagagtacaaaataatgaaatccaattcaatgtttttgaagacatcaaacaccctacaaatgaaaaagaatgttttaaggtggatgtcttaaatgagaaagacacagcagttgatagctcgtccacatattcaaatcatttggagccaaagccatagcaaactcgtccagctaatacgacgttaaagaagcgctcctgggaggcaacccagtgtttttaaattctgtcttttattattagtttatatcttatctttttgaaaatatcatctgttttgttagaatttggttataggtacattttgttaagaaggcaaaagcaaggaaaagaacgtggcagattttgttgattagctgaagggaggacataaagcttctcagccacgatcttcaaaaacagtgatatcgttttaaaatttctttactgctttatagtttttaaatccagtactttgactgttactatgtttgcctctttttgcttgcacatagaatttttttcttttctaaattacacatataaaatacttttttcttgtaaaaatctttttgggacttaactgatatatggtgttttgaaaagaatcaactgaaaatgttttgaaacttcttttaaaagatcagaaccacaaaaataaagtttttgtagaaaaccttgagaaatgaaaaacaaaaataaatggtcttttcagaaaaatcaaaatcaaggtaaaaagtctttttgcatggaaattgagaaataacttcagagggaaacaaatgatttggttgaaaacatgaaaacagacgtttagcccaagtgagtgtgtgcatctaaacatacattatacacagagagatctcactggcataatctatagtactttttgcataaaattctaatcgtcataagcatatgattcatggatatgatttaggccatcttttctttttgaatacattattagccactggccaaaaagctatcccaaaatatattaaatgatttatcctttgcaaccccctttgagccttaacagttgatattttattgaaaccctagcctaggataggaattccataccttacctaaggttaggagagcaagaagggaatgagttgtgatggaaagttcttttgggtagttcatgttatgaaaaggatttcttaaaagtggttttgtgtaattaatgataaagaaaaaaaatgaaatgaaaaagaaaaagaaagaagaagaaaagaaagaaaataaaattccttgtgataaaaagttgggtgaaaaagaaaatgatgaaaatagatatcttggaaaaagagaaaaggaatagcaggtaatgatctaaatatctctatcttagcttgctctcctagtcctaaggtcatttgaatatccagaaaaaccaagatttctttctagccaagcctagccataaaagacctaatgatccatgatgagtatgtattatgatttgatgggaaatgaactgcaaaatttatctatgatatatcagtgatagatgtaagactaaacacttacctgtgggagaattaaacactttttgagactgtttgaaatcagtcaaatgtttcctctgaggtctttttgaaatgaagtgtaaaattgactctaaacctcaacttgatttcatgaaaatccattaaattgttttctcaaagtatcaaggttaactactttttgaaaaatctgttctgatcaaaactaagttgattcttgtcaaagcatgatatccttacctttgcttgaggacaagcaagattctaggtaagggggagttgaaaagtgccagtaatcagtagaaaataggattcaaacatgtcacttatccatcatttttgtagatataatcacaagataaccctagaaacctagttaaatgatgatgatattaaggtacgctatgcttttgtgtttccagaagctttcgtccaattaattgattcaattttgctaggtttgaagattacggaagagccaagcttgcgaaaataggagcctagggtgaactaagcaaaggaaagagcctcaaacagcaaattaggcccaacatacaccaaggcccaagggattcttcaaggttaagtctttagctcgcccaggccaccaattcatgtgtattctagtcgcctgggcgacccacactccccaaggaaccgccctagctcgcccaggcacctgaaaataggctattctggtcgcctgggcaccccaagcaggcaggagaccatttcctataaatatgggacgaattttgggagcaaggcatgttcttcacttcattttctctcccaaattcagttgcttgttcaaatcttttgtttcttagcttcttgagtgagtgtagaacttagggaagtgaggttgagtgacttgtgtaaggagattttgccaaagagaggatcgatgacgagcttagtcgatgattctctcgaggaggttctgcccatgttcgcttaagcttctctaaggattggacgtactcttcttatccctatgctcttttaattatttatgcatcgttctacttcttgttggtaatttcattctacgcttaatgcttgattctacttgatcactagggtcacgaacttaaattcctaagtgagactggaaagtaatcttagggtttgaacttaatgaaattactcgttacgttacgtttctaggaatagagcataatgtttcgatcgcattaaacacgtgaatatgatcttaatgcttggatatttaattaagtatgcgaggaatcgatatttagtaaaatatccatagggcttaattgcgaggaatcgagttaagtttacctaaacgtgtgcgtcaacaagaatagaaaatgcatagataaaatcaattaaagggataagcaagacgaaacccaatcctatacttacttgacttgtatccgtttatttatttcatttcccgtcatcgtttatttgttttccgttatcttattttacattttctgcaacaacaacaacaaatgaatcttcgctttctatctgtatataactactaaactgttaattttaaatcaaccgacgtaaacccaaatccctgtggagacgaacttttataaatttgaaacttacagtgataacaacggtacgcttgccgtggtgaaaattcctaacactagtgtccattgccatgcgtcacatttggtacaataaatgtctcgcagacagggaaggctaacatatgcccctctacattgctctgtctcgtctactgcttgttgtgtagtcactgcaagtaactcaactaacaactccacagcttgttctacatctattgcatcataggtatcgaagacacctataatgggtagatgtaacaacgatgccacatcattgagggcaatactcatctctcctctaggcagatggaaactggtaatttccttatgtagtctcttagcaaaaacagaaaaaagtcatttgtctcttgtctccaatgaacatgtaattagagaacttaagtctttaccaaccaccaaaccttcaattttaggtgcagaccttcctcccatgagaggtcaacttcagctcaatacgttcctgcaaataattataattaattaggtaaattaaaatgataaataaaatttaaatatgttataactaaagaaataactacccttcttgcccacaccttggctgccatatgatcaacatatgatgtcaacattgatgtatcttagggtccacttggaaagccatatgaatcagcacctacatcctccgtaactggatcatgaggcttttcgtgagcctcgctagcagcatgatccacatgctcaatatcctcgacaacaattgtagttgcccgttgtccaagtgctgatgttgttggccttcagcgctgaggggcttattcctcatcaccactaacctctatacctaaagctctgcctaaagctcgacgcaatcctctcgttttaaccttaatctaaattttttcccaagtattagtctaatacttcaaatcaacccacaacttcaagaaaatactcttaaattgaaaataaaaccatattaataaatgttctaaaaccatactagtatttattaaatgtagtatattttaagaaatgtagtaaaaaatttaaattaactttaaatgattaatcgagcagagtaaaataaagtttgatatttgacgaattttaggttaatttcttaaaacattttataggtatttttttcaatttgaaaaccttttctatgattaattaaacactactctctcactctaaaattgcatcagaaatagcaaatgaaaattatttattaagcatgttggcaaggtaattgtgtttagtatttagtcttttcttttttgagattttttcccaaatcaataatctctaattaatggaactaataattgatgttatgtaccaacaaaactaaaagattaatgtcaaattatagttatatctttgataagatcacacaattgtacatttcaaatctcttatttagtgtctgtttaaaagaatttatttgaacttatttttgacaaacacgtgtgcaaatatctcaaagattttatgaaaatagattataatatgtttagaaattatgttaaatttatttaaataattttctacaataacttttgaaaagaacttacagcttatataaaacaattaatataaattattttcatgagtactcattcaacaagtctttaattaaattatttatccaaattaatcataattatatttgaaaatttaagtgttaatataataaattcattaattataatttttttctagtgtattagacctatatggattcacaatttgtatggtctatacatattgttaatccgtagggatttaacacaacgatgaggtgagagcggtactcacaacgtgacagcgggatcatgagatgaagaagggattgaagaaacacaaattgatgagatgaaaggggaattgatgaaccaattgaagagaagatgaagagagactcacaataatgcaatgtaatggtgtgaaaatgtagattatgttaacaatcatttgaacacacatgctacagaaagagatattgaattgcattgatagcagtaacgaaaaacaataccagcagtagtagccacttacaaaatgaataatagctctgcttatatagcaactttcacatattgataaaagccactaactctaataacagaaaattagttatctaactaactttttaaactttgaattatccttaacactcctctttaattcaaagttgcatttacacatataattccaattgaatctcttaactctctaaacctttctaacttcaaagctttagtaaaaatgtctgccaactgaatttcagttctgcagtgctctagcttcaacttctcattgctgacttgttctcttataaaatgaaatcttgtttctatgtgcttgcttctaccatgagatgctggatgccttgctaaatcaatggcagatttgttatccactagcaacttcactttgcttttacctttcacttgcaattctgtcatcaaggcatctagccaaacagcttgacatgcagtttccgaggctgcaatgtactctgcttcacaggaagaaagtgctacaacaggttccttaatggaggtccatgaaattggtgctcctccaaagaagaagatatatcctgctgtgcttttcctgtcacacttgtctccacaccaatctgaatcagaatatccaactaattttggttctgaatcagcttcccctttttggaaacagaattccaaaatcaattgtaccttgcacatatctcagtatcctctttgcaactatcaaatgggactgctttggctcttgcatgaatctactaattaacccaacactgaagcttagatcaggccttgtattgcacaaatatctcaaacatcctactatctttctgtaataagtaggatcaattaggtcttcatttgtatcattcttcaagataagcccaacttcagctggtgttcctactggattgctttgctgcatgttgaatcttttcaaaagatcttttgcatatttggattgatgcatcactgtaccatattgagtcgctttaaactcaattcccagaaagtaagtgagtagtccaaggtcactcatctcaaattcattcatcatttgacctttgaacatgataatagcatcctcattgctgccaataatcaaaagatcatcaacatgtaaacagactatcaatttttttgttttctcactgtttttccagcatttcacatagactccatgttctgaggtgcatttctcaaaaccaatttgggacaagaagctgtcaattctcctgttccaagctcttggagcttgtttaagcccatagagtgctttcttgagcttgtacaccatactctctttgcctctgacctcaaatccctgtggttgatgcacataaacttcttcttctaagggaccattcagaaaagcagacttcacatcaagttgatgcatggaccagtcaacattggttgtaatggctactaccaatctcacagtttcaatccttgccactggtgcatatatcttaccataatcaattcctgctttctgcaagaaaccttttgctactaatttggccttatacttcactacttctcccttaggattaaccttcactttgtagatccatttcagtgctataggcttcttgtgctgaggagaatctaccaattcccaggtctgattcctctcaatagagttgatctcctccttcatggcttttaaccatttctcatttgtcactgccttttcaaattcaaccggctcagcttctgctataagtgcaaaatgcactaattcaccatctgagtttactggtgaatattgaaacaactcatagtctctcaaatgggatggcaattgacttatccttgctgttcttctcatagtttggtcagttagtgcagttgaggtttcttcttctaagaatatcctggactgaacctcttcagaggttgttccccaattccaacttttactttcatcacatatcacatccctacttatggtaacttgaccattctctggatcatatacagtttataaccaccagttgaatgatagcccagcaagatgtgttgagtgcctttatcatctagctttcttcttagctgatcaggaacatatttgtaacgaattgaaccaaataccctcaagtgagtcacatctggcttcaatccagtccaggcttcttctggtgtcataccttcaagtctcttagtaggtgatctattcaagatataagctgatgttgatacagcttctccccataagtagcttggcaggttttttccttttaacatacacctcaccatgttcattattgttctgttccttctcttagcagtaccattgtgttgaggtgtgtatagtggtgttacttcatgaattatcccttcactttcacaaaactgtttgaagtcatttgacacatattcacccccaccatctgtccttagaatcttaatcatttttccactttgcttttctaccaaacatttaaattttctaaagacttccagtacctcatgctttctcttaactaggttgatccagactttcctagttaaatcatcaatgaaggagataaagtacctatttcctccaagagtgtccacttgcatagggccacaccatcagagtggatgatgtcaagtttctcaacagcatttatgggaacatacttgctgaaactattttctagtttgtttgcattcaatacactccttgcacacctcttttgggactaagacctgaggtagtccttcaaccatttggtgtcttgcaagaagatgtagatccttgaaattgagatgaccaaatctatggtgccataaccattcaatcttgttttctgaagttgcaagacactcatgcttcataatattcatcccaattctaaaggttctattctgagacagatttgccttaatcacaagtttctggtttttatcaaataccttgagacaattgtcctccatcctcatcacaaatcctttttcaagtagttggcccagacttaatagatttgtcttcatgccaggtacaaacagtacctcctcaatgaaaatatcttttccatcctgtaccttgaatgctacttttccaataccttcagcagtcaatgtactatcatccgcaaattgaactttgctcttggatgattcattcagattgatgaaccagtccctcttccctgtcatataagtggagcagccagaatctaagtaccatgaggagtcacttgatgattcactgctaatggtagccataagcaatataggttcagaatctgagccttcatcttgagccagatttgcatggttgctgggtttgttcttggcagcttctccttgccaacattcttttgcatgatgaccaagtttctgatagttgtaacatttcacctttcttttgtcaaacttccactccttcttgttgttggagtttattttctgaaaagtttgatatgctgtttttcctttgttgaattcatttccttcagctgtcacttattcttggttctttgtgatggaatttaacttgtttcctttccatggtgctttccctttccctctataattggatcttgcatgaagtgcctcttcttgatgggatcttctctcattgatcctcatctcttgtgcctcaagagagtgctgcagttcttcaatttgcattgtttctagatcctttaactcctcaattgcaacagctacatgatcaaatcgtgatggcaaagttctcaatattttgtctaccacttgttgatctgaaatagtctccttgcaggccctcattgcatttaccagttcttgaattctgtcaaagtaatctgttatggattctttgtcctccatggtgagaagttcatattgccttctcaatgtctacagcttgattttcttgttcttcttgttgattcaagtgaagccatgtgcaaatgagcaaggaatcaaggcttaagtgttttgtgctttcaacatgctcaaggataaaagttccaagaaaagcttgaagaccaatttgattattgtaaaagggagtttatgatctgataatccaattgagcatatcatgcatgaatcattcatctaggattgtttgattaaaggtcttagtaaaagcaattaactagaaagacatttaacaagcaaagtttttggaaaaatgaagttctactgtagtaatcgattacaggagcgtgtttaatcgattattttcagttagaaagttgttataaatagaacccattgctctgtgttttagtgacttgagaattttgaaatctgagcattcacaaacattcacaagctttcattagtgactttctgagtttcaaaaggcatctgggcttcacaaattcatatggttttttgattcaaagaagtgaagcatcattgttcatcaaagcataaggaaaggaatgcattgagtttgtaatttgtcattcaacctgttaaatcattcatttgcatgagttcttggattatcatgtgatatctttccttattctttgaaggtgtaaaactgttatttgaatttttgtaaagattagtctattgtaaatgggtttcttacatgtttagagatagtgtttctctaaggacagctgagtagtgttctcagtgtgggttttggtcactaatagtgttttagacttctgaactttatctagggttgataaagagaggcttgtaattgcttgtaagaatatttttgcaatagtggaactctactctagtgttgagtgaaagaactggatgtagcttcatagtgtttgaagtgaactagtataaaaatctgtggctaatctttcttctcacctattcatctcttaattgctttgtttgtgaatcaatctcattgcacagaaagttatactctgttttctattcctcttggaaaaggaatttgattgaatattaattcttggttttgaaacaatttttaaagtgataaagatcctgtggtaactctgattttaaaattttaatttaccaagattcaaccaattcaacccccctcttggttgtgttgaagtattctattcattttcaattggtatcagagctggttcttgtaagttactcaagatcattttttcttttcaaaaaggaaaatgaatacttctcaaataacctttaaggtgggtgcctctttaaacagacctccaatgtttgaaggggaacacttcagtttttagaaaaatagaatgaagatctttattcaatcaaatgacctaggagcatggaatgcaatagagaagggtccctttattccaaagaaaactgtggcaaatgagttgattcccaaagaatgggatgagatgactgaggctgaacaaagaactgcccaatatgattttaaagctaaaaatatgatcacctctgcactttcctctgatgaatttttcaggactgtgagatgcacaagtgcaaaacaaatgtgggaaatgctggaaatcactcatgaaggaactgaggaagttagaaggtcaaggaagcatgctttgatccatgagtatgaaatgttcaagatgaacaccaatgagagcatttctcagctgcagactagatttactcacattgtaaatcaccttttgggtcttggaaaagtatttgatactgaagaattaaacatcaagatattaaagtgcttgacatgaccttggcaaccaaaagttacagcaatcaaggagtcaaaagatttgtcaaagatttcaatggctacattgtttggtaagcttcttgaatatgaattagaaatgtctcaattaacatcttgtgaagatgcagaaaagaaaacaagaagcatagccttgaaagctacaactttgaaagttgaaaaggaagaggaaacaagtgaagaggatgataaagataatggaaacttagtggtgaaaaagttcagcaaatttctgaagaaaaacaaaaataaaatgttcagcaaagggaacaaaaacagcaataacaataacaacctcaacaagaagattgacaacaacttcacattctttgaatgtggcaaactgggtcacatcaaatctgagtgctcaatctacttgaggaagcaacaaagtgaaagcaagatgaagaaggaaggaaaaggaaagagggcatacatagcttgggaggataatgagttaacaacctcagattcttccacagaaaatgaagaagctaacatgtgtctcacctccaccatcaatgaagatgatgatgacttgcttagtgaaggagatgaggtattctgaacttgatcaacctattcatgcttttcaagaaatgtatgaggaagcccaaaaacttgcaaacaccaataataagctcaaaggaaatcttagatggcatattgagaaaataactgaattgcaaaatgagatttgcaacttgaaagaagaaaatgaaaaacttgtttcaagttacaaattgaatggatggtgtgtgcttcttcctctagcaatgttgacaagtataagttgcttcaaaaggattttatgagtataaacaaagtcaaggtgaaaaatatatgttgcttttagccaaatacagtgatttgattgatctcttgaagaagttttataagggaaaatgcaacttggctgaaatgttaagtgtgcaaaagtatgctggagatacttttggtttggggtataaacatggatcaaaatcatttggaaaaacagtttttgtacctccaaaacagaagaatcaaaagtgacaaaagaactcaagggtcaatcaaaattctgctattgggaaaacttcaaaatctgtcacttgcaactattgtatgaaaaaggggcacacatcttttaaatgctatgctaggagattctatgtgcctaatggtgattgcatttggattcccaaagtaaaaagaaaggctaacctttatggacccaaccttgagtgggtaccttccattaaattctgatttgtattttgtaggtgtgtctaagagctaggacatcaacttggtatcttgatagtatgtgaatggagacatgtcctttctttcaaatttgactttaaaaaaaggaggatatgtcacttatggtgataataacaaagggaagataattggtgaaggcaatattggagacaacatcaaagcaaaaataaaaaaaatgtgctttatgtgaatggattaaagcacaatttgttgagcataagtcagctgtgtgacaaaggctttaaagtaaatttcaacaaggattgctgcataatttctgatgagaaaagtggtgaggtactgcatataggtaaaagaaaaggtaatatatatatatatatatgctttcaattgatcatgcattattccataaatcttcttgcctaataagtagagttgatgaaacttggctgtgacatagaagagcaagtcacataaacatgcatcacatgaacaaactcataagaaaagatttagtaattgaattacccaaactcaagtttgagaaggacaaactttgtgatgcttgtcaaaaggggaaacaaacaaaaaattcttttcaaagcaaaaacattgtttccacctctagaccacttgaacttcttcacattgacttgtttggtccttctagaacaatgagcttaggtggaaattaatatggacttgtaattgtagatgattactctagatacacttggactttgtttttgaaatccaagaatgatgctttccttgcttttagaaaaatggccaagcttactcaaaatgcgaaaggatgcaagatagtttcaataagaagtgaccatggtggtgaattccaaaatgaacattttgaaaaattctgtgaggaaaatggaattaaccacaatttttcagctccaagaacaccccaacaaaatggtgttgtggagaggaaaaatagatctcttgaggaaggagccagaacacttcttaatgaatcaaatttacctaagtatttttgggctgatgctgtaagcactgtgtattatactttgaatatattacttataaggcctattttaaagaaaaccccttatgagctatacaaaggaagaaagcccaatatttctcatttaagagtttttggaagcaagtgttttgtactaaacaatgggaaagatcacttggaaaatttgatgctaaggcagatgaagcaattttccttggatattcattgcatagcaaggcatatagagtattcaataaaagaacaatgtgcattgaagaatctgtacatgtgatttgtgatgaaactaatccctctaaggaggaaaaagagttggatggtgatgcaggtcagctggaagaagtaattgaaataggcaattcctcaaccaaaattgaagaaccaagagctgaaacagaatccacaacccctgttcaagtgcctaaagattggagaacaacaagagatttatcacttgacaacatcataggtgaagtttcaaagggagtatatactagatcctcattaaagaacctatgttgtgatatggcttttgtttcacaaattgagcctaagaacattgatcaagccttgaatgatgaacattggatgcatgcaatgcatgaagagctcaatcagtttaagagaaatgaagcttgggaacttgttcctagaccttcatctcttaaacccattggcacaaaatgggtttttagaaataagcttgatgagagtggaatcatagtcagaaataaagctagattggttgctaaaggctataaccaagaagaaggcatagactatgaagaaacttttgctccagttgcaaggttggaagcaatcaggttattgcttgcatatgcatgtctcatggatttcaaactttttcaaatggatgttaaaactgctttttaaatggatatattgaggaggatatatatgttgaacaacctcctggttttagagattttaaacatccaaattatgtttacaaactaaaaaagatactttatggtttgaaacaagctcctagacaatggtatgagaggttaagcaaatttttgcttgaacaatctttttcaaggggcaatgttgataaaaccttgtttatcaaaaggcttggaaatgatttcttattggttcaaatttatgtggatgatattatatttggttctactaaccacaagttatgcaaggatttctcatcagctatgcagaaagaatttgaaatgtcaatgatgggtgaacttacattcttccttggacttcaagtaaagcaaatgaagaatggaacctttcttaaccaatcaaaatactgtcttgaaattatcaagaaatttgaaatggagaagagcaaggatgctgcaactcccatggctacatcaacatatcttgattcagatgaaagtgggaagaaagttgatgagtcaaagtacagaggaatgattggatcattgttatatttgacagctagcagacctgatataatgctcagtgtttgtttgtgtgctagatatcaagctaatcctaaagagtcacaccttattgctatcaagagaattctgaaatatctcaaagctacaccaagagttggtctttggtatccaaaaggtgcttctttaaatattattggttactctgactctgattttgcaggttgcaaattagataggaaaagcacaagtggcacttgtcatttgctaggaagctcattaatatcatgacattgcaagaagcaatcttgtgtggcattatccattgctgaagctaaatacatttcggctggaagttgttgtgtacaaagcttgtggcttaaacagcaaatacttgattatggagtggaactgaatgctatttctctgctatgtgacaacacaagtgctatcaacatatcaaagaacccgataatgcattcaagaacaaagcatattgagataagacatcatttcctcatagattaggttcaaaaaggtaacataaaggtagaattcattgacaccaatcatcaactagctgatatattcacaaaactattatctagagatagattttatactcttagaaacatgctagggatccttgatgaaagcaacattatctagcctgttttatgtgttttatgtgatgattaaagcctatatgccacataatgaataagtgtttggatcattgtcaaaaagctgctaaaatgctctgcatctgatgtattctctgttgtaatcgattacaccacgggttaatcgattaaaatcattaaaaatcaagtttggaacgaaattagtactcatgtaatcgattacacacgaatggtaattgattattcttcacatttcagaaatcacttacctctggaataatcgattacacatcgggataatcgattacattgttcaaaattctaaaactaaaagcataactcactgtgataatcgattacataagagttgtaatcgattactgttcatatcagaaataactctcactctgtgataatcgattaccactcgggataatcgatcacttatgacctgatacttgtatgattgatgcaagctctggaataatcgattactttgagaaagaatcgattactggtcatcttcaacctcaggtcaagaatgaaataatcgattacttataaaactaatcgattaccatgtgttttaaaggtgcctaattgctctggaataatcgattacattacgaaataatcgattattcatgttgttgtatgaaatctgacaggttttaatggaaaatctaactgcccaatccgtttaataaccaacccaatgtcattaaactgtcaccaacagctatatttttgaaattatggacgttaagtgactgatttgtgcctataaataagtgattatatgccttagacaatctgcacctattctcttctatctctctcattttctgcaaattttctgtgtctaaactttgtccaaatcctctattctaaccatgtcaaatcctatacccaagagaactagaaccacaaagaggaaagctggtgagtcttcctcaaatccccctgcacctcagccaaccaataggttagacctatggttttcatccgaggctaataaaatgaactatttgcagttcaatgccacaaaaccagtggccacccctaaatacattgaccttgactggtttattaggcaaggattccagtttccagcctacttagagtcccaaaaccttaggagattcttagaaatgaagggtactttctaccgtgatcttgttaaggtattttaaacctgcttgaaaggctcaatgcagggtgacatgaggtcaaaggttaagggagtaaccatgcatattacttctaatatatgggaaacagtagccggggtagtctgtgagggagcccgtagatttgatgaggatccagaagggtatagcaagatggacacctacagaagcatgcttcatgatcctcacatgaggctaaggaccagacttggcacaggtcctatgactgctgaggataggttgctacactatttgatcacatacatcatcactctaagggccacaaaccatgcccaagcaactgatgaggatcttcagttggtgtatgggctgaagcatcacattcctatgaactgggcccttatttttgaagaaataatgctgaaatcaaaaaggttggtcaattacccattcccctacccagtgtttgtgtctaggttgattgatcatttcaacattgatgttgaaaatgaagttgtagacaacacaaactcctacaacagccaaattaaggagaagcacttgaccaagatgggtatgagaaagacacccaatggttgggtgatggcaaatcagatggttgaagaacaaggagaaatggtggctgattatgatgaagaatagcaacaaccacagcaacaacaacagcctgcacagccagtcttcacagactttgaatccttgatgattcaaaggatggactccatgctgaagcttcaagaagacttcaaggctaaaacccatgaagccttagaagacattagggaaaggcttgactcaatagaggctaacatgaatgatcaagcctctgttgagttctaggattgtttagatttagttaatgtttgttatattttctagttaaactatgttctattctgtttctttaagtttattttaattcaatattgtattgccccatatgcattgatattaatgaaatatgcttttcaattttatattcgttgtgcctaccttattttttgacttttaacaagccaaatagggggagaattgattaagggggagtgagtttcaaatcactctgtttgcccctgttttctggttcagttttggccaaaatgttgatttgaatgagtgctggaatttagggggagtagttgtgtaaaattaaaatcaatcaattggtatagtgcttaattgaataattcatgaattacatgtgctttaacatttgtttcttggaaaggtattgaaagcttacaggttgaaagctttacaggtttataaatcttaatgttcaacaatggcttttcaaatttatctccaagtatctgtgcttaatcaaattgaagatttggcatgtttaaatccaaaaagggggagattgttgattcaagtgaagccatgtgcaaatgagcaaggaatcaaggcttaagtgttttgtgctttcaacatgctcaaggataaaagttccaagaaaagcttgaagaccaatttgattattgtaaaagggagtttatgatctgataatccaattgagcatattatgcatgaatcattcatctaggattgtttgattaaaggtcttagtaaaagcaattaactagaaaggcatttaacaagcaaagtttttggaaaaaagaagttctactatagtaattgattacttaagtattggaatcgattcttttgttcttcgtgccttttagaaaacaaatcaagaacatagtaatcgattacatatcgaattaatcgattacataggccaaaataagaaaatcatactgactgtcttaatcgattacagatgggcgtaatcgattacatccgtgcctatggtaaacatgttctactgaggtaatcgattacatatcaaattagtcgattacatagttcatttgaaaatatgtgcttgactgtcttaatcgattaccatagtcagtaatcgattaatcaatgcatttagaaaaacatgtctgtctggcttaatcgattacttcacaaaataatcgattatattgttcatagcctaaactcagaactcatcaggagcactttaatcgattacattcttgaattaatcgattacatatgcgaaataatcgattacaggagcgtgtttaatcgattattttcagttagaaagttgttataaatagaacccactgctctgtgttttagtgacttgagaattttgaaatctgagcattcacaaacattcacaagctttcattagtgactttctgagtttcaaaaggcatctgggcttcacaaattcatatggttttttgattcaaagaagtgaagcatcattgttcatcaaagcataaggaaaagaatgcattgagtttgtaatctgtcattcaacctgttgaatcattcatttgcatgagttcttggattatcaggtgatatctttccttattctttgaaggtgtaaaactgttatttgaatttttgtaaagattagtctattgtaaatgagtttcttacatgtttagagatagtgtttctctaaggacagctgagtagtgttcttagtgtgggttttggtctctaagggtctaatagtattttagactgttgaactttatctagggttgataaagagaggcttgtaattgcttgtaagaatatttttgcaatagtggaattatactctaatgttgagtggaagaactgaatgtagcttcatagtgtttgaagtgaaccagtataaaaatctgtggctaatctttcttctcacctattcatctcttaattgctttatttgtgaatcaatctcattgcatagaaagttatactctattttctattctttttggaaaaggaatttgattgaatattaattcttggttttgaaacaatttttaaagtgataaagatcctatgataactctgattttaaatttttaatttaccaagattcaaccaattcacccccctcttggttgtgttgaagtattctattcattttcacttctctccatccccatatgttttcactagaatatcccatgcttccttcgacgtggaggctttggagattttgttgaatatcttcgaattcacacattggtagatgaggaaccgtgccttgctatcaagtttctgctgctgtttgaagatctgtttctgctcatcagaggcattcctgcttggttctgtgaagccacttgtcactacttctgccacttcttggaagccaaagattgccatcatcttgatccgccaattatcaaatagtttgccatcaaagactcgaaaagatccttgaacgaaattgttgtagcctgccatttctgcaccctgttcctttcttcaatcacaatgcagtacacaattggttcttcattggttgttcttctatctaagaacactcactcagccacaacacctcacaagaaaatgatggagaaagggacccaatacacatgacttggaggaaaatagaaaatatctctcaagaatctctcaagaacacaatcaaagttctcaaactaacattcctcacaagttttggatctcacagctcttgataccatgttaacaatcatttgaatacacatgctacagaaagagatatggaattgcattgatagcagtaacgaaaaacaataccagcagtagcagccacttacaaaatgaataataactctacttatatagcagttttcacatgttgataaaagccactaactctaataacaaagttatctaactaactttttaaactttaaattatccttaatagattaatggtgtgagagtaaagatagatttacaattttaaataaatgataattttattttttgttctttttaataggtgtatttaagatttattggatgcataaagaaaacccccgaacctatccttgccttttgcgggcacgggaagaagagagccacacccgtcccagccggttgccatccctaatttactactcacacgcacaactgctatctgctctctccacaccgcgcagcaattcctctcttccctctctgcaccccctccatggcggaaccaatggctgtcgattccaatcccgaatccggtctcgacttcgagtccccgttcgcgtggggaagaagcgaggcatgggaggcaaaaagaagaacgtgcagttctacgagtcgttctccttcgacggcgccgagtacgtcataaacgacgctgtatgcctccagagcgggatcggcggcggcgagccccacatcgggaggctgatcaagatctgggagacccgcgacaagtccaggaaggtgaaggtgcagtggttcttccgccccgccgagatccgcaagtacttggttgggatcgaagtgaagccgaacgagttgttcctcgcgtgcggcggcgacggcgccaagggcttcgccaatgtcaatcctttggtatgttttggattcttaatctctgctctgtcgttttgaggattattggctatttttctgtcgttttgagtgtttgcttccaatactttggtaagtttcggattttgaacctgttttctggcgttttcaagtgattgccattttctgtcgttttgagtatttctttggctgtttttcttatgtcgttttgagtatttacttcgcgaatactgaacctgtttctgtcgtcttggtaagttttggattatgagcttgttttctgtccattagatgcgttgctattttttctgtcgttttgagcgttggacatttttctgttgttttgagtgttggacgtttttctgtttgttcgagtgtttttgtccaattgtttttagtattgttggatacttttgtgtcgttttgaatgttttgcttgttgtttgcaccaggaagctattgtagggaaatgcaatgttgtttgcatttctaaggacgttgggaattcgcaaccgtcagatgaagcaaaggctgattatgtgtactatcgtttcttcgatgttgtgcaattgaaagtagtggatcagatagatgtcaaggctgctgctggaactgaaggtattatgtgatcttattcgtttggaatctgtgctgtaaaatttttaattgttttagttttgaagtagtttttttttttttttttgataaaaaattcaggggatttgtctcacttgacttgacattctcatttgaattatttttattactcttgtggtttaaataattatctaaaaacttggattttatggaagaaaaaattcacaagatttggtatggcattctgccatggtgttttacaatcaaagttaggttattctgccatgatattttgcctgttgagttgttttgcttgtgttttgggtttcccaagtggtgcccctacttccttttgagatttaaatccctacattgtagccaaagtttgttgacatgtagctctaattgccaatttagccacatctcttggtttgaaataagaatgtttagctgtcacatggagagctataattcatgttttcaaaatcgagtttttttgtttaatcagagtgtttcagtttttaatatctcaaaaaattctgttggttaaccataggaaatatgtgtatttctatctagtgctgaattgaattgctgacaatcagatgaaatgtttttcacaacttgttgcagttaaaaatgtttccaacaaatgagatagttaaaagcatgttggtgctgtgaaactcggtccaagacaagatagaagttagtgggaatggcaagtaaagtattgaagtagatatttcaggttaaaaaacagagttagcctgaaattgaaaaggtagccggcaaatatgttgatgtaatttagttattatgttctacctcccgccaaaaatcaaaagttataccttaataaatataagtctagaagtgcttttgaaagtttttctactggaaaaagttctataagtagaaaaactctcaaaaacacttgtagcttgtattcaaacaggtccctaagctattacttctgcggctactataagggtctgtttggacaagcttctctataagcacttttaaaagaaaaaaataagaaggaaaaaatgaaatgagcttcttcaaaagtaaaaataagttgtccattagttaatttttaaaagttcaccaatatagcttctttaaaagatgagatgacatctacaaatgagttaatcgaaaactcattttagcttatgaagaagtttatttatttattttttttattcttcctctagaagtgtttctagagaaatttacatcccaaaatgccctaagtcatttactgttgccgcttagatttaggagtttactttattctgtagacatgtagatgtggtgtgtggaaggaaattaatactaaaatcctttttgatatctcgagtgactaagaaaaacattttacagcactaatgtataatttatccatatcgggagtaagattgtgaattaaataagtggaactaaatattcgaggaggaacaaagaataaaagggcgttaggaaataaaaaggaatgaggtaccttgttattgagaagactcgaacaagttcttttaagtaatgactctcttttttgacattcagatagctttgtagaagttaggtgcatttgtgtcaacacttcttttcttttttcatctatgcacagtataatcttgcttgtgttattatttctgtataagtgcattcgtattaggatactttacttcgatatcggtcttatttggataacttttttaatgaatatttatagaaaaggaaaataagataaattgaataaagtatttttttgcataaattaaaataatgtgtataaattaattttaatttatgaaagaaatttacttttttatgagcattgtttgttttaccaaattttataatatttgttaaaaaaaattattcaggactcttgttttgagttgacaaggcatttgcttgttttgaaaagcttcttttaaattagggcatttgcttcctacaccagtgctttttctcatacatccagcatatacagtgtaataccaattttacccttctcgtaagtcgaaaggcaacgggtgtatgaatccataaagattcatacggattcgcaatccgtaaggttacattacggattcgtaatccgtaagagtaatcttacagattcgtaatccgtaaaagtaagagtacggattcgtaatccgtacgagttaagattttttaaaatggtttttgaaataatggtccaagtagggtgtcaaacccatgacctttggttacgagaatcgtgctctgaccaactgaactactagaccattcatgttaaaaactaattaaaattgctatatataacattacaaattttaatgtatatttaatacacacaaatttacataattaatttttatctaataatatttttgtacatatataaatttttaatgtatatgaacctctgattttataaaattaaaatttttaatatatatgaacctaatatttttttattcaaatctataatttttaactaagtcatgatttttattttaatttattgttttcaaaattcatatattttataattaaaccatgattttatttaataatatattttttatctaataaaatatatttttctaaaattaatttctaaaattagatgaaaaaatatattatcagataaaatcatgatttaattataaatatatgaatttaagaacaataaattaaaataaaaatcatggcttagttaaaaattatagatttgaataaaaaatattaggttcatatatattaaaaattttaattttataaaatcagaggttcatatacattaaaaatttatatatgtaaaaataatattattagataaaaattaattatgtaaatttatgggtattaaatatacattaaaatttataatgttatatatagcaattttaattagtttttaacatgaatggtttagtagctcagttggttacagcacaattcttgtaaccaaatgtctcgggttcgacacttacttggaccattatttcaaaaaccattttaaaaaattttaactcgtatggattacgaatccgtaaggtaaccttacggattataaatctgtatgaacctttatgggttcatacacccattgcctttcggattacaagaagggtaaaatcggtgtatgagaaaaagcgatggtgtaggaagcaaatgccttaaattagtcactcataagaatgaagaggaaaaaaaaaaaaaaaaaaaaacctttcattacaccactcttcaagcgtattgattttcctttatatttcaaactagagtcttcgaatggtcctacaactaacttagaatcccagttatagccgatgttaaatgtttccccggcactactgtcatgaataaatttcaaataaagaatgtaatgtggtgttaacactcatcgtattacatataaattatacttctcttataattttactataaaatagatta

SEQ ID NO: 38 - DNA, 598948 bp, Glycine tomentella
atatgtgcatgtaatttaatagaaagaatgttgaccataatgtgcaactcacgtaaagaattgcaagactttaataggatatgttaaaacatgtcgcagcatgcaatgtataaatataaatagttacaacttgttcacgatgtgtgcctcaagatttttatgagcatgaactcatttaagaatcgatctcccagctcattaaattctgttttctgctttatattgctactttcagcctttacagatatgttcattccatcaaatactgtcatgtcaaatatcatccatagagcgttaaaattctctcttctctttgccacgctttagaatgtccgaaactcttttctatccttgtattccagacaggtgagttcaccattttatcactttgcctttctaagaatcctttttgtccactgatgtagaaagcctatggttgaaattcaccgacataaattgtagaattaattaaaacatgtaattgtcttattcgattaatttttccagttgaaagctaggtcaaaatagtttttgtttttggtctagaaagttggttcaaatagttaatcgatgagttggtaactcagtattgggtgtaatatttttttttatcacatcaatgttaattattaatttctgttataatattaataaaaaatcaaactcaccatcttttttttttgtttcttcaaccgttaaatctccttctcaatcacaagccaaccttataattgcattggatataatgttataacttttctcatcacatgctcccactttcaattaaacaggaggaatattagagaggatgatgattaaatattaaattaactgtaacatttgaaaagttgcatatcttaaaagattggggggattaaaattacagaatttaaaattgatggaacaaaattacaaaaattatagaagaaccagagtacagtttaacttaaattttattacaagtaaaatatttttaaaagtataaatttgtcaatacttaaacatattgtcaacgactctatccttattaaaactcacttacataatgatttggcaatgcatgattaaacgctagtgttaagaaaacaaacatgttcgctgctaatagtatagttcaataattgtttaaacttagaaaataaagattgttttatcaagaattctctctctctctctcaatggcaagaagtggcaataataataatagtaataataataataataataataataactccttaaaaaagaggcactaacaagatccttcaacagaaaaccatcacaaccattaagtgatttatctagcaatcgaaccccaattctcaactaaaatcatgaacaaacttagtaagtcattcttcatcaagaatattaacgaagagaggtacacatgatttatatttaattaaattgtaaaaaaaactttatgtaaaattaaagttttgtttgactttttgtcagccattcaaacactattaaagtttgttcattataatgaaaaattatgatttatttttcattcaaaatatataataataataaatagaaaaaaatagatgcacattcttgaaataacaaaaattttctttaatagtatgaagattgtgtatgtatccacctagaccaatctctattatcaattatttgatgagtggaactctaaagaataaatcatcattctatttttcatgtctaaaattaagttaaattttttctagtttgtgtctagtatagtttatctcaattaaatgcttctatttataatgttaaagagatatggatatgagtctttttcaaataggagagattttattttaaaaaatttcatatctctttatctttatatttgaaaataaaagttatttcatattttgttatcttaagaagttttctggtataagacaatgataactctcaaataatcacatgactatttactacgataaataatcacatgatgtgattctgatatttagcgatagaatctaattcttattttatggataactttcacatttataaaataatactttttgtttatattaattatttttttggtgctaataaagaatacaataatatttcactaaaatatttatttgattaaattatctaatttaattatcaaataaattattttctcttgcaaatattgaaactctcgtttatgtgtgacctcataagttcaataataaatctgtagtaaattaattataattaatttactaaccaaagtagacttctaataatactccttagcatccaaataacatgaagtaactttttttttacctttaagagccaatgaaaaaataatgaaatgtttcctttcatcatttacagctcaagattaattagtatattattactttcaaactctaataagttaacacattatatttaatcaatgaatgtcttaataatacatttatccctaagagttcatgtgtactcgaaaatctaatttacaatcattttgtttaaccttttttttcctattcctttcacccctcttttatttttgcttatttttctcttttgtcttatttctactttttccttcctctctccctttctatttctttgttttattttcgatctatcattgagttcatctatcatcgatcccaattaacttgaattaaaggtagtgttgatgttaaaatgtttaagtgcatgactccaaattgacagtgaagggttgtgaacttcttatgcattcagggattgaaataataccgccataagttataagaggttaaaaccaaacagaacatttcaaactatcctaactaaatttaagcttcagaggctagacattgattgctgatatcgttactcatcagaaaattcaagcctcaggtcttatttcaaacagtatcactatttactcaacttaaccaaggaatctgaatagcatatattttggactaaaatatgaatagcatttatgaacaaatgctttctcatagaccgtgtcagctcaacacaatgtttaacagcacttcaagaacctattgtattggcttactatcctgcagaaatttaattttcctacaagtttccatagcaacctattcagaaactacactactatgaaacagtatgttggtgtgccactagaaataccacatatagttataaaaatggaagctaacagttttagtacaggtttaaacaatgattaacataattaactgaaaacatccatgaatacaataacccaataaaccatcctaaaaatgctgccatggagaaagcagagggaggggatgaagatattgcaaaactagagcaagccatccaccagagagcaattaacaaagcgtcccactttagatttagcatttcttatagtttgagctatcctagcagactcatcttgtgttctagctagtgtctccttgcaagaagtctctttatcgtatattctatcaagtaattgttggaactttgcttccagtgccttcttctctacctcacaacattccaattctttcttggcagattccatagcctttctgttcctatctttttcctctttcagcgtgccagactgtttaagaatatgctttgcctcaagtatctcttctagtctcaggtgaagccactcaatgttcactttcatatttttcatttcatttgcattaacaatcatgttatgcagctcatcgtctctgattttaatcagacccttgtcttccaattctgagaggatgtcacctatcacctctaagaacattgatcggaatgtcattgttgataccatagaattctcaaaatatctccatgcttactgagaattttcttaacatgggtatgaatttcggcttcacttggtatccttcaactgtgtccttcggtgagcttactccaaaaaaattaacctcatcaccatcattagcccacatattaaccatttcagtaatgttgagactgaaatgtgaggatgtatgtccaaccattgaaatagacttgctattgttcttgtctgctctttccctagagttagaggattcttgaataccctcagcatccaaaggtttaagctcaagaggaaccatagggttctcagcctcactccttcccgccatttcagctacatcaactaaccaattctctggagcaacaaaatctccaaccttttcaatctcttcatgtctgatttctggtgccaatgtgcaaggttgaacaacttgtcttggaagggattctggttctgctacagaacattgtggaagttggtaagcctgcacaaatgttgttctagtttcagtaaacttctttgctgatctcaaagaggcacaacgagcatgaactacagtgtaatctggaacttggttatcctgcacagatgttgtactctcaatattcttctttgccaatctcaaggaggagcgggttttagaaatgacaggggaatcttgaatcaaatgttttttcttagaaggagggcagtcccaagactctgactgaacatttaacacaggccaacaatgtgcaaattagaactaaaccattgataagggtaagagagaaaataaaaaaacaggtcactgcacatccttttattatgttactgaaaaattcatctgcattttgagtaccaaaagtacaagtcttattgatccttcatctctccccaacaaaacataaactttttagatgtggagatactaaactaaacatttctgttttagtgcaacaatgagtattcacattgctcaactttcaagatggcagaaaagaataacaaactagtatgatggagaaaaatcaacatagtattcatatttctgtatcctacgagccatgcagctgctaatgaaactagtattcggtcctcaactttaataataacagagaaacagatcaaggaaatgacattaaagtaacttttcacgtgtgatggagcaaaatcaacctccacggttccacccttacaaacagcactcaagtttttcaaaatatttagaaacttgctaccacaatcatgtacttagaaacacagcaaacaatatatcagatagagagagatttttgatttgttaataggttccccaacctcacatgggtgaaaatgagaagtagagattatgattatattccaagttcacgtttctgccattttatttctacaaaaatgcttccattggaccattttcattctttgttgaaaacaatcatcgtagccacaaatatgctgcatcatttggaaacaaagtggataatagaattagcatgtgtctgtgttacatacctggctggattctgccgtataagattgagaagaatccatatcccggcttgcttccccttctttttgttgttgttgttcttcttcctctaggcatatttagtgtcaatgttcttcttactaaacgtcaaagcaagacacttgcacagcacgggtccggaactcaaacccaaagcgcttccttattcaaactctctctctgagaacatattaattcaaacttgtctttaaccaaaaaacgtttatacttagtaccatctttatgaatgtatacacaaaaaggtaaagagtattaagtgtatgtatatatgtatcgttactctaaaagtaagaaagcaatcgttttttattttctcagtttgtactagagttttcttcctttttgtgtgataaaatgtttttcttatgccatgggaataaaatctgtgttgtattgtatcttggaccaccacacactgggttaaatttgaggagattgattgaatttgagttgtcttaattacagttacacttactactcaactaatggtttcctatatataatataattgaaacaataggtgactaatccaaaaaaaggaaacaataagtggcatgccttatttgtgctgcttgagaaattaacatgggcttgagaaggatttgactgggttataacttataattcaccttgtcatttgagtaaatttttagcatcaaagcaggttttaaagcttatgctgacattccatcgctgctatcatagtcttgtttaaaattgttgaaactttatgagcaatttttatgtttgagttatgatataattaatataggttattaattttcactttattctttttttattaacaaaaatgtaaaattatcaattgaaagttataatatagtaatttcaatgtcttaccatatattaattcatgttcttactattttacagcattgttattttctatagaacattaaaataaagtttaatttttttaagaatggcaatatttacaagtatcgttaatgatatttcataaattattatatccattttaaagaaattatttttaataaatttaatacttctaataaaatattaaatttcttttaattagtatttatttcaggatctttaattctagaataataaaaccaaaactatcaatatcaattttatactcactaaaactcaaaattgtgtcatattaatagaagacttattaaatgctctacaaaatatatatttttaaattacataatgttactaatgaattaattacaaatacattaaatttaattatctgatcatttaacttcaaagaaaaagtaatatatatatataagtgtgaacacctatttttgttcatctttaatttatttttaaaaaaataatcattctttcaatttactgtgtttgcttaaacagatcccttttttgtgttaattaaaaaaaattattttgtctatccatttctaaaagaaactaaaataaaatgtttaagaaaaaaggtaagataatagtaataaaacaagagagagatatagaagaatggagcagcatcttaggctggagactattttcagttttaggcaaacgcccttttggcttgtctttgctttattattatttgttttttatccccattttttctcacacattcactgttgtacactcatccactcttcctgctgacatgtcagcaacggcaatacagaacttgtctctgaatacaaacaaaacaaagaccattctaattttaacaaaaaagaggtcaaacaaaatctgaatacaaaaagggtgagaggttggaaatgtgaatgttttacctaatccctgccttttgttttctgtcttattttcaatattgtaatcttgcggatgcccttgatatatgtagcattttattttatgcatgtaataatgtgataactaaagagccacaaagtaatcttagatattcaagcaatgatgcgcttgatagcctaacatatcataaacattcaaattaacgattaacatgccaaatttctaacatgactaacacaacttaaaaacatatcccttattaattgaaacacgattccaaagaaaaatcatcgtaaaatagtacaacgcaaggaaagcacaagcttcagaagccatgagagaaatagttttttttttttttaaaaagggccctttgaaagaaatagtagtgcttgtttaggacttaagtcaacatataatctgaatgaaccaattgatttgggtatggacaccaaggaaacaaccaagttggctctggtaatcacatagaatatgttttatgccctttcatgactagtcctcctcatatacatcatatgaattcaactttatagtggaaaatattaatttcaattaaatctttcaatgctaaaaaactatacttttgaattagaaggtaatgttccagcattagttgtcccattgggtctatggatatggtaaatgagaatgtcaaaaacagattaatcaatcttaattcttaaatttaattagaaagctaagattgagattaaaagagtcagttaaatattgaaaagtactaaagagatttttttatgcacaaatattaattgttattattaacatttttgttaatggaagaaatcatacctactattttttttttcctctcttcattattcttttatgactcaaccaatcttataattctaaaatctaaaagccaatgatactctcataaatattatatactcactctatatcataatcctttaccgatgcattcaatgttgaatgagattctagtaaattaagcaaggggtagggcatataggtgggttcaaacaccttatttatatgctccaatcgtttagattggatctcaatctcatatagcaggcacgaaattacgcaaatggccatgttcatgaagaataaacatgacacagatggtaacagtgaacgggtataagttgtaaaatgtaaatagctacatgtaacatactctgtcgtccgccccatgccattttcttttagtcttttctctatttccctttagatatgtccagtttgagcatgatagagaactgattcaatgcagaaactacccaacaaccaaaaaataggaggtaatctaacagcagatgatgctatactttttaatctcatgcttagattctgaagaccatagtcttctgaaattcttatgctcagagaagtactaacatttgtaatttagccaaaattgaggataattaattttctacttttttgaatttatcttctgcgtgtaaaaaggaaattaataaaaatatttaacattaacttctcccttatctatcatattctgtgcgaattaaaaattaaagatgaccaaaattacaattttaaaaacaataaaaaggcaaatttcatgtcacctactaatttttaacatccaatggaaagaaagtttaaatttaatctctcttcctatcactttcttttccttctcactccatgctcccaacaaattctgagtggttgttggaataaatgatggcacagaagaggaaggtagaagtagaataaatattttgtttctatgattttaacaaagaaagaaataaagttgagtatgaaagacgtcttgaaatatgtttataccaacagtttgacaaagaccaaggtcaaaatttgaaaaatgttaatgttctcctatacaagaaaattcttaatattgatgtattcttggtatcaaaacaccaaaggcatgatcatgatcatgtactgtatatcctattgcttttttgtagaaaaaactagtgaacaacaattgagtaacttctccctcatccccaattaactctaaataagagattatttctggcttctcttctcagttcttagccattcagaggcactgctttctttattaaagtagggttactcttctcagttcttggtggaggtttgctcattcaaccttggatattagttactgaatctgaaatctagtgtacctagagtgtctcaagtttccttatagttttaaagcaagaaagaaaaatgagtttcagaatccgaaataacaaccaacaaactagatttctccgaatttaaaaattttaagtatccccaactggtctcaacatgattttgagtgggaaacccagtggccagaaaaacaaaagattaactatgttttttatacttaatttttttttttttttgagttttcacttttaattcttgaaaaaaaaattgatcagttttaatttctaatgttttcatccatccatagttttagtatttaccattaagtttttttaataagtaataatatgaaactatcataatttctggccgtttaaaactgacaaaaagcctgctaaagtgattaaaccatattaagcaatctctgaagggttcaacgcaacgctcctccaccacgtcgccgtcaaaatcgacaaggagagcatcaaccaagggatacaaaaattgaaactcagatctgaaacccaaaactcagatctgtttttggacctcgaaacccaaaaccattatcagatgagtcgtaggaagctttcgcctctgccatccgccgctgcgactcacggtcaaacggcgccgttttgcaaacccgcccctcccctccgccaaacggcgccgaagatgatggcgttccagaggacgacgtttcagtgtgagggagggatttggagaagcgagtgcccgtagaagtgaagctgattttggacctcaaaacccaaacccaatatcagatttgttgaagagactgatccatagcgagaacaaatcaaaacgaatcgaagaaggagaatcaataattgcggaacacataacaatcttggctgccccgtagcgagaacaaatcgagatgattcacaactttgaatcctcatctcattagatgaacaattaaaaaacatgcagagaaagcaaaaacaaaaaatagaatgagtacgaattagctattaggagttgcccacattcaactattctgcatgtcgtatatcccttcctttcaaatccactaaacatcaaactttaaaagattttatgtaaagtagaaactgttgcttaaattaatgaaaattcaattaaaaaaattattatagcaatttgaaaaatataataccaaaatttcaatcaaatgaataattgtattttgagtctgacgatattggcatctcctgaagcaattaagccgccagaaaatagtttgctacattttaagcctttgttaaatgctgatgtagcactaattttattattattttaattacagtttatgacatttaatttttttggcgatttaatggtaacgacggacaaaaacattaaggaataagactggtcaaatttttatttagggactaaaaagatagttaaaaaaaaaacaacttaaatacaacaataacatgaccgcaggaagtcacctaaatttggctaaaattaaaaaataatataatttaaatatttaattaggaaaagggtgtaaattttctaatatttagcaaaatggtgcagccaaacacacctagggttaggcgtgtttaaacacgcccagaatggggcgtatttcaccagatggtgacacgtgacaggcatgaagaggggcctaggattttcgcggtgtttttgtaaattacgaaagactataacttttaactgggacgtccgattgataagaaaccggcgcccacacgctcgaaattgagaggagaaggccaatgcaagtccccttgcccaaattttttttccaaacgaagcctctaagtgcctcaaaattacgatttaagtttcggagcctcaaaaatttttttgttttctaatattttatctactcaattagtgaattgcaagctattctttgtttatctaattacttgtcttaatttcgagccttctgacataaaatacgtcatcatcggacattgctacgagaaattccgactgttcaaagttatatgcatcgtcaattttgcagtataattttggataatttttgaaattatttttgcgatcacaacagcatgattttttaggatttatggttttgggttttgggtttaggtttatggttgaggatttagggtttatgctttagggtttagtggtttcgtgtttggggttaattaatccaaagccctaaaccactaaaaatatacagcaataaccttgacgtacattgtttcaacttgtgccaagttcatcatcatatacaacaataaccgtaatccaacacaaagctttaaacaccctagacctcaggttgattctatctgtcatcatgacaggcgtttttccatcctataatccaataattgttcctaaacagacaactattcctactttggttattatttgtctgtgtttttgtttcacctgaccctgaactatagtgtcaaacaaagtttccaccaatacaatatgtttggcaaggcaaaacttgaattggaaaactaattactcaatattagtgaagtgtatgtaacactcattaggttattcactgccataaaccctaaaccggcacccataaaccctaattctatacccacaatccatattagtgaagtgtatgtaacactcattaggttattcactgccataaccctaaaccagaatctgtcatccataggtctataacccaagccatatgcactaatgaaaacattagacttagttcgaaagctgtaaaccctaagtcagtaaccgacgacctaaaccctaatcacaacatcagacctaaaccctaaaccgaattccataaacccaacgtatgtaacccaagccctaaaccctcatcacaacatcaaccctaaacctaaaccggaatccatacaccctagctctgtaacccaagacataaatcctaatcagaactaaaacctaaaccctaggtctgttcccagcggcataaatcctaattacaatataaacccctaaccttaactgaaatccatcaaccctaatcaccacatcacacctaaaccataacctggcacacacaaaccctaactctgtaccccaacccataaaccctaatcaccatgtcaaccttaaaccctaaacccgatttacatacaccataatcactacctcagggcctaaactctaatcacaacataagccctaataacaatgtcccacaggcccctttgtccatataaaagctggtgaaaatgaaacaagttgtgattcactaattgagtagataaaatatcagaaaacaaaaatttttttgaggctccgaaacttgaatcgtaattttgaggcacttataggcttcgtttgggaaaaatttttggacgcgtggccgccggtttcgtgtcaatcggacgtcccagtcaaaagttatagccttccgtaatttacgaaaacaccgtgaaaaccctaggcccctgttcatgcctgccacgtgtcactatctggtgaaatacgtcccattctgggcgtgtttggctgcaccattttgctaaatattggaaaacttgcacccttttactaattaaatatttaaattgtattattttttaattttagcccctaaatttacattagaatatattttgacaagctaaatatatccatagaaacatagttaacaaaaaaaaaaaaccttaaatacaacaataacatgcctgaagggagatttacattaaaatatagagtaacactagtactccatgtgttttactcaaattccatactcctccctttctgcatcctacaaaaaactccttaaatgtttaactcacattatacctagactccctcttttctagacattgtttaataatctaacacaaattagacacatactagtcctaaattctgaaactaattgagagaggataatttggattttacaataaaaatgtaaggacaattttgtttgctcacatattttaattaacgttagttaacgacgttaatagagagggtaaaagtaatgtccaaaaagggagggatatcgggtgaaatttgaacaaaatatgagtgtaatttactctaaaatatattttgacaagctaaatatatccatagatgtgagcattcataaaagattactcattaaacaatcccaaaatcactacattgaaaaagtagtaaaggagaagaaatggcaaaactaaatcaagccatccgccaagagagcaattaacaaagcgcctcactttagatttagcatttatgataatttgagatatcctagcagattcatcctgtgctctagtcagtgtcttcttgcaagttgtctctctattacaaattctatcaactaatgattggaacgattggatctttgcttccagtgacttcttttctgcttcacaacattccaatgctttcttgacaaattcaatgatctttttgttcctatcattttcctcttttagcatgctagattgtttaagaatctgtcttgcctcaagtatctcttccagtctctagagaagccactcaacgttcactttcatacttttcatctcgtttgcaaaagcaatcatgtaatgcagctcatcttctgtgattttatggagaaccttgtcttccagttctgaaatgatgtcacatatcacctccaagaaaattgaccagagtgtcgttgttgatgccatagaattcttaaaaacatctccatgcttattgagaatgtttcttaatatggggatgcattctggcttcttcacttggtatccttcaaccttgtccatccatgatctttgtccaacaaaattaacctcatcgttccccatattaataatttcagtaagattgaggctgaaggatggatctccaaccattgaaatggacttgccattgttcttgtctgaactttccccagagttagatgcttcaatatcctcttccaaatgttcctgctcaaaagggataaatagggcttcaaatgcattgtgttcttccatttgaactgtgtgattagccaccgggttctcatcctcactcacttttttcatttgagctacatcaacagaatctccagccttttcagtctcttcttgtctggtttgtggcataaaggcagaaggaagtgcaacttgtcttggaacggattgtagttctaccacagaacattctgaacctgggcctgcacagatgttcctctagtttcaataagcttctttgctgatctcaaagaggcatggcgggtagaaatgacagtggaatctggaatcaaacgcttcttggtataaggagggcacctagactctgactgaacattgaacacaggcaacaatgtgcaaattagaaataaaccaatgataagggaaagaagaaaaaaaaggtcattgcacatcctttattatgttactgaaatttacaagaatcaaaaatacattgcattttgaataccaaacccttaacaaaacataaaatttttagatggtgagactgaattaaatatctccgtatttttgtgcaacaatgagtattcacatcgcctcaactctcaagatgactgtaatgattttccttaacatcaagatgtgcatctttttgccacagtttccataacttaacgggtagtagcagttggcaaggaatagggatgggtcatatagtcaaaattttcttgaatcaataaaataagggaattataggcaatctagaacctactgaagaggttttgatttgttataaacaagtaaacaaccgaaagagttgcatggaagctagtacactagtaaatgaagaaattttccttttacactttccactttatgttttgggaacttttttctctcttcaactttctcaagagtgcaaaaggagtggtttaacgcatcaacattttgattcatgcgaagtgaggaaaaaagaaatgtgcattaacttgggtacaatgttaaaagtaaataatataaacaaaaaactctcatggccaacaaacataatagaatgagaatggagcttatgacacaggctgataaatcaagagaagttgtagggacattaaaaaccataagtgtcacggagctgcgattatgattctgtttccaagttcatgtttttgccatttatttatacaaaaatgcttccataaaatcattttcattttttatgggataaatcatggtactcacacaaatgctgcaagattcatgcataatcacagcatttggaaacaagagggtggatggataacataccttacctggttcttgggtgaatcagagtgagaagaatccataagctgatcctgcttccctgtgtttttcattgttccttcttcttaggacaagcacttgcaatatgtgctagaggctgttgtgttgtgtatgatatgagtatgagtctagaggctgcagtgcagtgcaatgcactgtgtgctaatgtactattgcctgttagaataaatctttttcatgctattttgaccacgatatatgcaccgcaacagcaacacttacattttttcaccaaaaatgtacgtttggtctttacgaacctgtgccaaaattggaaaaaaaaaaaaaaaaaccaccaagtatgcaattgtgtttgattggacttatgtgttaccgatttctattaactttttttttctttcactcactctatatctaattgtcacattatagtttgactaatttaagttgagttgagagaattcgttaaaagtctatgaattaactctagagtttaacaacaatagttgctagtgggacatactgtaatttagcaattgttgtgccactacatgcaatttttgcattctagaaaataatacatgaaaataaactggtaaaaaaaacacaatacatgaaccaattgtaactgcatagcttgaattggtcttcatgtcatctacacttcctgcccactcactgtcaacatagacatttagcttaacaactcctatctttaaatactagatgccaaaatttgttgtaccttcaacatatttcagcaccctttttgctactcccatgagatgatgagaacattgtttggtgaactcatgaacctggaaagtaaaatagttggaaacatcaaggctactcgttgtcaagtacagtaaactacccatcaagcttctacatgcagagggctcttcaagtttctcaccatcattcatagaatttctctcactttgtgctagtaaagttggtacttctttgcatgattctaacttacacttgagattgttaacaaataacaacatattttatttgtgaaataaatataactgagccacattggaatactttcactccaacgaagtaaataatgatgccaaagatcagacatctcatatatatcttccatttccattttgaacttggccagcaaaggtaaattacttcctatcacaagcatgtcatccacataaagtgacactacaagttacaaaccacaatcatttatatcaaatatagacttgtttgattttcactcctgaatccaagttggattaagtaagagtcaattatgctatactaggcccttggtgctcttcaaatcataggaatctttggtagtctgtaaactgtgttcttggccagcaacgtcagcctccaggttgaaagattccaaatttgatagttttacctttaaacactggaattttatagatgaattactagaagtagacatattttcatccatatgcctgaaaataaatttctcaacctcactagtatttgcactcaacctctttgcccccaaacacaaaggaagccagctctttataccagttaaatatcagatttgaaaaaaaccaaaatactggaactagaaaatattaaaattgaagaaagaataaaatatttcataaatgagaatgcttatttacgggctcacaaccaatttgaaactcgctaaaaaatctaaactgctgtgagattttattgggattgcaatagctaactaaaacagaaaaataaagagcagaaggtgtaacaattgcaaagactaaatctatccaagatttatttaaaattcaaaggcaaactctcgcaactgtaagcctcttgaacatatctgaaggtgggttaggaatctacaacaaaacaaacttttacagatttgtaagaaaatttgtctttctcaataatgctatgtttaattgattaactgaaaaatatcattcacaagaaaaggcaagatcccaaatttcctctaatttccatcacatgaaattacaataatgaagctctatacaatgcttaaatcttcacacatgcttattgtaaatattgccagtttatataagatgcttctagtaactgctgggattgcaataatttcatgttttcaactgatacttcaaccattttcaagctataaaggtgtctaaactattaagtcatttgtatttaccttttatagttaaaattaatattactaggaaggatcatggatacattaagagaaccaaagatgaaacctgcaatcacagagaatctaaaaccatatggcattatggacaagaaaaaatgatgtattaactttctgcatctcataatttacaacaatgcctttggccagatagcattccatgtctcaaatcatctcttataaaaactaaccatacagaacctacattgatcaacaagaaagctttcacctcgtaaagtttgatttcttctattttgggatgaagtagtaaaagaaatagtgaagctgctggagtgatgaattgatataacctactctattgaagatgtatcactataggaaatatatgctgcaggaaagctactcttcgtagaaattagaaagcaacatatgttaaaaatagagattcatgagtaactgcctcccttttcacctcagaaaacgcctcataacaaataaagaagaacgccagctcaaagattaaatgcaaaatttgcaaaaattggccagaatagcaactatctattagaacttaatgcatgcaaatttatctgttcaaaggttctaactggacttccattcttgcagagggctgtaaatctttatctgcagttgttctggttggactcaagagatcaactgaatcatcttcctcaagattaccaagcacccaattgcctcttccagatatctgccgccctattcgctgcctttcatggtattccaaataaataacaatcaatgcaccaattaaaaaccaaattgccatagcccatctgagtccatggacattttccacatcatatctgtctcctagatgcttcatcccagtaaaaagtgctgcaatgccaaaaacaatggcacatctaccaacaattgtgtggaaatattcccaaataaccctcttggaggatgcctgctccccatttgctggttttggaggccttaggaaagcatttactggctgtatacaagccaacaatatagtagcaaatccaaatttaacatgtgttgagctgaaataaaatcccctaagctcagccacagcaaaaagaagggcaagtagaacaattactaaccctgagtattgcaagtaaacatgaatccggtaccatccatcgcccttgagatgttttagatacctggctgccaatatccctccaggaagcaggataccccatgcaacaaacatcataaatccatgcacagccaaaacaggaagtaaatcctgctccgcctctgctgaaccacgcatcaggtgtacaaggatagccctattacttgtactagaatgcatattcctgtcagtaagatgatcattggtccatttagcacccattgcccaaacaactttgagtggagttgtgggatcaacgatatttttacattctaccctcttttcccgcctacaagatgggtccaagggacgagtaaactcaaaagtaatgatgccattttcggttttacatctcacatgtgtcaaattttcctgcgtggcatgtacgcttgaagcatcctttccatcaatccaataagtgttaacatgtcccataccagtatcatcaatccaacccacatacacatagctgttcaccattccacttccaaaccctatggcaatataaccactttttctctcgccacgagctgcaatagatatggaatcctttgacaatgtccaaaagaaagtaacctgttgatcatccaaaatgacactgttattatacatgtccgatagacccccatcaaccacctcgaccttccaacccatcttctggtcgaacaaggaatgatagtagacgtgatcaggagtgttcctgtcaggagcccaaactaattctgtaggactggcttgaactccgtgggcctctggacctccagcataaatagtctcagtcagatttctcgtggtagcatttccaccaagcggatccgaagtaatataaagtgcaacatcgtgcccggcttggatcgaaaacttgaccggcacccctctttccactctcaagacaggagcttcctttttgttgatataaagaaccttttcaggatttggagggttggggtaatgcattgccggagcagaagaaaccaccaacggaacatttgcatctgcagtgatgagaccttgatcttctttgtcttcagcatccaagggacctgtacactcattcacatgctccgagacattcaaaaccaaatggccataattcacagccccatgattctgaggaagatagtaaggattaatagaatcaggaggcttgatacgccccaaagcccaaataaccttcatattcgctgaatggttcacaggatgatcatactttccatcgaccttagtcaaatgcctgcggtatctgacaaaggtcaccccatccttcctatggccataaaccaacattgaattgttgactaaacccaccccatcagggccttcataaaaggaatcaggacataccccttgagcaactccatcactatttctcacacactcactatacttagtaatgaaaaaatcatccacaaagggcataccatcttccttaaaccctgcaacgacaacatcagcgccaatcatgagatcagaatcttcagcactggaattagcccacccaaaagccatgtaattggtgatcccagtcgcggcctccaacccaatttcaagagaatcctcggacacgttcaaactccacctcaacctgaaattcttagacaaaaccttgcaattctcgaacaccgtcggaggcggcggcgtcgccgggacgtccttgcggagcacgacgtggccgaaatcggaggcggtggcacgatcccagacggcgaggacgttgatcatgctccaggaaacattgctcaacaaatgcacatccaaggtggagttgttgtaggttccgttcaatccgtcgttggaaacaatgaatccggcggtgaggctatcgaaatcggaagcctgcgcaccccaccagtggacgtcggaaccgggaagcatgtcgaattgggaaaccctaaaggagcaatcgtccctgattttcagggatcctcggagttggtgttgaaccatttcgaactccaactccgaattgacgacggagctgaggcgagtgcaattgggagcgggatccgcatatacgaacaacaacaagaacaacaagtgtaggatgaagatgagggatctgcgaagcatgacgggtgcacttgttgcactgtcacgcaaattctgtggatcagaatccacgatgaccaaaccttcaggatcggatcgtaacaatgttctgtgtgcgtggcggaggggttcagttaaggtagttcacaaggttctgtcagtcttcgggtggagagatgactcaaatctagtcaatggttgttgtattgtatcacactatcagttgatggatcctgacttacacctcaccctggtgagccatctacgtggattcataaatcatgatctatataatctataatttatttatgatttattttacctatttttaacttcatatagttattataaaaaataacaaattaactatacataatttgtgagtagatttacgctgtcatatttcttcatactaataaaaaaaacacattgtcatgtgtaacattttttttctgaaacattttttaattatattattgattattcatcaattttatttaaaattaaatataatatcattcaaatcaatgatttattgatatttataaaacatatttaatgaaatataagacgaataaatatttattatttgatcaatcatatatattatagatgatcaaattaaaacatatataaagaatttttttataaaaaatatacttttttaaacaatcaatgtaatattaaatcttgattatttatgaagatatttatcataaattaccaatataaaaaatataacgacatgtgattttcttaaggaaatgtattctagatatagcacgcgagttgttcttgatggttactgttttataaattatcaacacattaattggatttacggtaaatatattgaaaactagtaaagcctaaattgtctaaatttaaaatagctaataaaacctaaattttggcttacttgctttatgttatgcagaaagtcgacacattggtgaaaccttaagcaaacaagtttaatgtcatgagagaaaacaccaaaacttatcaacaatcttcattcttccatggctagctttcaaaggtggaatttgattctcttaagtccaagccacttccaaaatggtcttaaaaatatgttctaatggagcatgaacttacttacatccaagaaactcccataagttaactcaataatgaacagttcaccaaagtgaaagcaccaaggtaattggtcttcaccatattgcattttaggagactttttttcaagggaaaaaaaaaatcacatgttgttcctaaatctattgacaatttatctaaggatcatgcaaaatatgcatatcactcattgaacatcctacaccacatcggaccgttttttatgaatagccctactcttggaattgaatactagatcattaatttccacgtgaccacatcaatgtttagcatgtagaactttaacccaatgagctatgtcattatttaatactatatagtccactttgatacatagctcttatttagttgcctaagattacaaaccccttgcaaaccattatacttagattgcacatatgctccaaatcaattaatgacattttttaacaacagtggagcgcctaataaagttttttacagaaggattaaattttggaatatggaaatttacatcacataagtgactaaaaaaagaattaagttaggactgtcctccttagcaaagaaagataataagttttatagtcttgcaaatctttttaactttatcaattaggaaggcattgttctccctggtaacctttcagcaaagaaagaaaatgccaaggtacatacctaaattatagcaaagtgaattgtcattctagatcaaataacttcaagtcatatttggagggtatactctgaaattatgattgtaacattgatcggaacaatcacaaaactattctgacacttgattaacacagtcaacttgaaattcaaccgctggaagaaatggaatctttaatagcatgggacaaatgttatacacagtgcaaaattaattggtaaagtgataatcatattatggacatagagataaattgtgaaaaaaaagtagtgttatatagtttgttattatcatcatttgtatatataaaattcttttaattaatttacacagattaatcaattaaaaagttggtttataagttggtagtgttcaaattgtcaaaattttttattatttttctaaaagcatccttaaaattattgagattcttcgtttcacttttttatttaattatttttatgtagttaattaatgtgtcttaagcctttttcccattcatcaccaaaaagataatgaatttatctcattaatctaatacattcattgtttactagaggaagaaagcacttcgtatttctctaaattttttaataataaaaaatacaaaattcaaaagttaaataaagttaataaaaaaaagagtgtcagagaggaaaaaaactgacaatataaaaatagtgggcaactattcttgtttagaagaacatggaagtttaaggataaatttttctactaaaatatgtacaccaaataaaaatattttctttattattagtattgattaaccacagatgaaaaagtacaaaacaactaaaggtgttttaattaaaaaattaatacaagaacaattttgaaagaattcttataaaaatgggaaaagtaaacctttttttttaaaaaaaaaatatttgttttgacgtttgaagactcaaatgtttgttgaatccaattcaactagaaacatacttcttagttaggatgctttgaaagttatgtaatctataccccaaacacacccttagaaaatatgaatatgagtattaaagtcaataaatttatcatacaaatttatcacatagaataaattataattagatgaattcataaaaattcacattatcattacatattagtttttaggggttttatgtccaatctaatataaaataataaggattgattaagtttttaatccataaacttttaaaaatttaaatttagtccctacataaagtttgactagtcaaatcctttaaaataaattctcatcaaaacttttagtttctctcctcaatgttattgttaaatgatgatatgaagatgtacacaactgccatgtattatttttttgattatttaatgtaatttgttttcatgtctcaaatgttgcattcttaaattggataatttttttccaacaaaacaatctgacttaaaccatgtcaaaccaaattgataatttttttattaaaccaaattgatgactactttttaaaaaatgttaattgtcacttttttggtaaccctttatgtgaaaattgaaacttattaaaaattattacctcttattttatatataagaaataattatttaattcaataagatcaataaaataattagatagattaatttatcataaattttaattttattctaagattatctatgatattaaattgtttaagagatgattattttttaagatgaattatcttattttattttgttcaatttgatcttttaatttgtttgagatgaattatgctaatcatgtaaaatattttttttagttcatttttttcttattttccacttaattttttttaaaaaagtttattcttaaataaataatgatgtcctgaaatggatctaagaactaaattaaaaaaagaagaaccaaaataaatttttgaaaagatgaaataaaaactataaataaatcagattgaatttttttaaaaagaaactaggacaaagaacgaaataagtggtcagtatttttttttttttgcctataagttgaaacaagaatacaaaattacaaatacaaattaggaatccaagtaaaaccctgaataaggacaattgtttcagatctattctatgaactgatagtgatacaacaccatttttactcatgaaaacgaggaaaacgttgctcatttctctaccggaatattaacatctaacacaaacaaacgtgtctgtgacctaccttaaatgaaccctccgccacgcacacagaacattgttacgatccgatcctgaaggtttggtcatcgtggattctgatccacagaatttgcgtgacagtgcaacaattgcacccgtcatgcttcgcagatccctcatcttcatcctacacttgttgttcttgttgtcgttcggatatggggatcccgctcccaattgtactcgcctcagctccgtcgtcaattcggagtcggagttcgaaatggttcaacaccaactccgaggatccctgaaaatcagggacgattgctcctttagggtttcccaattcgacatgcttcccggttccgacgtccactggtggggtgcgcaggcttccgatttcgataacctcaccgccggattcattgtttccaacgacggattgaacggaaccttcaacaactcgaccttcgatgtgcatttgttgagcaatgtttcctggagcatgatcaacgtcctcgccgtctgggatcgtgccaccgcctccgatttcggccacgtcgtgctccgcaaggacgtcccggcgacgccgccgcctccgacggtgttcgagaattgcaaggttttgtcgaagaatttcaggttgaggtggagtttgaacgtgtccgaggattctcttgaaattgggttggaggccgcgactgggatcaccaattacatggcttttgggtgggctaattccagtgctgaagattctgatctcatgattggcgctgatgttgtcgttgcagggtttaaggaagatggtatgccctttgtggatgattttttcattactaagtatagtgagtgtgtgagaaatagtgatggagttgctcaaggggtatgtcctgattccttttatgaaggccctgatggggtgggtttagtcaacaattcaatgttggtttatggccataggaaggatggggtgacctttgtcagataccgcaggcatttgactaaggtcgatggaaagtatgatcatcctgtgaaccattcagcgaatatgacggttatttgggctttggggcgtatcaagcctcctgattctattaatccttactatcttcctcagaatcatggggctgtgaattatggccatttggttttgaatgtctcggagcatgtgaatgagtgtacaggtcccttggatgctgaagacaaagaagatcaaggtctcatcactgcagatgcaaatgttccgttggtggtttcttctgctccggcaatgcattaccccaaccctccaaatcctgaaaaggttctttatatcaacaaaaaggaagctcctgtcttgagagtggaaagaggggtgccggtcaagttttcgatccaagccgggcacgatgttgcactttatattacttcggatccgcttggtggaaatgctaccacgagaaatctgactgagactatttatgctggaggtccagaggcccacggagttcaagccagtcctacagaattagtttgggctcctgacaggaacactcctgatcacgtctactatcattccttgttcgaccagaagatgggttggaaggtcgaggtggttgatgggggtctatcggacatgtataataacagtgtcattttggatgatcaacaggttactttcttttggacattgtcaaaggattccatatctattgcagctcgtggcgagagaaaaagtggttatattgccatagggtttggaagtggaatggtgaacagctatgtgtatgtgggttggattgatgatactggtatgggacatgttaacacttattggattgatggaaaggatgcttcaagcatacatgcaacgcaggaaaatttgacacatgttagatgtaaaacagaaaatggcatcattacctttgagtttactcgtcccttggacccatcttgtaggcgggaaaagagggtagaatgtaaaaatatcgttgatcccacaactccactcaaagctgtttgggcaatgggtgctaaatggaccaatgatcatcttactgacaggaatatgcattctagtacaagtaatagggctatccttgtacacctgatgcgtggttcagcagaggcggagcaggatttacttcctgttttggctgtgcatggatttatgatgtttgttgcatggggtatcctgcttcctggagggttattggcagccaggtatctaaaacatctcaagggcgatggatggtaccggatacatgtttacttgcaatactcagggttagtaattgttctacttgcccttctttttgctgtggctgagcttaggggattttatttcagctcaacacatgttaaatttggatttgctactatattgttggcttgtatacagccagtaaatgctttcctaaggcctccaaaaccagcaaatggggagcaggcatcctccaagagggttatttgggaatatttccacacaattgttggtagatgtgccattgtttttggcattgcagcactttttactgggatgaagcatctaggagacagatatgatgtggaaaatgtccatggactcagatgggctatggcaatttggtttttaattggtgcattgattgttatttatttggaataccatgaaaggcagcgaatagggcggcagatatctggaagaggcaattgggtgcttggtaatcttgaggaagatgattcagttgatcttttgaggccaaccagaacaactgcagataaagagttagagccctctgcaagaatggaagtccagttagaacctttaaacagataaattttgcatgcattaagttctaatagacagttaacccatttttggcaaacttcacggttattttgcaagctggcaggcttctttattggttatgaggtgatgttggaggtgaaaagggaggcacttatcaatctctttttttgacttatgttgctttctagtttctctgtagattagttttgctgcagcatataatgcgtatagttatacatcttcaacagaataggttatatagttactgctactctagctgttactctttgtttttttttacttcttcccaaaatagaagaaaatcaaactttacaaggtgaaagcttttctgttgatcaatttaggttctgaatggtttagtttgatagtatcttagatgatttgagacatggtatttaatctgaccaatggcattgttgtaaattatgagatgcagaaaattaatacaacatcatttttattgtcaataatgctctattgttttagattctatgttattgcatgtttcatctttagttctattagtatgtgtttggttagggagttttgagagtgaaattcaatttttaaagggatttaaaatgccaagtattaaaatatattgtttgtatcaaattcaaagattttttttttttaataatggggactttataagggtttatttttaaagtaaaatgagagaatttcaaataacaccaaaactctgagaatttgtaaatttctctgatcatcaacaccctcactcttgtttgcaactattcaacctcgcatgttcttttcttggctataaattcttaccatcacatgctcctgagtcctgatcactctctcttgcccgagcttctctggctttctcttttttcttctcccttggatctcctgtgattgagctcttctcttctctttggaccacgtaaaatttctttctcactattctccaatctttttcttttcttattttctgaaaatatttgaatctattttgttggtgttcatgtattattctaatttctggactctagatctgattatgattttgatgttattatttgtgtgtgtgatattatttgctgtattgcaacatgattagagtaatattaaaatgcatattatcaccttctgtattctggatcttattcgctctgtgtttattgaaatgaaaaagcatattatcatagccaaattttaaatgggttgattccaatctaggtggtacatgccttgccctgtgtaaaactgcattacaatcaataagttcgtcatgtctgtactgtatcattatggtaaacccaatttaactttctacaagtttgtggcagctaccaaacaagatggaagtgtggatgaatgggcagcacggcttatgtgtgtttgtctgtgtccgtgtgtgtgtttgagcagtgagtttaaaattagaaattttctacaaaccagattaatcttattttttattggaatgttcagaaatcataattaatggtagatgcttttcttttcaacattttgtgtgcaaataaagcttttagagcgagaaggaccagttagaacttgcaagccatagcagtaaagcttagtcaatagtcaagactaggcaaaggtgaatattttatttcatcttgttttgttgtctatttgcaccttaggatttgtcaactgctacttttatgaatgacatacttttttcttctattttcctggtccactttattttaaaggaacatgatactgagttcactgctctataatattaaccactgtgctctaaagaaccttgttaactcttccccctaaaaaaaattggtaactcttctccaactcagttcttgatggctatattggcaagagtttactctacatcatatttgtaccattatttccagctcaacagcatgcttagtagtagatttgtgcaaattatgaataaataagaggttcctttcagtacaattctcaaataaagaattgtcaaaatttgtgtatacccatcctagagatcataacagtaaggttcaacatcactttaaaccatttaacaatgaaacatgaaaactctaacaaaatttaaattttaatagtatctatccagatttcaaatttggaaattactaaatcagagtaatattttcaaagacattttcaagtgcaaaattgaaatatgtaatatatgacattagtcctttaatcagatttttctacgtcagatttttctacgcgagacaatggacaagtttataatatgctaatacttaaaaataggtactggattaaattttgaaatttgtaaaataaaatctaaggctttagcctacttccatcaagaattttcaagcatacttatgagtaccaataactataaattcaaacttttggaagcaatgctgaatcactgtcatgaatcatgattccatataaaaacgatcgttacaagcccaagtatattttatttgcaaggatttcataaaattatgttgaggagtaattttttttcctaacataactatgtttttctcattttgtaaggtgtgtatttttcactttcatatcaaatggaattaatttaggataaatatttattttagttttaaaaagatgaaaaaattaaaatttaaatatcgaatgtgtaaaaagtaggataaattcatccttcatctaagtcttttttattaactcaaagttcatgtctacatcctacctccggatccaattatcattgaaaaatggttatatgtgttgtttattaggtaaaactaatttgtgagcaaatagtcaatgaattaatttatcagtttcaaaaattgttatttttttaatttaatttctgaagttaataatttattaccattttaatccttaaaattaattatttaatgatatgttggtatctgaacttaaatgtgtattgtcaatttggtctttaaatatacatttgaatttttaattagttatatatttaaagtggtatttactttccttaatttataatgaattttttttactactgtcaatgaaaaataattttcacaaattaatttattgataatttatacaggatgcaagtgaaattagtggattagtggagagaaaggaagggtctttctgaaattatcaagaagtaataccgaaactcgaaagcgcgacacgacatccaaaacttgcaaatttctgtcaaaataagaaacgaatgttggttagtatgaacgtgaattttgaagggtaaaatcccaaatacaaggaaaaagcttctatagtttcactctcgctgtatggctactctctcgctctctctcaattgttggagtatcgtggaacttgttccacatattattttggttactaacaaagtaaaaaatgtatctaaagataactaaatcttcaagccttatcaatttcactaacttattccttttgctctaaaaataagatttttagtgagataataatctagtgaataaaataaacctagaatctttgtaaatagtattgttattggtcgacgtaagaatccaaaaaatcaatcataatatctgtaatgaatttaaaataagattttatatgtatatatactctaataaaaatcagatttaaacactcgcaatttataacatcctgaataaataaaatatttaaataaacaataacacttcaatatattcaaataaatataataaacacaaattagtaatttccataatcataagattcaattttttggattctagaactagtgcggatttgatattcttcaaaggatctataaactcatatttcatgcaatgatgttttagtgtcttttccatcataaataaaggtattcaaaatctttttcttatcctagatgaagatatctataaataagtatcattcacaaatgaaagcatctaatattatattctcataatagaaaatacgtcattattcattctcataaggtgattataaattcacaaaattataaaaatatcattctagaaaactaacaaataaactctaattttgtgcatccaataatagtagaccccatactaatgtcatgcatgtaggatttttttattgtttttgctcagcgtcatgcatgtaggattgaatatattttaagatcttttctatttttttctttaatagtatatcttattttgaaatcttaaataactttttagtgagtctaacatgaatctcattttttaatatttaaatatttattaaattaaatataatgaattaagtaattaaatttaattaataaaatatggaaggaaaaaatatatgaacactaagaaatgaaataatttaaataatttttatttatgagtaaatgttaaaagaaataaaaaatacataaatttgataatagaaaaagtgtaagagattgttcaaaagaaaaatcaaattttattatttgtggttagtttttttatctccttttagttttttttttctctttatgctgatgccccatttaaaggagagagatttttttttaacactaagtatcttgagggttcttttataagaacttatttttcatgttggagatctatccacctcctttattaggagatctagtgaagaccatatcttgagttcaagatccttctgaagatcttatactaaagatgttctcatatccctatttgctattgaaaacgtggctagattttgctgggtctagcgaggcagccactcagcaggtaactgaatcaaggccatggctctggaaatgtcctttaagattttgtaagcttggtttgccatttaaaacttgaatactatatagtagatcataataagttccgtaaaaaggtagtgcatctgagtagaaatcgttcctacttgagataacttttcttgcaagtctgtgcttttttgtgtttgcgtctgtactctgtatcagtacatggatgctttgctgaactctggaaatattttgctttctgaatcaggtccttagctcacttcagcctttggattatattgttgttgcatttttgcctggtattagtgaggttaaaagaggctactctgcttggcttattttgtctttcttatttatttttcatcatttgactgatatcacatattgtcatcttaaattccaggaactacttttccgaggagcgattcttccacttttgggaatgaactggaatagtattaggattgctgccttgatttttggtgttttacacctagcaatggtcgaaagtattcctttgccatctggtgcatatctttcctatttcccctctctccctctcatttctctctttttccccatttatcgaaaattgttttgctgaatttaattcctacactaaatcacaacttttttccattattgtgttgttagttctgattaaattacaataagattttcgtttgtgttttagggcaacctttgttggtcttgcttatggatatgctacaattttatcctctagtgttgcggttcccatggcttctcatgcagtgaacaacctgattggagggcttttatagcggtacacgtcaaatacaccaaaccagaaattaaatgagtgattgccatcttcatggataagtcaccgcatctctatacatctaaccctccctgccccggatttgatgttgtataaaattgtgatacagaaatcagagttagagaccaatccaagaagtatgtttgcaaatgcagctactaatggcagcactgctctctcctccattgtttaaggaaaaattcaagtttgtatattacaacattatatatagatttctgttgtagttctcttagaaaacattccatgtaatttatttaccataaatcgataactgtactttataaagtggacggggtcacttggcttgcttaccaatttggttttgttagtctcccatttttggaatatggcttcattggcttgggacttaaccttttgaaggaatattcccctaaaaattaaacggaaaataaacagaaaaccaaatcacccgcgttttggacgagtgtggcaagcaggaaggtaagatctcaacaagcttgggttgcgctcctctttctattccttacccctttataaaatgctgcactttcaatactttctctttttccttttttttctttctcatctctttgttgtctgttccttttcccccgaattttgggtaactaccacatatctcacaaagcttcaatcttcatggcttcggtaagaattaagatcctcccaccatgtcatgtaatcatgtgtgttcatttctagccaatgattttaaacaacaacaaaaaaagtcattgattttatcaaaaacaaaatggaaatgaggtttagctatgtaccgaggtttccagcaattctttgttgttaatgatgagcaaaagggtctttttatttttcatcttctatgaataattaatctctgttttgacgtaagcatttatgtttgcatgtggagtatgaacaagatggaaagccactacccaagttcgggaaatgggatgtgaatgatcctgcctcagctgaaggattcactgttatattcaataagctaggccagtgacgagaaaaaaaactggaggaggaggatcagggggcattagatcacagcgaagaaataattcgcgcaaagatgatgataaaccctgctagttacttatcaataatacagagttatgctatttagtacgagaaacaaaagtatagatttctctccattagatgtacatgtgtttcattggtcatttgaaggttaaaaacagaaaatataaacttgtactatttcacagaaatcatgtgaatgtgtttctacgattgtttctttttgcaatgaagttcaatatttaataatattatacatatgattttgggtgcagaaaaagtggttttgctttagaccctagacaaggacaagggtataaggatgtgtttcttgctgcttgggacgtatatcatgattctcttcagtttttcttctgaggtctcatctgtctccagaccacggataagagataaaaagaaaagaaagaaaatagttgcagagccttctcaaaccatcgttgtagcttccagttattaacatgttttcccttctacttgttgtacgcaccggcacaaagtaatatgtaaataggagaatcaataactaactaccttttgcaaaggcattagttaaacagatatgtttttcttgctgttacttcgtgatgttgatgagctcagctaggcaattacttatttttagtttaaaaaaaaacaaaaaattaagtatcatatattataaaaccatcattgcaatttatgaataataaatttaaacattgaaaatcatttccattaaaaaatctccacacgtctatcaataatttcaaaacttaaaatatttaataactaaaacatgattaaaatatacattaattaaggtgttaaaattaaaattaaaattatatatatatatatatatataaatatgtatgtataacaatgttatgtgagagaataaaattgattaatctcaaatatcagtcgttaaattaaaataaaaaattaagattaaaatattttaaattcaaattaaaaatccatttatcttaaaattcttataagatttatcaaataaaaaattaaatattttaaagatttaatttaattaagatcctcaccacaactattatgattaaatgaagttttgatttgaatttaaaatattttaatcttgacattttattttaatctatgattgagattaatcattctcatccgttagattaaaataaaaattcaagattaaaacaatttaaattaaaatctcgtttaatcatacaatctttataagatttattatcatcgtcgttaccaccaacatgatgtcactgccattatcactgtcgctgcttgtgacattaaggctaacaactagtggtggtagtgatgatggcggttgacaattatgatgatagatttaagatattttagaatatcataaatcttacaaaaattttataattagatgagactttaacttaaatttagaatattttaattttaacattttattataatttaaagaataaaaatgatcattctcatttttacataaaagaattattatcatatgatatatgtcctttatatatatataaacttaaaaaattcaccaatcacatgtataaataaatataattaaataaatataatttaccaatcacatgtataaataaatatatggataaaaaatgtaaaaaattcaactactacttatatatgattatagaaggaagtgtataaaaaaaattaaaataatatttaaaaacttttctagacgcaacctcactgaaacacatgcatcccaaatacttaattaaattatttatttatatattccatattatttaattacgacggggacagcttttattattaaaaagagacgatgtttaattgccaagcatggcaaatctaacttgaaccacttttttatacatcattatcagttatgatttcgctacacatgtagcaaataaatggtggtggtggctgaatgtattttggttttttctatttttacttaatttctaacgttctcaatgaaatccttaattaatatatccttatatatactcactaaattaaagatcatttaaaaattaaataaatttatgaatattaaaagcaactaaaaaattggaataactaaaacttgtcgatcatatatatgtagaaagattacaaatatatttaaacaaaaaattaaccaccaaatgattattctacttaggcaatgttaatcccatgccagcataacagttaactaatcctagaatgatgaaagagtaattaatgaccctagtccaatccagaggtgtaagacaaaacaaaatacaaattaaggtaaagcataaaattcaagcaataaagtttgattcatatgaagaatagcgttagctgtcaagcaaacatgcgaaacagaaaaacaaatcagaaacaaaaagaatatgaggttggacttaaatggcgaccattcctggttgttggaattcacgtgactcctcattgctcagttcaagcaaaacggattaggccattcaataattcaatttagaagaagttaattgaatcattaattcacaactgctagttgcttctactttgccaacttcatttgatcgatatagtaacgaacaagattagtagattatataacccctataatccctcccgctacatttgacgagttttgagtaaatctatctggaactgtaatggttaattaaattgatgcttaaaattaagaaaatagtaaaatattctttaaaaatgctgcaaatgtgtaggaagtctactaagagaagccttcaactatacgccaacacgggcaacaccttcaagggaattgcacatgcatgtctaaaaatttatgaaaacaatcttagccgaagaatgaagcaaattcttgttaattaagaatgcagcaagttgtacgtactccaacttaatagaacatgagaactgttttccttctaaatcaagtagtctttttcctccttacataatgtgataggatgaagaaggtcttaaagagactcaaacatttcctcttctcatacaaaaactgtagaattatctaaaataatttgaaatatatgaagaaacatatttaggcttgtctcctagctaaccatttatcagtccaatgtgatttcttatttgtcttgttaaatcatcaaaaaaccacaaggaaattaaaagtgtaatacactaaatttgaactccatcaatgactactatctcaatatcttacatgatatcatgttatgtaatatacaaactcgcattatatatatttattctaagctaaaggttttcattttattgttattgtactcttactaatcacaaaaaaaatatacaatttagacttttgtaaataatatactcaacataaatattgattcctttaacaacaataatcttaataaattaaatatgtattatattatttaattgtctataaaacacacaaaagcaagagtatcgtgttagttaatctaaaaaaatattgattttctgtatctactaattcttcattatttgttcataaaaaattatctaaaatataaaaaacaatcaatctcaacaaacttttttatactaattaataacattattttattaaaatgtataccaacttaagtgttaattaaaatgtgtttccaacatccgaatgcatcactcaattagcttataactaataattttgatctcagtaattcgatttcgatctaaactagaggtatgaacaaattggttcggtaaaaaaaaaattgaaccattttaacaattcagttctcaaattcaaatgtctaaatttttttagagaattggttcaaaacaaattgattttgtcttgaactaattatagaattgaatcagttatcaaacttattttcaaactactttataaaaacacaatttagaagaaaaacaattcactttactaaatttgtttagaaaaaataattcggttcaaatcgaacttattttaaaaattaattcaatttgttttaatgtaacttgcttgacaccaaatcagtttgattcaagctaggtgtaaaatcagtttatctcaaactttttgtttttcttcacaccctagatctaagtgtgtgtttgaattgatcttgataaaattgattttatatataaaattaatattaattaaaattaattttaaaatgatttagtttatgtttaaatgttttataataaaatcaaattaaaaataaaatattcagtataaaattttatatccaacacatattcctcaaagttagttcaactaggaatcaattataaattattttttaaagtaaaaccaaatatatatatatatatatatatttaaaatcaattataaactccaaattaaaacattcactaaaagatagagctacctcgatcatgaatttattgcaccagcacatcgacctttttcacttccgaagtggattccattccataactcttgacaggtaaaggtgatggtagcatagcagcaatttggtatgctcgggaaatgtttatgtggtttgttaggtgtaggaatgcttatttgtttcacattcattaattgcatccccaacctccgtgcatatgactgttatgtattcacctgtcacaatatttaacgcaacccatttctgccaaactaggaaaacccgcaaaaaactataggcaagaaaaagagacgacaatgccacgtatagttattacatgcagcagtgttgttgatgagtactacctcacagtactcataatctcatgcctcggtttgatcgtcaccctcaactgcctcatctccttcttcgcttggatcttcccaacctgtttccgatccgagaagaatctcgtccgaagctacggttcctgggctctggtcaccggagccaccgacggcatcggaaaagccttcgcagaccagctagcgcagagaggactcaaccttatcctcgtgagtagaagcttccagaagcttgggacagttgccggtgaaataaaagaaaaatacccagacacgcgcgtgaagattgttgagatggacttcgccggcggcgacatgtcggagggtctccggcgcgtggaggaggcgagcgagggtttggatgttggcgttttgatcaacaacgtggggatcacgtacccgagggcgatgttctttcatgaggtggaggagaaggtttggaggaacattgttagagtgaacatcgaaggaaccacgagagtaacgaaaattgttttacgtgggatgttacagaggagaaagggtgcgattgttaacattggatcgggtgcttctgtggtcgtgccttctcatcctctctttacaatctatgctgctacaaaggcgtaagctttcttaattttctttctatctaaaacccttccattttctttctttcttttatctttctaactgaaaaaaatgcttttacaaagtaagtaattaactgaaaacatgattattagcattgttcataagaatgacgtttttttcaggacaaaggtttatcagtttcctaaaaatattggctaaagaacctagttagtaagaatctttttttattatgaaaataagaacgatgaagaagcattaacttgcttcgtgttggctaattaaagtgagctgaatcaatatcccaccactaaaggacaaagctctcaaagtaaacaaggtgtaataatggtaacatcaacaaaaatgatatgtttttacatcgatcctttgtacatatatccatcttgaaaaggatttagatggagaaaaaaagaaaaaatgaataaaattatataaatactatcataagttatgtgatagtgaaatgagagataaaaaatataaaaaaataaatacaaaaagttataacctaatttttctttatcttgttatgatatttttacacttcaaattttatattaatttaaaattttcttctcttcttatttttcttctaaattcttaagtatattcatgcttcaacgagtacttacaaaaatttcagacatattctttagtactttcgtggttattatcactgatatgcgggtgactgtcgaaagttaatgagactgaactctcctttaagagagacagcaattctcacatcgtcactcaactatattttaatgagggcaatgttattcttaaatatattttttttcaaaaaaattcttttaatttaaaaagttacaaaataaaatgattgatgtaataaaaattaaaaaataattataaaaatattgtaagcataatattatattgttttggcatgatagtaatctgacattctgtattattttatatataaaaaattctaagagcttttcttttgtgaataaaaagttctaagagcttttatatatagagagagatgtgaataaacacagctaatattttttttaagaaaatgaaaatgacactattaaaaataatataatttgtaatgttatgtagatctaattaaaactcaacaaacttatttatcatacacatgataatttttttatcaaatgatagtgaagagaaatctttacagtattatttattctaaattaaaaatgttaatttttataataattgttttataagtcaaaatttaaatttaagataatttttaatcgagtaacaatataaatatacagaatatcagaatcaaaccaatattataaacataaaatcataagtcaaataaaataatatgcatatatagtgtctttattaattaacaccccaggcgagtactgaaaactaaagtgaattggacgatggaaagatgcagttacgtggatcagttatcaagatctctgtacgtggagtatggacaatacgggatacatgtgcaatgtcaggtacttacaaatgtctactttaatttgttagactgtttttgttttttctttgttcttataacgaactgacattttataattaaggctacagactaaaggtaatgtgcaacacatattatcaagccttggatcagctagagaaaactattgtaaacttatctagatgtctaaagcagctacattataaactcgcaggaacagtgttttaacattcatagtatttttatttcatgtttaaagtcttagaaaagaatatcaactattggaaatgagtgatcaagtacagtttgcatgtgcttattagttaattaataatatgcatgacttctgtattctgatcaatgtatgattaactctcagttttttgggtaaactttagtattcatgattaatatttaatactgatcatgaatgaaggtaccattatacgttgcaaccaatatatataatatcaagggatgagtccagtattgtgatgtaattcgtatgatgaattcatcattttctttttttgggtaaactactccatattatgattaaatatttaattctgatcacgaatgaaggtacccctgtacgttgcaacgaatatggtatcaagggtggcatgtattgagagagattctttgttcgtgccaacagctgaggcttatgcaagagctgcaattggtgaaattgggtgcaaaccaaggtgcacaccttattgggctcactcaattcagtggtgttttgcaaacttaatcccagagacactacttgatacttggcgcttgtccatcggtatccgccgcaggaatcaaaagggagactgaatattaactaaggactatcatttctcactttaattttatttgtatgaattgttattataatatgttttaattttattttcaataattatatatagatatgtgatgtcatatactaatcaactgtttaatttttttttcttttactgtaaaacatggcttcgcttgtccctatggatcatgcacttaaatataaattcatgataaataaatatttttaacatacaaattatattttataatattataatacaagattatttttaattattatcagttaaaaaattattgaaattcagtttagaaataaagataaaaatgataatggaaagagataagtagttaaaaaattaagtggttcaaataaaaataaaaggtaagtggtttgagatagttgagtagacatggcaacgggccggggcgggtgcgggtattgtattccccgtccccgcccccgcctttaaaacccgcctccgcccctgcctctatctcccgttgggttttaaaattcagactcatctccgtccccgttgggtcgggttttccccgccccgcctccgtcccacccctactattaattaaaaaaataatgtggcttttcttttgaaaaaaatggaaaaaagttgactaggtaacaaaaaaattaataacaaatccacattcaaaatatgagatcataatttaaaaattattaaagaaaatcagtcaatttaattaaaaccattatggacctacatatttaatttctcccaaaatataatatcatttaaatatatattgttccaaaattaaaataaaacacaacaaagagtagaggtccattgcagcaacaaagcttccaaaatggaattaattcagaaagttgttggtcaaggttcaacgccgtcgagaatgagaaatgaggggcagggttaggatttcgggattttattcttatatataaggctaaatttgtaatttaattatggcgggggcgggggcgaggcagatatcatcaataccaaacccgcctccgtccccgaatttttgtcgcgggacaggagctgggcgggtatcaacaataacaaattcgagtttttcccgttaaaattgggtgggttttgacgggtacccacggactcgggtctcgttgccatgcctatagttgagaaataaattcttggagtaattattaaatcaaattaaattaagaaatatattttaaaggaataaagaattaaaaaaacattcaatatataagattaagataagacatgagactcaatcaaaataaatgttcacagataactcgtagaagcacttctatttaagaataacttctaacaatgttttacgacggccttctccttatatgatatataagtgatctataaaaatccattattttaaaaaaatactattatataacatagcttaaaatacacatgctggagaattcagcaaaaaaaaaattacatgctggagttcttgtacaatgctatcaatataacgtattaattctatgctatcatatatccatcgtcccctaagcaaaatacacggtgcaataagcgattttgatcatcacccaccgtaacgatcaccacctctcaaatctcaatcattgagcaacactttaccgagaaaaaaagttcaaaataccccaaaagaaagaaagaaagagagaagaagaaaaacatcttaggagtcgtacgtaggaggagctagtaaccgggtcggattctgaggtcgttggtggtgttgacaccacgaatacgggtgggaagaaagaccagcaggggaattgaggatcaaaataaccggatattcattcaactgtttatcaagtaactgcatccatgatcaactaattcatcattgctttaatacatccccttgaaaacgggatttgtacggcaaatgcttgctccatactcctcatattctgcctttgtatgacaagcctgtacattggaacaaaaattgtaaaacttctctcgttttccattgagacttatcggaaggatttaagaaacattaagaaattatgcatactttcactaggagaacattatagcaagacaacacatcgcaacccacaacgatggcaaaccaaaagaaaaagaaaaaaactctgatgtcatatttttacattgttcaagtttcatatttcaacttaacaaacaataccagatattttgttaacatgtatgcaatcgtagattcgtttaacctggcaaagcatacaaaattcaggttatcaatgtcaaacaaagaggcatagacaaccaactacaaacgtgacattgacatgtaatccatccaccattgctttctcatggacaagaaataatctaaagatttattgtcaacaaataaaggtgcatctaaaagaggcatcgacaaccaattacaaatgtgacattgacatgcaatccatccatcactgctttctcaattctcatgcacaagaaataatctaagatttattgtcaacaaataaaagtacatctcaaacctataaatccaaacataaaaaaaactacgtacctcattgcctaaagatatgcgaagataagagggaaggataccattcaacaaattgtctcagaccaatgtgctcaagatcaaaagagagttttttttttttttttcagggtatggtacttataacttataagtcatagcaaggaagaatgttaatcattgaacaggtacccccaacccccacccctttccaattacatggaagaacacactattagtacacaaaattagtgattataggatgcacgcattgaacctcataaccccccaaaaaatgctggaaatgcataccgtaaaaaattcaggtgttgatgcaagtactgatcctccaaaccaaactacaaatctctggattggatggctgagtacatttacctccactggctgtgactgtaggctccaaattaatgaagtaaaaaaagttaatgcaagaccaaagcaataaatatatatagcagtacagcctgccataactatatcaaggggacaattttgttcatgcatgtgttggaccaaaagttaagccgatgttaataggaaacttgaattgtgaagaaacactttgaagtctaaagaattcacgttaagtcaaagcaagaccgagtatatgaaatgtgagttttcattggtaaaagataatgatcaagacttcatgcatctatttggtcaagaggtacccaagaaaaatgtttttagatacttgggatcaaatttgtaaaaaggtggagagaatgatgagaatgtaaatcatagaattagagcagggtggatgaaatgacgaagtgcatctgggttgttgtatgaccacaaaattctccttaagctaaaagaaaaattctatagaacaactataagacctgtaatgttatatagagctgaatgttggtcaatacatagacaacatgagcataaaataggagtagcagaaatgaggatgttaaggtggatatgtgattatacaaagatggataagataagaaatgaagatatttgacaaaaggtagcagtagtaccaatgagtgaaaagatgagagaacatagattgaggtgatttaggcacgtaatgagacggcccttgaatgctctaatgagaattaaagtttgttaccaagagtttgacacaaagagaggtagaggtagaccgaaacttacctagggaaaggtagttaaactagacttaatagagtgggatatagattggcggacgatgtgtcttagaacataatagagaaaagttataaacttggtggagggttagacccgttattatctctatgttccagatggttctattttagttatttttctcttcatctcccccttcttctttccctcttctttgcttttaccctttttttttcaacctcctcgtatctatcattgggttcatctatcactgatcccaattaacttgggttaaagatgttgttgatgttgatgtattgagccataaattacataaccaaaccaatcaacaaccagcataacactgttttcaacgtaaaataattatgtgacaaaataatttatgtaattatttaatacaacataatgatgtattgatttttgattggtttaatccatacaacttgtgcaaacagatttacataagaatttctcatccatgtgtgtaagcgagggagagaatgataagtttaaagatggtttaaaggtgcctattaacttacttttatctccccatttaagcgtgcttcagacgaaaggacacgagcatccactatttttttaagatcacgttgcaacctcctgtgaaaatccttgaacatggttgtacctccagacaacacgatattctgaaataaaaaatacaaaataggcaagagataaagagatcaatcattaagaacaagtaaactaaagggcttgaaattcatatgataaaaaataaaatatcgtggctggactgatggactaatataacacttgacactaatgtactccatctgggccaacaagaaaaaacgcctcaagcttaacattgaaccttggaagatccctaattttatgattggaagtgatggttcactcaaatttaaaagcactcctggggattattaatatatacatgtcagtaaagtacttcaccttgtataatgatctccttgtgtcaattggcgcagactgaatgcatttgtctattacaactggcaaaggggtagtaaagtcactgctatatatctcaggattaaagaaagtctgcagaaatcattgggaaaacatacagatatgttaaattggctggtcctattgatataatgaccccaactgaacctatagattagctcaggaattacaccaaggcactactacagtttcatgaattattcaatagttaaaaaactcaagtggattccataatagagaaaatctaaacagtggccatagaacaaacctcagggccaagaaatcgttcataaccaatatcacatgaatatggtgcccccgtctttggtttaatacctctccaatgcttgatgtacttgcctggttctttgtcatgcttattaaattcctgagagaaattgagctaatgttatgtaggaaaactaaaaagtttaaaagatcacttgagttacatcccttgattcacaaaaagagaaaattaaagtatttattgacattagacatgcaaatggcagaggcaacaaaactattggcagaggcgcaccacaaactcctcaaataattctgtcaaagaactgagtattgaaataaagacaaccttcacaatgtcagagcaagtgtagcaatacatttccttcactttccgtgccacttcaaaagagtcttctggtggtacattttctcctctttcctgcacgaagcaatgtcaacacaacagtttgtcaatctagcttagcaaaatgcagtttgacaattggatgtggattattacaatctcagacagttcaacaaaaaaatatatagctaaatacacgaataagtttcataatcaatcatgaaataagtaaacttcacttttttatttattaactattaaaaatgtaacaaaaataccatcataagtgcatcacaccctattcatccagattagcatttacacattggtttcactagctagtgtaaatggtaatttatgatatctttcaacattaaaaagaggtttacaaaaattcacagatattcaaatatgggaacaatacaggcacaataaccttttaattttataccagaaggattacccacccgcataagctgttgaacaaaaagagtaacatcctttccagcaatgggaatcgatttgatgctactcccaataacatagccatctgcaataggtacaacatgagtagccccatctccaacatccactacaactcctgtcatttcacactaagaagaattccagatcatcctaaaaggaaaatattcttaaaataagacagatataacaagaaacaaaatatctccatagctcttatggtattgttattgtaataccccaatagaagcacaccagaatgagaaggattcaaaggttgggtaggtatgagactatacaattgaggatgacttgaaggaattaattggtactatcttaccaacaagatgcatctacttttcggtagtccatcatataggaacttcacaattaagtatgcttgacttggagcaattatgaaatagatgaccttctggaaaatttctcggaaaacgtgtgagaacaaaacacattgaaaagcctcatgttagtttgaggtgttacagttatcaaagtcaagtataattatgcagagtcagcttaacattttatatttaacataatgagaggagctgaagaattgtcctatgcactagtaataatgcaaaaccacctcaacagttcattcatattctacagtacggcttacttttggtttcaagtgaaagtatccaaaagtatcgaattgcaggggctgatgaaacatccagtgcattttgtgtttagatagctaccaaacttgttgctgctgagaccatactaaatatgcacagcattcaagattaatcatccaaatccaattctatattcaacataattgccaatctttttcgggtctaacgattaccaaccttggatgttgtgtatccagctgcaagagcaagcacagaattcacaccaatgtaaagtccaggcacattaaaagtctcaaacatgatctccccagtatactcgcgactctcaggcggagtcaatggactctcgttcaagaggaaatagtgatcctccggatcgcacctcaaataattgaaaatgcactgctgccagaagcgctccatggcatcccaattctcaacctggccatgccgaattgggtagctgagattgtaagtgctactagatcgagacttggtaagtgcttcatccccaatgaagaaatcaagatccgccataactccagcattgtgctgggccacccaattgcctttagaagagcccctcgattgattcagaaacgactcattaactgcaacaactgtcggagcaataaaacaaggctcaacgttaccagcaaaccccatcttcgtatacctgcaaagaaaacatcattttccaaattcagagtaaacccaattcaggtcaatcaacattaaagataattctagttataaaactaacaccagtggggcattcaacaaacacatggtgtccacaccacataagaaaaaaaataccacataaagctaaaagagaaagtgggtgatagaaatggatgaaaagggtacccggagccattatcgatgactacagctggacgagaagtggatgggtccatgagaaaaagcgaattagtagtggtagtgatggtgaacgctgaaggtggatctgcgactgagatccgagagcgagcgtgaggcagaggttcatggcagtaaagagcgctgtgagaagcgcaagaaggaggaggaggaagaggaagaagaaagtggtgtaggtgagagtaaagatgatggtgacgcagactttgatccaaagtgaaagaagatagtaaaagacaaatgggaatggttggtgattgttgttgctaaagccatttgaacacagcgagtggaagtggaagtgcaggtcccatttagtcgatcatcattctgttcgtttctcagagatgctttccttggcaaccaaacaacgactcttctcttctcttctctctctttcttttatttatatttaattaattataactatagtactaatgacggcaactacaattgtcgttgttggcgtgttggtatggtacgaagaaatgggggatgctttatcagactaagccgtttgatttcaagcaccggttgcagagacgcacacaacacagatatttaacttgtttcatttctttcttacacgccaacctttttctttcttgctgcctgccctagaccctagtacgatgaattcatgaacctctgttgaaaaaaactgtcggtagtttttaatttaaataagtataaattatatatatatatatattaaaagaaaatatttaaattataagagaagtaatagttcattcaaataaataatatatgcaaatttagatatagaattgtgttaaataattaaaaggataattttatagtttataatgattatattttgatttgaataaaattgttttttattagatatatataataaataaatgaggaaactctataaataagaccttaaacattattatatgcattctagagagaagatttatagatttttgtgagatcttttattattattgggattcatttaattatttcatagttattaaatgtgtataatatttggcacgacattataatgaagacgttggtttcccaagttatttgttcgtttccagtttaaatttcaagcctcaagtcatcggttcgaaactagcaacatccaaaatattttaatacaaattatatttaagaatattttgcgtgtaaatatagccaaaattttgctctataactttaggtggtcttcaagtggtaaacacctcttttctcaaacttgccatagtaagttttacaattattttggatatattggttataaatgaatatgttttgagatagtcttttgaacatcaacaacacctttaatctaagttaattagagttggtggtagatgaatttaaagatagatcgaaaatgaaacaaaaagagaaaaagagaggagaaaaaaaaatagaaataagaaaagaactaacacaaggaaataattgaaatatataattaataatggatttaatcatctaccaaacttacaatttttctccatttcgtcctaaaatataccgtctgtcaatctatatcttactccattaggtcttgtttaactaccttttctcatataagtttagttttacctttatttatctgtatgtcgagctcttgataacaaatttttgttcttactgaagcattcattgagcatctcataacgtgtccaaattatctcaattttgatatagtttgttaattgtattttttattttaaatttttaattagagaattattttgaatttatgtgggaagagatgagggtttttcttaaattaggaattaatattattttaagattttgagtttattagtcactaaattttttttcggatttctgtttttaatccctaatttaaacttcgcatcaactaattgtaattgcatcctctaaagtgttgatttaatcccatgttaatcagtgatatggttttaaatagagcctataaaacttgcatagtcctaatttgaagggtcatttttttaagttgaattaggtctttaaacccaatctgcatttgttacactctagacaagtagtctttgagaaaaagtgttagaatgtcaccttaattgcactcatttctaatccaccttagttgtgacctcttcattaactaccttaattaaaacagtggtttagttccacacagctagaaatatagtttaaagagattgaacttataaaacttggtcgatcttcgtcataaaagttgattttatgaggctgaattaacttctaaattgaaattctaagaattttattcatacttcataatttattatgttcgttctgtatataaattatgatttttgaaaccgaacaaaacaaaactgagtaaaaatggaaaacaagtgaggattagagtttaaaaaaaaaaaaaaacatttctctttctctttcccgttgcaaagcccagcaggtgcaaggcaacaattaatcaacctttcaaaactgcatggagcttatttgtagattcaacaacagaaagaaagtacaaacttgaactcaatcaatcagatctaaaaatcgcaaaagggaaggtacccacaacagttgcaacaaaaaagaaaccactggcttgcttgggaatggaaaataataaaaagaaagcggatatagcattagatacaagttgcatgaaaactattagtatgatgataattgatatcccacagcatttaagccccttcccaattttaaacttcacaaagatcaaatcactgtgatctcatcctgttgagctggttgagagcaggctgcaagatgttgtaaagcacccaagcaatagccggcgtaaccacaaacagaagaagctgtcccctgttgtcgctcgcagcagcagcagcttcagaagccgccgccgatgcatgcggcgcagccaccaacccagccaagccgccaagccccaagccaatgatcacgcctttggtgctgcgcatgcggttcagctggttcagcgccggctgcagaatgttgaacagaacccaccctattgctgggattatgggcagcaacagtgccagtcctcggttgtcgccttctgctatgtcggctatttgttgaacagcgaaagcggcgtcgcaggttccgagggttgtgaataatgcccctgccattgctgtcgcagtggaaagtttagtgctttcgggtgaggctatgaggccctttggaaggttgatctgaagggagggttttgatggtgcgagcttcgtcggattggggaactttaggttgacgcatttggcgttgatcatggccatcgctgatattgttgatgccattggtgagaacagagaagaaggtagtgagtgatggcagtggcagagatggggaacgtggctctgattgtgggaatagcaatttagcgtttggaaaaagccacgttggagaaacgaggtccaatgggattgtggtttctagattcttctcttatgcgaattgggggatatatcagatttcgacctcatatttcttgcgtttcttatcatcacttgcgctgctcaaatgccaatattttcttgtttttgttcgtgacctgtttgtcccaaacacgcgttttacagtgatgcaacgacacgtcgtttataggaaaaatgaaaatgtttgttgtacttttaagatgaaagcatctacaatgagaatgtttttttttttttcgtgttccttagagtatacatatattaagaggaaaggttatactgtaaattcataaattatcaatgcacatcaaactcagggtatccttcacagatttaatatgtgttatcaattaaattgaattcattgagttgacaaatctttatttaattatcaatattaactaggttgcagcgataaaaaaaaaaaaaaaaacaagtacagataaaaacaaaaagataaagagtttaagagagaagtaaaaaaaaaaattataatactggccaaccaacacgtgacatataagttttaatatatattgagataacttttacttatactaaaaaggatctcttctctcgcctgtaaatttgttctcttccctcctcttttaattttcctgtgtttacaattaaaaagggttttaaatagactttttttgtagcctatattatgcgatgagacgaataagaggagagtgttaaattttattcagcaaacaatttgggatgactaaatgtaacaaaaggaaattgcaactgatgtacttggaatgaggtggtgcccaagtacacgattttaagtacctttcatatgaatcagagtattgttgagaaaatgaaaaattcaatggctaaatatttagtttagttccaaaaaatgggaggttcacattttagtttcttaaaaaaaattatcaaataaccctaccattgagtttagtgtgttaatgttaatgtttttatttatgtgacatattttgttcacatgtaaatgataagtgacagataatagttggtaggtgtcaattgtcatattttaaaaaattgactttttaatttagtctctaaatttaaatatttattatcatttttgtctttaaacttaattagttattgatattttttagtttctgaacttaattactaactctcatttaagtccttaaattttttttcaaattttgatttaactttcatatgaaattatttgcatatatatcaccatatcttctcactttcattctttatccttatggttttcaccttcctcttatgagattcagcaaattatattataactatgaaacttatttatgagcaattacataggaatagttaacagttaaattcaagataccattaacaagattctagaagatttaaaactcaatcttctacccaaaccaagcttctaaaacttatatgccattaaatgtgcagaatgttagaataatcatttttttcgaagcaaaaagaataagttaaataattaatctattttatgaaataacactaatcatgaaaaaaataattaaaaaacttaagaatcatagaagaaagaaaaatgaatgtgttataagtatttcctattttttttcattctttgtgatttttacatcattgttcaagggtctctgatattaggggtgtgtgaacccatgaccctctagtggcatgcaaagcagtgatgatttccattgttttatgacatttgaaaagttgtggaggaaacttttttagcatgagggaggtgtaagttgaaggaaggggtgacacaagatccatgtgattgttagcgaggataatttctaatctttggtagacctcttagtagtagtcgaacctagaaaaaattatgatcatctatcaaagaagaaaaaaggagtaactctgcatcaatggaatctcatcatctatatataatgaattggtgtggtatatgcaaatcacaacatatgaattgtaaaaactagtattttaatcaagactagaactcaaggatgataaccgttaatgttattatcatttaaaataagaattagtttcaatttttatgtgtaaaaatagtagaaaaataaaaaaaaatattacttattaaaagttaaatatttaaaaattacaaatgaaggaaaaataaaaggattaagcaaagcagaaaatgcaaacaacgaaagttgttagtttgattaactactactgcaagttatatatagacacaaaataatttgaatgtaatagttatttgagagtgttaaagaagatatttgaaaaaaaataattgaataaaatgtaattttttaaagaagctagtcaatgtttttttaaatgtttcaattgaataaatatcaagcttgtcatgcagttgatggaggtgaaagtcaatatgaagtgcgaaaaaaaagttgaaaaatatgagtgataataaatgaaagtagggatatggtgatgattaagttaataacttatatgtaacataatatttaattgaaaattcaaaagtacttttaaagaacaaaataaaaataagtgattaaattaagagaccaaaatgttagtaagtagttaagttcatgaaccaaaataaaagtaattaagttcataaattaaattaaatagtcaattgtctaacttgtgatagtcatgtaaaagttatgagatattgtacctaagtgtcatccatacgtgcataaaacttgtcacacaaacaaaaatgttaatagtagtgaactaaacttaatgatgtgaataatttgatgcattttttttaattttagaaactaaaatatcaaaaatctcattcttttaggaattaaaattaatttatattcaatgaatcatacttattatgctagattttaaaaccatggactgcacaagttcatataaataattattttatatttttattcatcattataaaaataaatgtacataaataaaatttaattcgtaatactatattaaatataatcatatcaaaattaagaaaaccgattgattatatttttaattgaacatatgttgcatactcaaaaataaatttatggtcttgtaaaatgattaattatatttgtaaaatagagaatatttattttaattaattatatttaatacatgaaaatattaaatatatacccaaaatgggcatgcacaaattagttctaatattttaaggactaatttgtgtagacatatacattgaaaataagtatattatttaaaataattattggaacatttttatttaaatcaccaaatataaagaaaatatgaacatcaaatttattacaatttttttccaaatgtgttcatataattatgctaataaagaaaactaaatttttttaacttatttaaaattaatttaaaaaatattgatgaatcgtcgttatttgaaagaatttcaaataataccgaataaagttatcattgtgcaggatttatttgtagatattaagcaaaaaaaagtttttttaatattaatatcagagtttggagacgatactaagttttttgagtgtgtgattggaaaaaggtaattttaaattaaaaaataattaataaacagacatcatatggcatgttgttaacgggaataaattaacgaattaataagaaagtaaaatttaaaaaatatttttaaaaatagaatattaatttttaaatgaatactgcattattttttattttattagtttttctatttctatttaataatatttaaatatgataattataaaatagtaatatcttaaaaaatgtataatttcgataaaattaatttttcaaattcatattttaacacacctacttatgtcttatataaatttacaatttaatatatatatatatatatatatatatatatatataacacgaaaggttgaattgtataatagtaaatgtaatgaccggtatgtatccggctcattaacatttatttatggtcttaagcgcaacaattaattattattaatcaatttggaagcgataaacaaagtgacgtcatcacaataacatttttatattatgtatcaaaataatggcggtaaaaaataaggtatcatataccctatcctctttacatacatcgatctctcagatatacaaaaaacacactaactatgcatcctcccctcaggggtacaaaatacaagcataaccaacagaaaagagtcatcatgttctcaaaatatatgcctaaggttcccacagaaccataccagagctcgggcctcttgccctgagatccaccatctactcgctgagcatcacctgtaaaacataatccccacacacggggtgagatgcaaatctcagtaaaatcaggatttttggaggtttttcctccccctagttcacttccatgacacatagtattaaaattgacatatcacacaacaagccatcacgactctcatgaagcatatcacatgtatatcacaacacaggtgtaacaatatatatacaaatatataacattgcctaagaaagattattcactgaacgacacattctctcaggaacttttcgcatcattatctgagaaagatcatctacttaagggcacattctctcaggactctgcacacattgcctgaggaagatcatccactgaaggacacattccctcaggacttcataccaatgcctgagaaagatcatccactgaaggacacattctctcatgacttacttggacatgtatgacacttccaagggaagatcatccacttaaggacacatttctaaaggaagtccataagtaatctattctactggtcagagaatctcatcaatcacataacataccatcacagtgtacatcatatacatgttctcaataaaagcagtaacacacaatttcaatacacatgcatcatgacatacaataaccatcactccctcggagtatggtggaacacagtcaataggaaacactcccaagaagaaagaacttacctgctctcagcgctatatcggctctcttggcttcatgatcacaaccaccagtagtatccgtatcacgccctacatgaaggcatacaaacaatcaataacggttctcaaccattagaatgaaaagaaacattattcttttccatttaaacctcttagtcctctaccttaaggttatcagaactaaccacctaaaagtcaactcacataccctcagcaggatctatctcggcctaaccaagtcactagagtctcccaaagactctgcatcaaccaattcagagaattcaacactatacaggccaaaacccaaggattaacaatatggctaaaacggttacttcaacacaactttaccgtttatatagccccttgagcacatattgtacaaacatcagggctcatgcatgtcatacaatcaccaatttaactaacattcttcctacacatacatttctcagagcaaaattctaaagtccataaaatcaatattttaaagttaaatcttcattacaacaacctcctaagcatacttttataaagaactcaagcttaattgcaactctaactccaatgagatactattcacctcaagaacaaattcttaaataattggtagaatttgtgtttcctacctctaaatcgacaaggaaggctagtggacaacttctccactagagaaaatgatatctctgtttgatggtttttaggaaaaagtgatgaaggattctagctcataggatgatttcctacaagtttcatgttgggtgtgaagtgttttggtcaatggttgagtggtctggagcttctcaagctctttaatggaggaaaacgtagtggggaggaagaagataggtttttggtccccaaaaacgcgtgaaatgaccttatatagtggtctagatcgtgccctagcgctgatcgtgctactctggcgctattcacaccaagttccagagaaaaacatgctttctggagtacttctgacggtaaccgtgccaacttccaatatatcttactctaatcacgtcactctggtactaatggtgccagattttttttttttaaaccttagttattataataaattaaaaaaaacaagaattaaatatgtttgtataagataagataaaattatgtgtattctatttcctgttatatgataaaatatgtataagataagatgataatagaatcataagataagataaaatatgtattcaatttttcaaattacaatgatcaatttaaaattacaaacttccattaaatcaattttcaaattcatatttcaacaaacctacttatgtcttatataaatttcaaatttaatatatatatatatatataacgaaaagttaaattgtataacagtaaataaaaaaataagaattaaatatatttgtataagataagataaaattttatgtattttatttactgttataagataaaatatgtataagataagataataatagaattataagataagttaagataaaatatatattcaaattttcaaattacaatgatcaatttaaaattacaaacttcgattaaatcaatttctcaaattcatattttaatacacctatttatgtctcatataaatttaaaatttaatatatatatatatatatatatatatatatatatataaccaaaagttgaattgtataacagtaaatagaaaataagaattaaatatgtgtataagataagataaattatatgtattctatttactgttatatgataaaatatgtaagataagataataattaaattataatataaattaagatataatatgtattcaaattttcaaattacaatgatcaatttaaaatttagaggaaaaaatatatttaatttgagcaattaaaaatatatttaaaataaaaattcaaataataatgtacaatgtggtaggattttcataataataattcgaaccaagtcataataactcccttatttgcaggtggtttggagagggtggttgatgtgttgccaacctaattaaaatttttgcaaccatcttatactcttcctccatgtgtttattgatttaaaaaaaaatcataacagcaaatttgagtttttcagttttcaaattgttttattgttggtttgatcgatttcgatttatttggatctgtttgatagtttaaaagaatttagtttaattgtaagtaatgctatttatcaaagacatacttattaaacttaaaattaaaactaacatttcgaattattttgaatacctgaatacatatcttatctaatatataattataaataatctcttgtcaaatatgaaagagaagagatatcatcctatttgaaaaaaaattattcattcaaccacacactcccaaaagctatataaaactctcaccgctacgtcatttcattatatgcacactttcattaaaataataacttggcaaactctctccaggtaaatactcagtttgaggaatggtggtttgatccctctcatatgtaatcacggcttccacgtgcctgcctatgttttgaggagatcgcaacgaatgccattcaaccaaaactcttttatcatgtcttattttccccttatcctgattcttttttcttttttcaatttttttgctttaccattttttatagttgcgtatccatccaacgtgatctgggaaagtcgaaaaaaggatttttggtttctgtatgaaagagggtattttgtaatttgattcattttgattgggatgatcaacctttggtggtggcgatttcttcaactttgatcaggaaattctttcctttttttgtgtgtgtgattgtagaatatcccatcatctgggaataatgtacttttaagttttcttctttggattccttcaccttatttccatcctcaattttcttcatatggttcacccttaatcaataaaatgtctgctttagattttttttagtttggtatttatgaaaagtaaaatctttttgcgatgatcctcagtttcatcactaaatatttgcctttgtctttgatttataatgccattgtaaatggatacagaaaatcatgtaattaacctgtgtttaaaaaaaaacaaaaaactatgtcacatattcttgaggtactaacttgtagagtttcagatgctttagttggagaaacagaaattaatttattaatgcagtaatccgtttgcacatattttcataattaccagaagtgctagatcctctcttctgctctgtgtgggcactgtataagattcgcagtgccaatggatgccactaccggtgaaaccccaactatccaatatcataacatccctgatcagccagctactaccattgttgccacccaattgccaacatttcaacggcagcaacgccattgcttcggggattctagtccaggagagtttcccttgtctgcgaacccctccattgtccttcatgtccttacaacatgtaacttgtatcctcaagaccttgctaaacttgaggcaagtgctgtgcttgtatccatttcagctcttaagttgttaattgaaacttgtactaattctaatactgctggtttcatttctgatgtggtgttttgcaggcaacatgctcctttttcaagcagccggcaaactttgttcctgatttcaacttgtccttgtcagagcttgctgcattggacatgtgccagaagaaagccatttttaatccaatgacaacagaacaacggcaacatttgaagcaaagatgtggcggttcttggaaattggttctgaggtttttgcttgctggagaagcatgtggtagaagggagaaatcacaagtaatagcaggccccggtcatagcattgctgtgacatcaaaaggggttgcttattcatttgggtccaatagttcaggacaacttgggcatggcactactgaagatgtatggcaacctcggccaatcaggttggaactttagttaatacattatcatactaatttaagtggaaagtgaactagttgaatttaagttaacataactcaattacgctgcagagctttgcaaggaatccgaattatacaagccactgctgcgactgggaggacaatgttgattagtgattctgggcaggtttatgcctttggaaaacaatcttttggtgaagctgagtatggaaatcaagtatctaaaatagttacaactccacagttagttgaatctatgaaaaatatatttgttgtgcaagctgcaattggaaactatttcacagccgtattgtcaagagaaggaagggtatatacattttcttggggtggtgatggcaaactctgtcaccaaactgatccagatgatttggaaccccatcctttattaggagctctggaacacataccagtagtgcaaatagctgctggattctgttacctgctttgtttggcttgtcaaccaagtggaatgtgagctacaacttaatcttcttatctcaactttttcaattctttttccacaataattgaattgggatgatgcaaattaggcacttttacatacttcatttttttgtatgcatattaatgtttgtagagtgaaaagagaacttttttgtattatgatttattccttgattggcatcatatatatcttccattctgttttcttcaattacctacatgtatttgcatcataagtccacggcttcaagatttatgaaagtttttaagcattgctgattttttattcttaaataaactagtatttacattcgatttcatttttgttgtaataactatctatacgtttattgattacgtgatccttctctgaaatcttaataggtcagtgtactcagttgggtgtggtatgggtgggaagctcggacatggcacaaaaacggatgagaagtatcctcgtttgattgaacaattccagttgttaaaccttcagcccatggtgattgctgctggttcttggcatgcagctgtggtggggcaggatggccgtgtttgcacatggggttggggccgttatggctgcttgggtcatggaaataaagaatgtgaatcagtacctaaggtggtggaagagctgaaaaatgtcaaagcagttcatgttgctacaggagattacactacttttgtagtgtctgatagcggtgatgtgtattcatttggctgtggagaaactggcagacttggccatgaccctgaaaatcctgagcaggtctacttgcttatgcctctccttgtttgatttgtgaattgcttgtttggtttggttcaaaggacacgtccttccgctgattttttaacaattatgatatgatgaactggttattgattactactttacaataattggaactttcagaggagttccaaactgaaccagtttcagaatgaagcttctagttgaagcatagtgaaccatagatgacatttcttgtaaatgccttagagacagggcacaagtagcacaaacctaattttatattggtgactctagtgcattcattctattaaggttaatctttccatgtcaattattagttagatacttttggagacaaaattgttcattcagaaaatcctaataaaaatgaagttaatcaacaatatcatgtatgtacttgtgcaggaagccatgcatacaatgtgtgtgttaactccaaagctagtcacttcgatgaaacagaactatgaacgggtggtacaggttagtacgaccaattccatatggaatgctcatacacttgccctaactgaatcagggaagctatatgcctttggggctggggacaaaggacaactaggtgtagagattgatgctgcctaccacactggaagaggaaagccaaagcgggttgatattgatctttgttaactatgtgccggtgtatgccaattatttacaccatgtcatcctttaatttatgcttaccatgcatagcatttagtgttttaatcctttgttgattatgtaaatagaaccaaagaatgcatcgataaggtccaagcttggcaacatataacaagagcttcactatttgtgcggttgttgatatcaacgtagacttcaaatagatcatcatagttgaaaatggtgaaggttcatatgcagtttagttgtcttgacttttgaatttggttatcctaggatcatttgcttagataaatttggtgaattttacagaattgtcattcactcgatatcaccacggctcgatttagtaaacttttattaaagtcgaagaggagcacttttcctttatttaaaaacaatggagatgtttaaaattgtgcatattaaaagaagaaaaaattacgagtcacattatgaagttgtgaaaaaataggtaattgagcatgattaagaaaagagattagaattgcgaagaatttatttgattttatactaggaactagaaaggtttatgatagaagtcgcttatattttatgggggctgatgaaaatgtattaaagcaaagaaagatttgcatataatttttattgatttgaaatatattattaagtgtctaaggaagtattgtgaaagattttaagaaaggtgttattgtgaggtatatatatctaagctacacaagacatgtatatatgatagggttattattaatgtgagaacttttagaggcaagactaaggacttttctagaaggataaaattacattagacctcacaaccttgagtctttttgcttgtttaatttagttttggaagtacaacgcgtataaaagattatgacttattgcataatttttgtagattatctagttttgattgaagaatcaagggagaaagttaatggtcaacttgaactttggagactgctaaggattttcataggagtaattaatgctgcttatgtatttatgaattatgtaagattgaaaaaaatacttcttgcatattaatctgtaaataacttgttatgaattatggaataatttgtgaaatagattatatgtttattagttcatatggtgtgtttttaaaaaatttaaatatatatatatatatatatatgaaggattaaattaattatatcgtgtaattttaataattattacacaatttttataatttgatataaaatgtgatttttattgaataaattattgaattatatctacatattatcaagattatttctattaaattttgtcataattgaacaactaaaagatgatctattttaaaatatttatgttaagtcgattttagtttatatgaacgcaaatgatttttaattaatatgaaattttgtatgaaatttatgtaaaataaattttgaatccaataatgagttttaagattatattatgaagttgaaagttataaaatgatataataatttttaaagttatatgtgatttaatccctcatatatatatatatatataaaatgattttaacctaaaataaaattaataataacatttttatgatgtcctttaccaactaataacctttttagtaaagcaaagcactgttttctccttttattaaaatgaagttaatttatgcaaaaatttaaatattaaaatgaaacttaatttttttaaaactattaataacttttcaaaataaaataaaaaatttattaaagtttctgtaaaaatttcattgtaaaaaaatatggcagatcaacagagtactttatttcctacaaaggattcttttatgaattacatatatctttgatttcataagaaacaattacattgaagtcaaatagaatcgtatattttcaaaagaatactattaaaaaaagtagaatcattatgaataataattttttaggatttaacttagaaattattaattaaattagaataactttacaaatttatccacacactttcgtatgaatgaaggaaaaattctgttatttaatacatggagggaagtaaaattaaattttgtagtaattaatccttttcctcgtgtgtgtcaatcaggaaaaaaaagaaggttaaaattgttaaatacaagtaatatatccctatataaattttgttattagtttattattttatttctcttctttattataaattagaattcttacttttacataaaaatacttcctgattaaaccacgtgacctttccaacatggaatattttatttgaattctaataagtcatatatataaaagataatatatttttggataaattgaaaaattattataatcttaattcaaacttaattttttaatttaacatattatatctataaatattttttgattcaaatcattcatttctataatattattttcatcttaaaaagaatttaatcagaatgaacaaataatataactattttttcagagttatttaattataaattattttatatagtaaggatgtttgactttttatattttattcatttacaaggtaaaaagtcttttcattttcatgttgaaagtgtattgaaattaaattctttttaaaatcttatctctttaattaattaatcctcgtcgtctaacaacaaaataaaaatattgattatttttatttgtagaattgacttaaaattcaaaagatatttatacaccccagaaaaaaaaacatgctaatttatgaacggccagcaaggatcgatgtcccctataatattctttgccattgttgcaacttgcaatgtcacttgaaagggaataaagatttatttggcacaccataaatatagaacaaccttaacaaacaaacaaatccaacaacgttgttgtgttgtttccctcttccatgcagagatcgatcatcacattcccatatatagtatatatattccttaccttaaatagcaaaaaaccgtaaccaacggcttccctcacacattaatagcaaacgtaccctataatatatgaaccctctccttacgacctttccgcaaccacaatatattccttgcattgcagagtttctctaatatttccccttccttagagaaaatctgcaaaacaaatcaacaaattaattaattatttttcttaaaatatggcacgtgcacgccgttttgtggttcttgccgtggtgatgttcgccatcattggcttggcctgtgctaagaatccagcaccagcaccagaggcctctgccgatgactatgaggacgatgattactccatcggagccctatccagtgaagcggcttctgctcccaacagcgtcgtggctgcacccattggtgggcccgtgcctcccggtgctttcgacaatgctaagggtggttctccttccagcgccgctgcctcttcctccctcggtcacctctccgccgtcgccggagctgcctctgctgctcttgccggcttcttctacttctgagttctcatcatcgccgctccgaaggttgcatgcaatcatgcaaagatagtgcatgcaaatatataagtgtatttaagtatattgtaattcaatatacagaagagttaatattaaaatgttatttcaccgaggtggcaagcacgcaagatgtgagattatttcaacttataaattgaaacttttcaatttaaatattaactattcaattacattaaatatttgaaaagaattttttcagtcatacacgggcttatctagcttgaaaaggatcaactaaaagtctaaaatatatgtgatgtaaaaaaatatattaaaatgttatcgaaagatttataattatttcttgtgataaagaagacccgggaaataacctagattagttatgccaacctatcactgtatacttgatttgttatatatcacttatcagttattaattattgaagttcacctgtaatgaatgtttaaactttattataaagcttcataggcaagataaacaaaattgtctaaaattgagatagtttagggtttagagttattttatgaattataataacacgtgattattttatgactttcaataagatttagggtttagagttatttctcaattattaaaatgttatccaaaggtttagttaatttttcaaatgcatctcagattattaacaaaaagggcatctctattttttctcaaaataaaagaatatgtataaatataatgttataaaatgaaaattttattgcgttgtaaagagacattgaggctccctgacagatttctagaaaatattatcatgaagtatttgatttaactgattttgataaataatttagtggtcttttgaggaaaacaaattcaaaatgattattttttttataatattctcatcgatgagaaagaactatacgaacaacttcaaacttctttttattttagatatcattgtacacacatgaattaaatattccaaggagaagaacacaccttacatatcaagacatttgaggtcaatttctattaaaatcatagattcgtatgaaaaagttagatgaatttttaaaaaaatgcatgataattttgattaatttgttttaatcatctattattattataaatacctattaattaagatatttattcgatactgacaaggaattattattgctgtaaaaaaaagaattattatttgaattgaaatgggaatcatttttaccggcaacaaaaagggtaaaagaatagcaaattcaaatggctaggccttcagccactttcaccaacgggtcaatgtgctaccagaaagaaaaatagctattattatattataaatgttgggagaatgatttcaaattccaatgtggcaaaagaattatttctggctttgataataagtaaacaaaatacaattatacattatgtaaccaaaaatgcaaaaatatatgaatcacgatttagcgtaaacgtaaatctaacctgcactgctgcttattacaattcaatcaaaatgaatttaacttactgcctagaaaagtacttcatggtattatcagtcccatcaatgaacgacaaaaaatgcagaacttcatcaaactctaagctgaacctcaaaagtagcaattcagctcaaccagctttgtcaaagatcaaattctatcaaaccattaagtaccgtctggatctgctggcaactgtattaaccttgtgaaactgacggccaagtgatggaataaaaacaaacgcatattttcacttaatacacatattttacactcacttctgccaccctgaatataggtgggaagaaagcccaggaagtgaattgaggataacgataaccagctgtttcattcaacagtcttaccaaataactgcatcgataatcaactaatatgttgttgatttaatacattcccttgaaaacaggatttgtccggcaaatgcttgctccatactcctcatattctgcctttgtatgacaagcctgcacgttggaccagaaattgtaaaacttgcatcgagatttattggaaggattaaaagaagcattcagaaattatcgacactcccaaggagaatgacattatcacaagaaaacacattgcagtccacagggatgaaaaaataaaaaaactcggtcatattttgcactggtcaagttctatatttctaaacttggcaaacaataccatttattcaatcataccgtaaaaaattcaggtgttgacgcaagcactgatcctccaaaccaaactgcaaatctctggattggattgctgagtacatttacctccactggctgcgactgtaggttccaaacataaaaaagtaaataccaggccaaagcaataaatatatagcagtctgaccttccaaaatacaattaacaaccaacacatcgctaatttcaatggaaaataattacatgacaaggatttatgtaattatttaatacaacataatgatgtattggttgttgattggtttagtccatacaactagtgcaagcaaggtttatataaattataaagaatttagtatctgtctgtgtgtgagaggaagagaatcatctatgtaaatatgatctaaaggtatctattaactcttacttttatctccccattcaaacgtgcttcagataaaaggacacgagcatccactattttttttagatcacgttgcaacctcctgtgaaaatccttgaacatggttgaacctccagacaacactacattctgaagtaaaaaagacaaaataggaaagaggtgaagaattcaatcattaagaacatgtaaactaaaggacttgaaatttatatgatcagaaattaaatatcatggctgggattgtggacttataaatataacatttgacactattgtattccatctggccaacaacaaaaaatgccccaagcttaacattgagcctaagaaaatcactaattttatattaaaaattggttaactaaaatttaaaagcactcttggagcttatttatatacacatcaataagtaaaggtacttcaccttgtataatgacctccttgtgtcaattggcgcagactgaatgcacttgtctattacaactggcaaaggggtggtaaagtcactgccatatatctcgggattaaagaaaatctgcagaaatcatagggaaagcatacagatatattaatatgactgatcctgttaatataatgacccaaactgaacccatggattagctccacaattagaccaaggcactactgtattttcattaattcttcagtagtttagggaacaagctcaagtggaaccaatagctatacatagataagcgctatgaagactcttagagatggagactacttgatcagttcatcccagattcaaaccccaaccagtctacaatgcttgtacttaagcctcccttgccccttcccacgctagttcttcggcctcttttatttttttaccacttttctgtataaccccctctgttaagctggatattaatgataggaaatcaggatctaatcgagtatatatttaattaattcattagttcatgagataggttcaggtactcacaaaggaaaaatcatactaaaaataggtataaaacaagtagccatagaacaatctggaggccccctaagagagattcagctatccataatagagaaaatataaagagcagccatagaacaaacctcagggccaagaaatcgttcatagccaatatcacaggaatacggtgcccccgtctttggtttaatgcctctccagtgcttgatatacttggctggctctttgtcatgcttattaaattcctgagagaaaatgagtcattgttatgtaggaaaactaacaagttcaaaagataactttatttacatcccttgattcaaaaaaaagaaaagcaaattaaagtagtgagaatttattgacactcgacatgctaatggcagaggcaacaaaactattggcagagaaattcgacaaactcctcaaatgattctgtcaaagaattaaagtattgaactaaagaccaccttcacaatgtcagagcaggtgtagcaatacatttccttcactttccgtgccacttcaaaagagtcttctggtggtacattctctcctctttcctgcacaaagcgatgtcaacacaagacagttcatgaatctgactttagcaaaatgcagattgacaattggatatggattattacaatctcagtcagttcaacaaaaatttatagccgaagacacaaataagtttcatactcaatcatgaaattaaataagtaaatttcacttctatttattaactacaaaaaatgtaacaataatactatcattttttttttgatcggcacaataatactatcataagtgcatcacacactgttcatccatgattagcatttatacatgattgatttcactagctatgtaaatggtagtttgtgagatccttcaacattaacaagaagaggtttacagaaattttacagatattcaaatatgagaacaataacagcacaataaacttttaaatttataccacaaggatttcctacccgcataagctgctgcacaaaaagagtaatatcctttccagaaataggaatcgacttgatgctactaccaataacatagccgtctgcaacgggtacaacatgagcagccccatctccaacatccactacaactcctgtcatctcgcactacgaagaatttcagatcagccataaatgaaaatattcttaaaataaaaatagatataataagaaacaaatatcttgatagctcctatggtactgttatcaagttcaagtaaaattatgcataaccaacttcatattctagattttatattcaacataatcgggggagctgataaattatcatatgcgcatgtaataatgcaaaacaaccacaactgttcatattctacagtattgttcactcttggtttcaagtgaaatcatccaaatgtgtcaaattgcaggggctgatgaaacatcctgtgcattttgtgtttagataactaccaaatgtgttgctgctgagatcgtattaaatatgtaaagcactcaagataatcatccaaatccaattctatattcaacataattcccaaaatcaaatttcgagtgtagctgtgtaccaattaccaaccttagatgttgtgtaaccagctgcaagagcaagcacagaattcacaccaatgtaaagtccaggtacgttaaaagtctcaaacatgatttccccagtatactcgcgactctcaggcgaagtcaatggactctccgtcaagagaaaatagtgatcctctggatcacacctcaaatagttgaatatgcactgctgccagaagcgctccatggcatcccaattctcaacctggccatgctgaattgggtagctgagattataagtgctgctagatcgagatttggagagtgcctcatccccaatgaagaaatcaagatctgccattacgccagcattgtgctgggcaacccaattgcctttagaggagtttctcgattgattaagaaaagactcgttaattgcaaccactgtcggaacattaaaacatggctcaacattaccagcaaaccccattttagtatacctgcaaaaaaaaaaaaaaaaaatcatttccaaattcaggaattcgggtcaatgaatattacagacaattctagtcctaaaactaagaaaaccgcattggagcatttcaacaaacacatggtgtccacatattgacagaaaaaatagcataatgcatagaagggagattgggtgatagaaatggaggaaaatggtacccagagccattatcgatgactacagctggacgagaagtagagggatccatgagaaagattgaaaaggtggtgaacgttgaaggtggatctgcgactgagatccgagagtgagcgtgaagcagaggatcatggtcgtgaaaagcggaacaaggaagaaggtgtaagtgatggtgacagaggctttgctcccaagtgaaagaaggaaatagacaaattgaaatggttggtgattgctacatccatctcaactgaaaggtgcaggtcccattaactcgatcatcattctgttcgtttccaaaacatgctttaaacaactactttccttctctctctcctagactctcttgttttcttttcagctagatgatattttggtataatcacaatttagttctttcaaaaaaaaaaaaatcaattattaaatgtgtataaattatgataattacataatgtgtaatgataaattaatatttaatatttaattagttttaaaatatatattttattattaaattaatacttacatattataataatataataaaataatctcataaatttaataatagaatataattatcttattatttacggattcataatttttattttttaaaaaactaaattatgactgatttatcatttatatattcagcaataaaaatgatgaatcagtatttcttttctgttttttttatttttatcattttaaattttaattcattaatttttgggttgcctctgaaatccaacaataatatggatgcattgcacggcatgacggcaaattcatttttcgttgggaccaacaaatggggttacttgatcgatttgaaggacttgttgcgggggcccacctaaaacaaatattctaagtgctttgtaacttttttttgtttcctggtactttgacacgaacctccatcaagaaaaaaaaaaaaaaccgtcggtagtttttaatttaaataaactttcaaaaatataaattaaaagaaaatatcttaatcttaaaatttttattcctgttatcgaaaataaaagttttattcctgtcctatattataaatttaaatatttgctttaaaaaatgagactactgttcttttttttttcctgtcatttaattcacttttatattttcttttatcattatatagtagtgaatgttttagttttttaataaataatatatccattgacaattttcttcattatcatctaaagacaaatcattctattcactattaaaataattatcttaaaagttatattaaaaattatttctaatttatttacatttttaaaagaattacactaaaaattatttaacgtacataaaattttattgcaagatttaataacttttgtttatttttctatcatcatcatctttattattattattattattaaagtaaattacactctattccctttgttttgtcaaaatttcactcgaaagtcctcctttttttgcaacttataaaatcccccttaatttttttagctcacattccattcagaccctccgtcctaaacaccatttaataatttaacagaaattagacacatattggtcatataacttttaataaaattttatgtctaaaatactctcatattcttcctcttaacctcaaaatattttaagacttttgcttctttttgttttctctgtaattgacaacattgcatatatcacttggttcgtctggttggttcgtaaagtgaatcgaaatatccacattgcctaattcaggacctatgtatttagttcatccattgtgttccgttgatctcaaacatcagcactattttaatcaacaataagaaacaaatgtttttccgttcattcattgtatttcataacatcaacactattttaattaacaataataaacaaatgattttaaaaatcataagtggtctcaaattggtctcccattgaaactccattcagaaataggtaataataaacactttaagtacctagcaattattctcctgatcgattactacaatttaagactttaagtacctagcaagggaagcaataataattacaaccagagtattttatatgccctaagtgtgatatagacctagtgcagcgaacaagtgtcagggtatcacactatcaccaccacaataaaatatttcacttgtgcagcgaaagagtatacaagtgtttagagtatcacactgtcaataggtaattgcaatatacaatgaaacaaacaagtgttggagtatcacactatcactaccacaataaaatatttcacttgtgcagcgaaagagtaaacattctcagcactaaaatacacatgcaatatagacatcagacatccattatattccacctttgcactaggtagttgccatacactagacaacgagagaagagtatcgcctctatcactgatcgctagtaaagggaaagagagaaatattctatggcaaaatgctaatagaacctgtccatagaaatcaacctatcgtcttatttttacttgtaccacagaaactaggaatatccataacaaatacatgattccatccaataggtaaaatctacataaaaaaaattacttactgcatacgtgatttaaatgtagttaccttatcataacattaaccatcgacagaaaagcagacgactcaattagctcatgactacatataccacagagaggaagttggtgtctctattctagaagttcttatgtacgagtaacaattcagtccaattaaattatagcctgtagcgtacataacaatacaggtgttggattgaatttcaaatattatttaacaaaacctgaatttggaaagtactacttcagtgttttttttgtaatagatagaatgcaaacaattatgccacacagttcacacataaatactcaaattatatataaaaattaaaaaaactcaaaattaaacacatattcatcattagtccgtagcctaaacacacaatcatcataaatgtaatgcataactaataactaagcagtagcaagagtcatcaacttttactatgcacacttccgtaaaaagtactaggaatgacagaatagcctgcaaagtgtgtaaacagaggcaggccagaacagagaagagaatgcaaacggaagtgctgaccttggccagaaaatagaagggtcgaagattgatgaagatgagcaactgggtttagtcaaaagtcaacataaaactaacagggttttgaagaagagaatgtgaatcataaaagtaaccctaaaagtggattatggatccgaagagaaggtggaacaatcatatttttgccacttattggtacagctgtgctgtctactgcaattcagccactatccacccaaagctaggagttccctgaagtgtctggcagccacaatgcgcagccatagcacaatagtggcaccccagtattcactattctgtttaaaatcttctatcatagactgcaaaagctaacaagaacatctacttgtattccaagcacttgcctatgattgcaataaagtcaacaccttagcaagagttaaacatgtaaaacatcattttgatacttgcttattccagttggtattgccacttcttcataattcctcaatggctcaatttaacctcaaaaatcctgtaggacaagtatgagaaagaggttgatgaaagactgcggacaatggtttgatactgattctccactcttcaatttacttttaaacaggccaatttgtccagttatacttgtatatctgaataaaccacaaacaatgagggaattgtagagcaagtaagactatattcattattcaggagaagcaacagcagcaaatgagttatgcaccacagtcagatcaactaactagagattttagagacttttactccagtcacttcaacacatgatccgatggttgaattccaaatctcacactttcaatgaaaaataaaaggttcaagtatgactgcaacaattcatcaaaacgcttaaaatctggttcataaatcataacctgagtgaagtgttccaacaattactgacacatagcagtttatgaaacaagtgcatgtgtagaggaacacaatagaaatccacgcaattaaatatgaagtgctcgggagtaccagaatttattcgagcacaagaccattgcattggaaaaataaaagcaaggaaaattacaaagcaaaaggcagcaaaattacaacattcgaattcaagaaagagaatccttctgactggcctgctgctgcaataattcttctctaacccttctgatctccgcttccttctccaacctctctttctgagacagattaccatacagaaagagggtaaaaaaaagtacaaaacaaatagcattcgtacttagagatacaggcatacagcacagatagatcaaataacacgaaccattgctgaaaggttcaaaataatgtatctacgaaatggaatcctaaaatagagttaaattgagttaggtaggaaattataataatcatatgttagaagatatctcgggtttttttcattggaggagagtgaaattgagagaaaggaatgaaccttttcgtcttgacggagagcgatccagacatggagcttgtccatggactgccagaacacgaaggctcccagcgtcatcgcgaagtacgtcgccactttcaccatctttctttcttcttctctgcttcgatttgcttttagtctcagaatctcctttcttttccccttgtaatcaaaatctctgttttcccctcttttgcgtattaagatggaacgagaacgagaatgtgacgtcgggatccgcagtttgcttggcctcgtccttactgtgtggcccaaatcccatgcgaagcccggcccattattttcagtaacatgcatctgtctcatgttgcaatcgggactcgggaggatccttcataaattgatcgagaaatcaattcataattttatcattttatgtttcttctattcaatattagtaagtaatacaagcatgattaaatgcaattttggattcttcattttttatattcgtttaattattttttaattgaacaattttagttcataaattttatcattaaatttaaaaattaaaaccctctcttagtctcataacaccgtaattgatttgtgagtgcatttcattttttacataaaaacgcagttaaatattacaaggaaataaatgtaatcaggaattagtgtttagtcaaaccagtgagcgtaggaagatagtaatcaaatgttctgatctttttgaagatatatttcttgaatgaaaagtgctagtaatttataatgacagaataatagattataaaatatattgtttgtgaggtgttttacgtctggaccgatgtgagcctgtttgcttaacgtcaaaataaaggtcatcctcttatccaagtaaattaaatatatctgcgtgatgaaatcatgaaaagttttctaataatttggaggcttgtgcctgttttaatatcacgtttggggactcccattggcggagtgtccggtcttttgtctcgactgtatctacaagactgcgagtgtgcgaagtgtaaaatatggccaacttgcgctttgagatggtagctactcatcaatttttcttatgaggtgacattgcatagaataattcaaaaagagcgagcttcccagccaatagaagaagaaagaaacaaaaagaaaaggaatcaattgttttggcgttttcccattgatgctccggcaccacccacagtaaatgctccatctgtctcaatacacacttcaaaatgcaatttaaaaatcgttgatcgttccctcctcttacccttttttctcttgttcgtgtcaccatttccacccgcttaagcaaacttttccttttctcctctttgtgattctcatctttattttgcagtgcctctctaaccacgttatctaaaacagaatcatgcggatccaatggtggctaaagacatgctcctccgccaactgcgccaccgccacccaccactcaacaatctcatcactccccaaacaaaagcaacatgcatgtgatgattctatcagccactcctccatttcagaagcaccatcttcaacaacctccaacaacagcacttcctccctcgaaagcaacctctccatacaaaccctcccatccgttccctctctccaaaacctctctccacaaaccttcaccttctctgtctcccaccattgcgtcaccaccctcacgccacacccttctcaccccgtcacctccctcgccgtcaacaacaacctcctatacgccgccaccgaccacgaaatcaacgtctacgaccgccacacgtgcaccaccctccacgccttcaacacccaacccacctccaactccaccaaaaccatcaccttcaacaataacaacactgtcatcaccacccaccaagactgcaagatccgcgtgtggcaaaaccacaagaaccaccaccacagcatggtagccactctcccaaccgtcaacgaccgtctgcgccgtttcctcctcccgaagaactacgtcgcaatccgccgtcacgataagcggctctggattgagcatgcggacgcggtcacggggctcgccgtcagtaacggctctatctactccgtttcgtgggacaggactctcaagatatggcggctctctgattttcgctgcgtggagtcactgaaggcgcacgaggacgcggtcaatgcggtcgcagtgtccaacgatggaaccgtctacactggatccgcggacaggcgcatacgcgtgtgggcgaggcccgagggagagaagcggcacgtgctggttgccacgttggagaagcacaagtccgcggtgaatgctttggcgttaaacgacgacgcttcggtgctgttttcgggtgcgtgtgaccgttccatattggtgtgggagagggaggacagtgcgaaccatatggtggtgagtggggctctgagggggcaccagaaggcgatactgtgtttggtccacgtctctgatttgcttctgagtgggtcggctgatcggacggttaggatttggaagcgcgcttatgatggacggtttggatgtcttgctgtgctcgacggtcaccggaaaccggtgaaatccttggcggcgattccggaggagtactgtcatcaaacttcacctaaatttagcgtctcggttttcagtggctctcttgatggacagataaaggtttggcaggtttctatcaccagtcagtcatgataatgatcgataattgatttcctagaaaattgatgatagcagaatagggaaaaagtagagaacaatgaagaaaaaagtactgagtaagaaaatatgtataagaatatgacatttctgtcatgatttttgtgatctttatgatagcagctataaaaacacaaaccaattcttttacaacacttttttttttgttgtctttccattatttcttttattgtaaatttcattgaataaaggcaaaatttctctttttgtaaattttggaagttatgttagatcaattataccttttttttaaaacctattttaatattgacaatgtaaaatatgatggagaattgaattcctagattgcttttgtcgacgttaaaaatttagggaagggaatgatgtaccaatttaggacaagaaaagtcttcaaactcaaaaaatgtttaaaatttgtgatttttttttcttacttcactcaattactcttgagactaaattcctataaaaaaattagtgatagatgaaaggaaaaataatgaaaaaaatattgtgtcgagataggggtgaaaataggtcagaccatatttgattagaccgtgatttaaaaatataaagattgatataacctattcaaaagtttggtttgaattatggagcctattaaaaaacttattttataataaatgttatatataaataaaatttaatgattatacatttaaaactttgaaaatttgcatagtactttttaaaatttaatataaataaagacgcatacttttcttttaatttgtgtatgaaaaataataagttaaaattaattcgagcacttttaagtattcaataaaatattataaataaaataagcaagttaaataaaataccataagttttatttaataatctagtcttaatgtcaaatactaaaataaataagaaataagaaccaaggtaagttgaagaacattttttaggaaaattaattttacaaaacagtttaaatcaatttatgaaagttaatgaaacaaattttaaatagaaaatatctcaacttcctacttatattttcaaataagtaataatcattttataagattttcaaggtgattttttgaagtggttcatcattcactttcataataaagaaatatttttagaaaaataaatatattatttttaaatttatatatatatatatatattaaatagcttagtctgacaagtctaacattttttttttagcttgagcttgatcttttatttaaacatacttttcaaagagttttagtctgatatttataataaataagtcatgttagaacaaatgtcccttatactcatttccatccttaagttagtgttaaataagatagagcatacattaatattgtaaataaaaatacactattgtcataatataatcttatatgtatgataagtttattaattttttaaaattttcttaaaattcattcatattataattttttaggaaaacaattcatgaacaccttgttgatgtatacatctcaccttaaagagaaaatataaacaattaataagatagagatggagaaaagtaaaagatattcatagaatgtttgtaaaatataggtgttcaaatattaccacttaatgtctaattaattgataatgtaaaaagttaaaattcattacatcagtatgtggaaattaaactcttcttttatattttttcactagttttatttatttttattgtataaatataatctctatgtgttaaaattgtagaagcaagatcaattatacccttagttatatttttaaactgatttgatattacaatatgtaacgggatctttgtaaagattgctattattcatactttataatgttttatacattcaccatttatctttgtatgtatgtttattatataaacaatatactttgtcaataggatctcttaaacaaaatcttaggataaaattttgtggaagaaaaatatgattgaaaaaaaaacttcatcagtcagttttttaaccaaaaacaattaatcatcatcaaattcaagaaattgaactataaaacactttattctctttttatcaactatagatacaactactctttaagtgttaaattacttatcaaattgagttataagatatccattatttatctattgtaattgagtttcgatataataatttataacaattcacacactatttaattaattgaactaaactatttaatactatttgttcatttacttgcatcaaaacttgtgtgtttatgagttgttttttaatcagtggttgaaaatgagttttttttttttactttatgtttctctatatagcaattaattacggttgatcggttgtaacaattttctttatgaaaaacttccataaaacattgatgtttaatatttatgttatctccttattcgtgtaatattttggagattcagtgcgttcagaactatatttttgtgtgtcattttatatttaaaattaatatttcactttaataactcatgggataaagttttatattatatgttaagattgattttcaatgtgaatttataacttgaatttaaaaaataatactaaaaagtatagttataagttagtggaaaactatttaaaattataaaatcatgtcactaattggagcatgaaataatttatgaaatctttgacatattttatcattcaattatcataattttgtaaatttatcactgaagttatcttttatgaattttatcacctattttttttcgcattttaccattatagttttcaattcaagcacattttattattttgttggtgacaaaacaacatcatttcttgctttcttgctttctcctttaatttttatgtcatcatatcctattccagttgtagttattgtgagagtagactcaccatgtacaagtttaagtcgagacacaatgtattcaatttctgatccatgttgatttagttgatatactttgacttgccaaacaacaactttgcttatggtgattggattaacaaaagcttgtgatcgggatggagaaactaagaccacaagaggatgagctagtaagctctcatggctgtggtagagggcatgagatgatgaagagagagggcacaagaacactaacgtggccctcgattgcctcattttcatccatcacatcacctaccatgacagcttcctccttcaaatctgaaatttccaaatcaacgattttcatatctaaggaatttttgcaacttggatgtttgttgttcaatgttttgggtttgttgggagttaagtttaaggggttttgaaatacgtgttgacttattgagaaatacgaagaacttatttggtgattaagtttcagtgtctactttgttgttggatgtttaattgtcattttgttattttgggagtgttggtattggaaggggtttaatgacatgcttgtgaaatatgtcgtatctaacgtgtttttcttcttctttcatttaatggtttttaactatcataaattataagttaaaattataaataaataggatagttgatgagttgtagaagattgtattttaaaatttttaaccgacacagttaatttacaacataaatttaaaagaaaactttttttattacgactcaatgcaaacaaaaaattatagaagacctgaaataaaattcattttttataaaatattccggacattatttaccttatttcttgattctgacacttactattttcatatgctatttttatacttctttttcatgcaatgtgtatgttaggacttctcacaattatttaatggtgatacttttattgttgttggttggttgagcaaaggcaatgtcatgtctcgaacttgggatcaattgtgacattgtaattagcaaaccattaaattggaccatagatagacatcttgatacttttattggaagcctataattaggtaatttgtctttatcacaacaatcttatggactttaaagttttttcccctgatcaattaagttttgaaaaaataaataaatagttttgtcttttaaaaaagatgttttttcatgcacaatgaaaacaaatataaacaatttagttaatattgtttctattaataaaataacatcacttacatttttagtataacaggaaagatgatttttgtgaatgaaatgtaaaaaaatgaaataaattatatggggatgacagggtaagttgaaattgccgagtcaacttgcttaagtaaaaaaaaaataaaaaataatagaacattttagacgtttcaacccactaacttatctaacctaatgtgttgaaggcaggtggagagacagactaaccctatattcaagtcaaaattaaaagaatccaaacaaaaacaaccttatgttataagttccaaacaactatttaagtcacctctttgacatctattgacacctttcttcctccagcactatctcttctagtcattttgtcttggttaataatcttatgaactggtttttctttggatggtgcctgttcctttttgttttcaattccttttcatcagtcgattatttttagcaacgtttctcagttcctctctccaacattgttcttcttgggtgttccttctccagcgaggacaagtatgattatctttccattctcctcttttgcctccgcgttcagacattttggttttgggttgattcacattcacatgcaaatgttaaaaaatgatttagtaaaaataaatagattttcacatctctaacataagaaaaaaatatttctataaataaatgaaatgtattattatattggatacagtagataaataatgaaaagcatatgaaaaaaatagattaaagaataatgaagatgggatttaaaaagcagggtttaaaaattattgaaaacgaggtgaaaaatagagtgtacattgttttttttaatgaatgaataatttattgataatgagattttgtattttttttatataaaaatgcatttttgacgaacaaattaaaagaaaatataaggaggtattttcgtaataggaaggtgtaaataacaacagcctggaacccaaaattaagttgattttttcttatttaaaaaatccattcggttaccaattttttggatctcaacggggcctaggcccaatttggctaccactagtttagatcgtaggcttggttctgttttttctttataaaagcagaggcagaaccccctattttcttcaattaagggataaaccctaacgccgcgaggccaagggaacactcatccgaatttctgcatcaaacattgcttgaactttttgaagtatgttctcttctctagggtttactcgtttctcatttcttcctgaactagttcttctgctattgtcgcttttgataggcgttgcgttctttgtcagtttctatcgccgaaggacgtgtcaacgaaagcgtatacgaattgcaatgttgacctcttttgtcacttttgtgacttgaacagctacgcactatttcattcgtagtctgttccatggtctcgttgtgccattcctttaattcaattatttatttatttatttattaacggttgcttcttatggtgaactctccctgattattccatgggggttgttctagtttccgaagcatatataaattaattcgtcttgaataaccagttttaaacagcgtggtgtaatcttctctaagctacactatgctacctgtcttctggtacatacaattcattactatatattcattttccacaattaagagcagtgtcaatgacgttctaatgaaactaatttttagatttcagaatctgaaaatgagaatttgaaagattagagtaaagtaataaacactgacgcttggctattaaaattgtagaaatggaaacgcctaatgtaacgatacctaaagttggacctaaaccgtcgaggaaagtgaagcttccgacgccgaaggagctgatatcacactatgaatctcagggtatggactcgcaagatgcgtcgttgaaggtcattgaggatcttcagaaggctctgtttggagtcatatcctctggcaaaggtaagcacgacaagctattgactgaatcttctaggaagattgattcaattagcaatagactcactgttattgacatgaagctcgattccaagcctggttatgttgagacttttgcaattgggcttgcctcaggagctgccctcaaaggtattggtgcagttgtgcctcatattattgcccctcttgctcagatatggaactctgtttccactgccattaaatcttccccccaatgatatattagtttgtaattattagttagtttgtagaaatattttttaatgaaatgactatgctaccattttttatgtcattataattcgtgtttccaaaaggcaacatagaggatcttacagaatctaatgaagaaatgacttgaacaagttttgcattaccattacaagcctttacaatcaaaccataaatatgcagatgtcatgctgtctgaattgaaaacctagattaagcaacacttggaattcatacaggaattcaacacacttatgcagtcagtgaattgaaattgttggatgaagatttgctggttcaagtattgaatttattttaagtctaatttactagttagtgtataagtgatatcttcatccaatagtttcaattggcatcaatgtgttaggttccctgttaacacacaacttattaattgaaattgttggatggagatttgctggttaaagtattgaatttattttaagtctaatttactagttagcgtataagtggtatcttcatccaatagtttcaattagcatcaatgtgctaggttccctgttaacacactacttattacacattatacattaggtgatgtgtgtgatgttaggagtttactcgttgcagcagtgatacatgtagaacttttccattgtttggccacattcagcacaggccactttgtctggtatcctaaactggttcctgggagtatcaagcaattgcagtggtgaggggtttggagttcttttatataatcatgcattgctggcaaaagccctttatcttttgctgcatccctccattgctcatgttcgtttaggcactttagaaatgcttctcctttgccctgtgccatctttcctgttccttgactaatcacagcccatcctgggtcaccactatcgtaggttaggattctcattacttcatgcattatatggtggttctgtactgttttactctgctgtgatttagagtgccacatgctctctagcctaacccaaaagaaccaaattatggctaggtcaggaagtatgttgctcaatttttctgcttgtatggcattgttgatttcttgaactttcttccctggattgcttttccccacataaatcatctctagtggtagttgcagagctcttgccagttaatatgcagtgcttgtgaatttagggatccactctatatcatccccttcatacgagcatatatatttgcctttgatatctaaaccaagtatatgcattagatcattgtacattcatcatggttcaaggagtattgatttctgtaagagttctaattgttgctttttatgtgatcttatcatagacttttcattgctcaactttgaatatgttatactagagtgctagttttgcataaacatattattcacaagaaagaaaataatgtaaagattactaacccattccaaaagcgatggatcaattgaatctgccaatagtccaagttcccatgtttcctcattccacagtgcttcctcccttgagctagagaaaggataagccaagcttccccaaatccacatcatgggtattgcattaagattcacaaccttccctagcggatccaactctacaagaataggcttcgttttgaacagccatacctctttaatgtacctgatggttgcgggctccaatagagaagggtcataaagtgagtaacatgacatcattggttgcagcttctcaaactttggtttcacgttagtccatgggattgctttgtccacaactggaatccaaacgagttcgtattgactctctaacctggttgaatcctgacgtgactcttagtacatttgttcaaaaatcacaagctcttgatcagggacattatgtaggtctgttatgtagagtagcacaattttcctcctcaacacctcaatgctaacatgaagacaaactacctagaaggttggaacaggacagctttccccttattgggtcatttgccaaaagttttgattcatgtttggattcaccttaaattatccaaaatcacaacatgtttgatcccaaaggagttaattctaagtaaaattgattgagttaaaacaaccattaagtaacttttgtgtttgataaacaaacttatcctgaattttattatagattttcttttagaataaaaaaatctaaacacaaatcccttcaaattcaattttaaagaaaattaattttattttgcaagtcattcatcaaaacaatcataaccataatattcgaatttattgggggttgaaaaaacaaagtcaaatagtcttcctgacaatatccatactcgagtttatttgtattacgtcacaagtaactctttaaatatagtataaaaatgttctgctcctgtatcttccaaaaggaataaagatctctgagagctatttcctggatccaagcgagagtgccctttctgacacggctgcgtcctcacgaatgccaaacttcgtaggcatctaaagccaatccattacaagtgaaatcttgcccaactccaactacaaagaaaggggtgaggtgctcattatgtataaatgggatctcttggcgccaaataattgaaatttaatttcttgatctttatcctcaatttttggaaacttaaaaagcccttctggtaagcccgctgaatagaaacattaaactaaaagcccatacaaaatgtgcacccaagaaaaaaagaccatatgcagataatggcttacctaaatgctgatgacaaatggtgagtgcattggaaggtgagtatttatgttatcaagcttatgggccaataaagttaaaaataatgataacaaaacagacatgttcaatcaagagtttgattaaagttcttttggtaaaaaaaaagagaaattaatcggagttactaagataaagttgtgatgattataatatgacattaacaatggaggcatacccttgacccaagccagttatgcctaaaacatgcggtgcacaggatacaatactccgaatggtccaatagacagcaccgggaataagattggaagcagtcaacatctctgggacctcagggtcaatgtactgacagtgaagctcaaggaattggacaacgttattggttacatcgaacattgccttgagaaggttgttgattgtttgaaactttggtcccaaatcatccacttgttgcagtgtttcatggatgtgcttcaactttgcaacagacttagcaagacgattggtggcataaagctgagccaccagccaaaatgccccgaagtttgctgcaaatgctgctaacgctatcaccactttggcatcccatgaatagcttgagagcatgcccagtattcccatgattgtggcatgtacatctccaccgctcgaacgcttgtaacatctattacacaagcatgagaacatgaataagttaaaccacacaatagataaaatagtactctctccggttctttttcttataaaaagaaccggaggtagtattgttgttgtaggcgtttaaatagttgtggctattatcaatatttatacagagggagatttagaattgtaagaaaagatttattgttaggaataagaaaacctcgcagaaaattttgttgattgcgtggtacgaaatatctagcacattagctaaatcagattggtatgcactgctcttcatggcatccatctgcccttgttttccctgtgtaaaatttcaaaaacaaccacactcagaaaccaagttaaccaagaaccaaaatgcaaagtgagggaggagagaaattattgtatgttccacgacaactgtatatggtttccattattctccacttaatacagctaagtttcattcactctttctaataaattgaaattttgactatgtactaaatcacgtaaagattaattgagatcatacaataatttctggagagagagagagggatgagagaggctgcacggtgaaaaatgtcttcaacaacttgaaaaagaggtctaacgtcaatgtgtccatcaacgggagcatgagtgtgtttggtcattgtagtgtcatctgatgctgaataaatatggcgcctaggccccgattgcatctcccgtggcaccattaccataacggaaattaaggatgcaagaaaggaagaagatcaaaatagataatgtttaggatcgatgaatttgggcttggttattgctagactgctagttagtgccagtggcttcttatatagctattgatgccaaattttggtgaatctttaccttacttgtatttggtttcaaatcacaaagtaagaaaggaaattggaatatcagataaaggatttgtcgaatttataccttcatcatcggttatggctttcttattttattatcttgtgtcagataaaaatgaaatcacactagtgctgtaaactttttaggttatttcattcgtaactttcatatattcattatattggcaacctgttagtctatcagtagttttttcacatgcacttttaacctaacacgtttcaaaaattaccaacacacaaaagtataataaattcacaaagacgaatcacaagctacgagttattgcaagaaaggtataaatctttcgtaacttctatgatgcgaaagaatcattgctatttattaaagtgtgaaaatagtttgcaaggatatacttgctgtcactttaggatgacattgacagttcgaaacttgcagggtttaactggaactaaagctctgttcaataacttaattattggcagcatgtaaaggatttgcgaaaataaactttgttcagttttataagataaagttttaggttgggtccacaacgtaagttgccaccatattaatatttgtgttattgaattcatgaaaatttcgttcacatagatcattttatccaagtctttatcacctcctaaaacaagattctccgcaacacattattgattttggtgttgggcaacattcaagctccttaagccaaaaatcctcgttaacattaataaatttatacattttcactattattatactatgtactgaatattcacacggatatgcttatttactgcatcatgttcatgcaattaaaacgtaagcaagggatacctttgatgagtacaacatatcgacccaaattcttaaaagcaacttatattgagctcaatgatttccacaaaaggtccggtgaattcagcatggataatgtcgaggttgtcgagattgacctccttccactgtcgataagtttgaaccattggcttccagggtcacatgtgttatctttgctcaagcatttacaagcattggtcacaatgatgttgttatcatctacatctagacataaaatagaaccgtcgcttaggttagatgaaaggtgcatgttcgaatctgatatcatttcccatttagagttaggatctgagcatgtcatgctaagtgttgcaggctttctttcatcctctgcatgtatgcagaaatccgtgttgtttaccaatagggtcttttgagatgtgtatgtccaggcatcagaagaagagcaagcacccaacgttagtgatgttagctgtgatttacttatgacacagagacctgtcaaagggtggaatatcagtttgtgtggattgccttctatgatgcctggtcctgcacaatgtcaaacaattaagtgacaaattagtaataatggtattttctaaccaactaatagtgcacagtttggaaaagaataattgcgcaaattttgtgaagtatgtgcaaaattggattattcaaaaatagctttaacagaaaagggcgagtacaaaagcaaaaggcacaagagaaaatgttaggaatgttataatacacttttttgaacatattcttttaaaaacattcttttttattagttaaatttattagaaattacaaaattttatgagtcttatatcttatttaatgaattttatctcttttttttttttaaggttaatgaatgtgtttcttgattttgtaattttcaataagttttaaccaataaaaaatatgttaaaagaagtgtataaaagagtgcattgcttatactacaaaaacatgaattaaggaagtacaaaaaagtcctaattagtggttatggtcgcagcgttacctcgaaatggaatttggagggcagagattctgtttaagaaactggtactcctaacctgattccaatcccaagtgagaaggccataaaactcttcctttcctataaccccttctcttaagtagtaactaccaacaagtgtccaataggcccaatccaagtcaagctcagctaccagtgccagaaaacagttaaggtatcggttgtcattcacattggtacctctcaagtccccaccaaactcactcacaaacaatggccatccatggtccactaagaagccagatgttttctttatattcgctgtcacttttccacatacttggtttgggttctcatcagcccaagctccaccatcagtgaagccatacctgtgcacctcaaatactagtttccctttgaatgtcaggctcactggtcgatcccgaaggaatgacaagtctgtgtcaaaatttaggccagatagaatgactagaacatctggatttgctgcatgagcagcttctgctcctttcaccatataccttcaattcagaataacaacttaattatcatctacacaggaattttctttcttcttgttttttttttttttttttttaaaaactattccgttgtgacatactcctgggaatatgatttggtgttgcaaatcatctacatagccataaatcttaccaaaactatgtaggaaattgattccgtgttgtaaaacaagccagcgaacaatgaaggaattgtaatgtttggaaattgttttctgatgacaaattttgtatgcttaaatatatttttcatatctataatataatttattttaattttactaccataatttcaattttattagatattttagtaattatgatcagtcaagacctattaggtaataatctgacatatttcattagtttatcacattatcattttaggtccatttcaagatgaggttgtagttgttagcagttacttacttgtaccaatcattaacattctgtctagatcctcggagctcattcctcaagcttatgcccacaactgctgtaactcccttgaaaagggtggtcatcttggtgaggcccaatatccactgatttgggtcaaaaaatttgtcaccgaagaagccattgccgtccgtgttaccgcagcaccatcctggctgggtcacgtggttgtccaaaatcaccatcacatcgttgtccccgagactcttcaccactgcctggacacatcacacaatattgcaccacactcaactcatggccatacaaatattcagaattattttgggtccaaagttaaggattaatttctaaaactatgattcatttcgaggattgatcccttttaacataatttttatattcaccacatagagattaaactctatactatatacttaaaacacattattatctcttaactatgtcacaccataatctctttagtttcattatagtttaattacattttaaatctctttagtttgaattatgtgagattttagttcctcacatgtgctttgaattaatttactaattaagtatctttagttttaaaatctttgaaaatttaatgattataaatattcttttactcaaaactcactcactaaaatatcaaattttgtccgaaataaaaaaatcaatttcttaattttctctttaaccttaatcattatccttttattttaaatttttcactaaatcatcaacctctcaaacatttgaataaaaaacaacaattaaaaaaattcaagtagaagaaaatcaatagaagaataaatttatttaattttaaaaacagaaatcaaattagctcaaaccaaattatacatatttcaaataaaacgatcaacaaatgtaattaagtcaaaaaaacatttttacagagcaaatattttgtattgttgaaaattcaataaaacaaaaaaaaattagcaatttaattatgcatgcatgacgtaataagaagctaacggaagaaaaaaaaaaataggttagcccactgttcacgtcaacaatgatgaatttaataaggatattgcgacatttacatggcaagctggcccatagcaaattagttgattgaagcactcaattatcaaaaaccacaataagtcaatcgctatcggataagcgtcaccgatcgataacatcaatgatcaagtgcaagatttaataactaaaaatacacgtacgatgaggtagttaaaattagtcaacgaattggtaaggttgatttatgaatgaactgagttgggtaagaaatagaagtaattaacttaaacttacctgaaaagcttggatgagagaaagatcgatgatggaggggttgttggtttggacaccagcaatggattcaaggaggccaaggctctgaaaagatcgtctaacggtgagagaagcaagagagtcattggtgaccaaaagtgtgggccaagtgagcctgacacagttgaagcccatggactttattccctttgaaatcacatccacgggctttttgctgagcccttctgccaccgcaacttccaaatgggatacccaattgacacaggctagtttcaccctttggccatcttggttgaggatccatcgggaatccgtgtgaagaagacccgtcacaggcactgtgtgatcatcggaggagagtaatgctattattagtattgatgcagagagaacagcgaaaaccaacgtgctcgaccaccacttacccatttccatttcatatgatatttgatattccacgcgagctaatgagaaccaatatgttgtttattgaagacataggaataggatgtctatatatacatgtggggaatttgtgtttctgtctactgttcttttgtcattgtctttcttaaagtattccctttccgagctatatatcttgttatgtaccttccaaatctttctcatatgagtaactcctttgtttcacatgattttttcacattcagaaatcacataccaaaatatattgtactaaaaaatgtttaaataaacttctgaagaaaaaaattaaaataattaaactttttatatatatataatttattttatacttaaattaatttgtaaaaattttattatttaatttctctaaaaactcattttaatttatacatataagttatctaggggtgtaaaaaaaattgattcaaacaaaacatgattataattgaattgaaactgaagcgatctttatccaaaattattttgatttttatttgaaaaaaatcagttcagtgcgaaataagtttgattcttataattagtttaaaatcaatttggttcataaacggtttttaaaaccaattctaattctgaaccgattttctaaattaatttgactatttaaatgtaaaattaaaccgattcaaacaatttgaaaccacttcagattagttttttttttaccaaatcgattttttcacacccctgaagttatctgagcttatggataaactttatttcgttttcatttataaatgttaatgaaagaaagtctaactcgctattaagaaagtaaatgtaccaagtagctcactagattgattcccctaaagtatatgcaaccatgacgaaaagaaaaagtgtagtagttattaagtgaatataattctttctctacatatacaattcatcttatacaaataaaggtgaataactcttctttattagctttggaaggttgtgcaaaatcaaggactaaaatctttttgtcaaggcggcgtataggtagtaaagaaacacgcatgtaagaagttttcaacttcgtactaattgatagttttaaaatgagtatttaaaatttattaagtaaaattaattaatatttttgacaacaatcttttaggaaggttgtcttgatttttttataatatttatttctatataattacattgaatttttttaatgagaatgtttttaagaatacttattgaataaaagtatttttaggagatattatttaatgataacctttttcaggagttattttcattgtcattgagtcacgtgttatctcaatcttatatattaacatttatttatttttaattatcctcttcaaatatatttcttaattttattttattgattacataattgaccatccctgctttgatcacaatcctgaaataatattctctatggcacaatgtactatgttgactttggtgtcgtttagcaatggtgccctggtcttgagccaaaaatcctagccaacgttagtaaattctgtacatattttaatagtgaaataatatgtattgaattcaatagtcatatatatggacatgtttaatgcatcacttccctgccattaaaacataagtacatggttagagaaatttacggtaatattcttaaaacaacttatgctgagcttaatggtttccataaaggtctgatgaatttagcatggatgatgttgaggttgtcaacattgatctccttccgctgtcaataagtttgaaccattggctactagggtcacatgtacgatctctgctcaagcatttgcaagcattggtcacaatgttgttgttatcgtctacatctaagcatacattagaaccatcgctgagtttagatgagaggtgcaacttcgaatctgagatcatttcccatctagagttaggatctgagcatattatcccaagttttgcaggcatcccttcattctctgcttgtatgcagaagtaagttccttttattgatagaattttctggggtgtgtatttccagccatcagataaatagcaaggacccaatgtcaatgggtctagtaatgactttcttatgacacacaaaccggtcaaaggatggaaaatcaatttgtatggattgcctcttgttatgcctggacctgcatgttgtcaacagagagaaatgtagttcaagtttccatgaagtgctaaattggcaatttattttttgttgaacaacatatacatcaatggtagcaaactcaatactttttttagtaacatgaacatttttatatgatatctctatcaatgtgtaatatggttaacagataattgatccttaagtatataattaagaattcgatctccagatatgtgcgtacacagaaacatattttgggaaagttaatattttttaaatagatctcaatatctttaagtgattagtcgttaactttggattaggattaaaaaaaatcatagctttatcaaagtttccctaaagtagtaaattggtagtgatatttttcaaccaactaatagtgtagagttaggaaaagaatatttgcacaaattatgtactacatacctcgaaatggaagttggagggcagagattctgtttaagaaattggtatctctaacttgggtccagtcccaactaagaatcccataaaactcttccattcctataactccttgtctaaagtagtagctaccaacaagtgtccacaaggcccaatccaagtcaagctcagctgccactgccaagaagcagttaaggtagcggttgtcattcacgttggtacctctcaagtctccaccaaactcactaataaacaatggccacccttggttcactaaaaagcctgaggttctcatcatatttcctgccacttgtccacatacttggtttggattcccattaacccaagcttgaccatcagtgaaggcataccagtgtgcctcatatactaatttccccttaaatgtgaggctcactggccgtttttgaatgaaagacaagtctttatcaaaattcaggccggataaaataacaagaacatccggatttgctgcatgaatcgcttctgctcctttcaccatgtaccttttgttcagaacaacatattagtcacatgaggattctctctcttttatttttctttctttctaattttaaataaaccatggttttatccctcatacagttacaagtaacttaaaattgtatttactctagcaccagccaccagctaattttgaaaaaagagagggagagaggatgttttttttactgcaagtaacttatattatttcattcagaataatgacatcaatacaacaaaatattgaacataaaatctagatgctctagcaaatattaggggtgacaaaatggattggtcttatcatgtctacttattttggctttttttaaggtcaagttggaattttaaactcattccatttttgtcagtcaaaaaacgagctgagagaaaatcaggtggatcaatccaccaacccttttttattaaaagatattatttattttgatattttgtacatatattattaatttttaattattttttaaaataaattattatttaaaattgaagataataaatttaattttttaataagtatttattatttaatatttataaaaaataaaattaattaaaatcaattaaaatatatttattattattttaatatttagttttggcggactaatccaaccaaaaatgagatggattgtcacttttaatctgtaatctatatataaaatgtgagacagaacatattaacccaattatttttgatgggactaaccaactcatattaccacatctagctaacacataagagagacaacatcattaacaatttaacatgtaaaaacactattttactttaattttgataattgcatactgttcgacccacaattacaatattaatatgattccttttagattatagaaatagagaaagtattatacaaactttgacttttcttaaaaaaaaaaagacactttgactgtgagcacttacttgtaccaatcgttgatattctgtttgggccctcggagctcattcctcaagctcatgcccaccacattagtgactccattgaagagggtggccatcttggtgaggcccaatatccactggtttgggtcaaaaaatttgtcaccgaagaatccattgccgtcggagttactgcagcaccaccctggctgggttatgtggttgtccaatatcaccatcacatcgttgtccccgagacttttcaccactgcctgtagtcatcacaaaatgttgcccacactcaactcaaacttgaacaaactcatactatacggaagttagttgagagtgtggttcggactcttaaaaaatatcacccttaaaaatacccaccaagaaactgtccaatataaacataataattttataaaaaaataagagaaaaatgaatttagttaataaaattattttataataaaataaagagtttaatgtctacaatataaaatattttttagtatcattcaatcacaattgtgtaaatataaattttaaaataattatcataaaagtcaatcaatttattataatgatgagagatataagattagttaagtagttaagaaggaagaaattggagaaaacgtgtgggtttgtatagacattaaactcataaatatgattatttaaaattaaaaaaattaaattactaattatttttaatgctcaatgttgattggaattagaaagtataaaacgagagtttgtttgtaaattaagacaaataacaaaaacatattctactcactatatgcaacataaatggcaattaataaggaagtaggttggagctgttttcaataaccaccaaaaggcaatcgccatcaaatatgcgccaacacatcatgatgataagattaatagcaaagaagataaggaagatgaggtgattcaaattagtcaacaaactggttaattaggcaaagaaaataattgaattgaatatgataacaaaaacaatttacctgaaaagcttggatgaggggaagatcgataatggaggggttgttggtttggacaccagcaatggattcaaggaggccaaggttctgaaaggagcttctaacggtgagagaagcaagagagtcattagtgaccaaaagtataggccaagtgagcctaacacagttgaagcccatggactttattccctttgaaatcacatccacgggctttttgctgagcccttcggccaccacagcttccaaatgggacacccaattcacacatgccagcttcaccctctgcccatcttcgttcacgatccatcgtgaatccgtgtgaagtggaagacccttaacttcaactatgggtccggagagcaatattattgttattagtgcagagacaaaattgaagaccaaagtgcatgaccaccttcccatttcgtgtttcttcagtagtatcatctgttgtttgcctatgccatcatattccgcacctgtgagattctctgcacgcccgaacaagcccaatatataacttgaggatgtgggattgtacatgtggcaacaaaattattttttaagtttaagcaacttgtttatttaatgtcattttgtcgtttatttttaaagtaatactttacaaaatatttatcatcttaaagttattttatatttattaaaaataataataaataaataaaaacaaataattttataaaattaatattttattaccattaattcatttttagattttataatttattattattcatatataaaagatacaagtaaaaaataataattaatattatattaaaattaaaattattttaagataattttttcttacctaacaattataatataacagagaagtatatctttatccgttcctttcattaaattattccttataacatatatggatcctacaatctatcatgatagattgcataagttctagttgataaataaaaaattgtgtcaatttttctctctttctgatgtacataattatatcatgttactcaataatataagagaattcaatttctatgtctcaccaggtgaacaaggtgactagtttaaggtgagggctacttgcatatttattaattttcatgataatgaattatatatatgtgtgtgtgtgactaagtttaatatctatatattattgtgagtcagtgtaaatagtgagatccagtgtttgaaagtttctgaattttatttcactcctaaaaaatacactggtgaagacaaaagggcattttaattttaattttaagttcaagcgaaaaaaagaactatatataagttaccacacatttcatcctacaagtcatgcaatgttaatttaaaaataagtaaaggtaaaaaaatatgtggtcatttgattattgagatatgatgtaacctgcacgactaatcagattttttaacgcatataaatacaaacaaattgattctcggatccttcaccaattatatgtgttgaactggtccatttgaaaatcctgactccgtaaatatgattttctcttattttcctttctttgacggttaatcagcctcgattagggttcataaaatgggtttgatttaggtctaaaaaagaaaattaaacaaattaaattaaaatatattagtttaatttttaattttttaataaattaaatccaaactatttatcaagaatgggttggtatgttttagtttattagattatattagatttgttatatatattatattatttttaaaattagagaaaaaatttatattacttgattccgatcctaattattcttttgaaccaaaatggcattgtattatgcatataaataaaaataaataaattaataaggaaatttgagtggttggttaaggaactcaattgatattttttcttttttatgaatacctctaacttcaaaaaacaactttcacttcacatcttcattaaacaaggcatgaaacacacaagtgaatttaatgtcagaccttcaactaaaattcttatggcattatgtgtgagtctttgttcatattagtgactccaacaattaatatgacactgcttttcctcccataaactttatgtttaacatcctactaacttttatagtaaaacaatgttgttgattgcttcttcttcttcttgtatactttcttttttcctctaagaagagatgataaagtgtacccgaatcataccccgtatccattaaactatttacaagcgaaacggacaatgatccacaatattgaaactctatactggcggatgtatatttacaaacatacgcaattaaaacattaactttaataatcaatatgttagatgattatctttataattttatttatttataactaaagtttagatgtatcaatattatatttatttatttttaatattatgtgtgtatgtattttaatgttatgtttgaattatttaagaatgaatttttattataattatagtaattattttaattatttttattgatttattattattaaccttgtagataaggaaattgtggatcacatatacatacataaatatataagtatccaatgaatagaaagatgaggattaaaattattacttacttaaatatgaagttagatatggatattatttttaaacagaaatatacgaacgaatattatactatcttatctggaaaccacacattatcatcccattctctaagtgttgttttgcattattagcatcgtaaatgcaggaaaaatgtatacccacacttcattttggggtcgattgagacaaggaaggataggaagataaaaaaaaaatgatagatataataagggatgtaataaaaaagttggaaaaaaaagagataaaaaatgtagttttatatccgaaatgcattatgtgattgcattgtaatagtaacgtagacgtaccgtgactccatctagttcgctagtttgaagtttaataaacacttgaacttaaacgtagtgctacgtaataattgggtaggtgatatatatcacgcaacctttggcaacagtctttctttctgcattttctacagaaaattatgacttattaatttgtatatatcgtgcgtgcactcaatagtttcgcttcgagataaaaagaaaataacggctaacaaagttcatacctgaattgcggggaacactgcaacacttgcaatgcaaggcagtggaataaactgcccattgcttcttattttggtatggctattggttactacaatctgtgctgtgctcgattttgttatacaattataccgtgtctttgtatgattgcgcatctctttcttcgtagcttttttttcttcttgttgttggtgtttgaaattttaaaaattaaaaataatttgatttagattttagaaatccacttttgtgtttcaaatttaaaaaaaaaaagttttttttatagtaatttacaagtttcgaatgtgtgtcagtctgtgacagatgacaataaacaagctcttttatttagtcgtgttttgttgtttatggtgattttgtcaaaggaacaccagtgactgtcaggctgccactgataaagaagtgaactgtgagaccaagacgtgtataatttacatacaagaagaaaacaaaaacaaatagtatacttaaaaaaacctaagaaattttttacaagcaacttacatcaaaacatgaaacctaattgggacgcacaaacttcaaatgtacaatgaggcaacgcgcattcacaactcttcctagctcctaccctggcatatatttatttttgttcaaaattgcgaaatgcagttttggttaggcaaaaatctaaaaacttatccaccaccatgagcctggctaaccctgctcctctctttgctaccctgcctatgatatatcacgttagtttttgacttatgataacaattaagcactcagtttatgacattgtttaaactttaaacgtaactaaccttttttctgcaatgcaaggttaactagtaaagctttattctggtagtgattgtgcttcggcaaatggggcaccattctaggttttctccacaaacacagcaagtctgccaaatgtgagaaaataacaacagtggaaagaaaagttaatataatgtcctaatcatatagtcttagattcatcaagatgaatcggtagaatataattcaacttggtacctggtgcccgcaaccaaatgccatatccttatcattagtaagacaaatcgggcaaacctgcggttaatcatgtcatatgtaaaccattgttgacttcttgtgacacagaaacatcatgaatcatgatgatcacgtcatatgtctcgagattatatgaaagtcacatcttaagttgaaaaaagaatggtctaaatagtaccttattatcatataagtttcttgaagatgattctgcgttaacattatcataatatgttggtgtgttctgttgaaaactgtttgaaggaagaggtattgtgctgctgctggaagccatctcataatgaggtggaggtagaggaaccctgtctggtgaatgtcctctccgtgcactactttcatcaatgaagacacgaagcaagttcagttaatatctagataaaatcttcattaatatgctataagtaccttgtttttctatataatattcatttattaccccaatatgccaaggtctatggttgccttatattgagaaggtatctccatcaaagctgatagtgcaaactctgtctcttctttgcttgagtctatactctctgacattatttccgtaaaattcacaaactacatgcagccaaaaataaaatgttcacatttcagcttaatatgaaggactatgaagaagtaaccgtggcaggtcaataggactaagtgaattacaccaaacctgaaaattgtcaaatgctcgagctgggatgttatcatcaaattccctcatcatatcccatgggccatctccaactcccaccaaaactattgaaagtggatactcactgcaatttaaagagtatgagaatgcagggtggcaatccagaaaaaagaaaactacaaaatttacctggcttttacaattgcatcaattgtcttctcttcctgtggacttagctggccatgttgtgtgtcaacacttctggtcacctgtcgcaatattttaagtatcaatgtttttagatcttatagataagaagaaaaggaatttctacagtaaaagattaatcattgttgaagcactgacaaaattaagggcattttaagttaatcttttgttcagatgtattcatgtatccaattaatcttagcaaaatattgtagtgaagaagacagacatatttcagaactcacacattatgctaatctaacaatctaacaattagcagttttcttctgcagctatcaatgccaagatgtttgtgttaaggtagatattattattatcactaacaaaagaaaccaaacaaaaaaatgctttcataaacctataccattttagtttttttttatttaaaatctatgatacttttagagttataatcatatagttagtgtgataacggccaatgaaacatttgatgactgatgcacgtttacactagtttaaaaaaatcttcttttcaattttgtgaaatatgtattaaaaatacctgtccatcagcaattattagcaggacatgatattggccgccactttgctcgactatagtcatggccatctcaataataggggcaaatgaagtgggtcctgtcacataaatgcaatgagtcatgctgagcctaagtcaaaaatgcaatgaaagattattggtgaaggcaacacctgctagacgcaggcgagggagaatatctctatatcttgacaaaacttcctcaaatccattgcagaacctctcgtctgaatagaaactgaagacatcttgatcatgtgttgatgctgtcagaggaaaaagacaagaaagaaacacaatcaagtttgcaattttgaaacataagcaatctgaaagcatgaatatttatatatggaattaccatctccaaatccaaaacaaggaatcaagttatcctcgtcaaaaacacttaaagtttttccaataatcgagattgcttgttcataaggattttgaccacttcctatatgatgtaaactttttcggttgaatgacctcttccctgatttcaaagtgatttatgcaaatttaattaataccacaactcactacaagaaatccaagcatcaagatatgactaagagataaaacctgtccactcattgctctttgtaaaatcaatgccaacaatgagattagaagattccaggccagcatgtgaaagagcagtggtaacctgtgcaaaattatttcattatttgacaaaataaggtgttcttctgtgagtaataaccgcaagaatgaaagttttggggagtgaaacaaccaataagtattttctcatgctggtcttgttgcactatgagaaaagaaaaaaagtaaaataaagcaatctactctaagcttcatccaaatattttctcataccaaccttgttgcattgcactcttggactagtttggacatatcagacgttgataacatgtttactgctactcatattattaaatgaattaagggatgctctgctgattcatgcatgcatgatcaggaagaacaataaaaatgagagacagttgtctcttttcgtagcagcttttcttaagccacttcatttcagctgaacttgtttaactatattctatggcttggatttaaagctcatgccaacttcaaagatctgctgaagtataaaggtctgcttaaaagaaactttacaagtatatataaaggttttactcggagttgtagtaaaaatatagcaattctaagcaagggtctcgcaatttttttttgcaaaatccagcatttctatacatttttttctcctggaacatggtccccaatattggggaaaacccaagtcccacatatcggctagagatagcggcaaaatagtatataagtgggggacaactctcatcctatgagctagcttttggggttaagttaggtccaaacccacattctaagatgatatcaaagtctatcctaaatctattaacgggccacccactgtattatccacgcaccaagcccaaaagtgttgggcgtgaggggatgtattggggaaatcccaagtcccacatatcggctagagataatgccaaaatagtatataagtgggggacaaccctcattttatgagctaacttttggggttgagttaggtccatacccactttctaagacacaaagccccaaacagatccatttgatggttcagctcggcacagattttaacactcttttctgtggggaaacatgtttgttgttagattgaatccttattaagacttaagaacctcaatatttcgattttcaacgtggaccatcatcataggcagaaatttgaaggctgatttcagaaagaacataactgattccctttctttctttcttctcctcccttttgtgttgactgatgaaatatcgatgccgttcaggtaggaagtagatagacatactagttcaaatcaattcattatgtccctaaccccatttcttaccaaacacaaaaagtcaatgatgtaaacagaacaaaccaaaaatgatgaaaaaatactcatatattcatacaaaaaaaacacaattatatctaacctaagcaaatgacaaaaacacaattatacgtaagcaaatcacaacaattacctcatccagtgaatggtaatcatcagctattcttgaatatctcctatctatcctcctttttggctgtgaatagtcgtggaatggagcttgtgcacggtggtgaagaggcgtattataaggattttgttgtgggtatgcatttggtgattgagggcatccatagctatcccgtgaatatgaagaaccagcagatccatatgatgaaacatgccttctttcagacccttttgaactcttacctcccatgatcgactcctttagaatcaacaaaagcaaaaacataacaaccaaagctgtccaagtctctagctgcaattgcaaacaatatgttaaactaaaagcatcgcatatatatgttcacggataatccaatctggaacactgaataagaaaacaaaaccttacaactttgactagcagtaaaatacaaattctgggaaactaaaagtaaatgacgcatacgaaaatttgttcaagaaatttcaaggccaaaaaaaaaaaaaaactggcaaatatgaaagagaagaaagagaaaaataaactgaggcgctgaactatggagcaatgatgactgaatcaaatgacacctttccacaaatgatgactgtatcaacctttcctcaaatgctacaatgaaacttaaaactcagaacattttttttttccatacctctagaagcattgtttccacacaagaattgcaaatgaattgtgagagaattaacaacagacgctggataataatcaatgtctcacgctaatcgcgtcaagtagaatagcttctccttgtttaactaaatagaaggaagaggacaacgaattaagaaagctcctgttggaaggaaactagctagcaaggtcaagtcaacaacaactgattaatcttttcttcctattcaaacaagcctaaagagtttatatatagtctatgattataaaaatatgggaaaagccttaaaatcatactccaggacaaattaattaacactttagttgagaagctttgtttacatcggcattcaataagtaaatgaatgttctttttacaagtaagcaattatatatatattgtcaatttggaatggtattagcaattgagacaagaaattgcctttgtatttatttatttatttattcattcattcattcaatagaaagtggaagtcacttgtgtttttcctcgatccttctccgtagagttggtgttaagaaatgtcaatatacattttgctacgttgacgagtcccactgttcaaaaggaccgaaacttccaagaaatacctcgtaaaccaaactaattaaatcaatcccactattaagggctttaatgcaacaacttaacttgagttattaactctattttaatggatctgttattgctacataggatttaagaatatttttattctaatttgaaaaaatttaagattttaatttaattttaacagatcttattttatctctctagatgtgactccacatgcatcataaaaggatgaaatctacttactagtataatctcttataatttcactaaagtctcttttgttaagtaattatgctaataaatgacttaacacataagcatctcattaatttatcacatcattactacatacatttacatttttttataaattatatttttaaatattgtattaattaatttgatgtcatccattattttaaatagataaaaatttcaaaatataatttacgaaaaaaatatacacatcaagggacgtgcacagtaagtcaatgagttataaatattattgtaacattataatttaatattgctaaagtaaaaacaggaactaaaaaaaatctctaaaggactaaaatcctattatacagtgatattcaagagagaaaaaactataatgattatgcgttccgtggcatgaaggagcagtctcaaatctcagcccacgctcgttttggcctcaacgagtctctctctgtctccgtgtcatcccttgcaaacgaaatttccttcctttttgtcccacctaccatcactccaatcccctgccctcacgcctaccattgccatcttcacttccccaatcctaaatcaggcccgtccaatcacatcgccgggccgtgaaacacacttccccacttgctcacctaggatggtaaatcgagtttgatctaacgggtcagtctatttggcccgcaagaaagtatggatcaggttaaaattttgaactcacatttaataaacgggtcagaccaaatgtgggtcaggaccggaccagcctaccaggtcgatcagcagtccatcaataaaaaaatataaaatataataggtcattaaatgaatggtttagaataagagtgactaagaagaagtgagtgattttgaatctgtaaccctaatacatttttatttgaaacctaatgatgagttatactacgtgtataaatatgcttagattgcctatatcatgttgaaacaaatttctaagaatatgttaagacttaggagctagttgaaaatcattgttagacatgtattctctgtttgcttttacttctattagatatgtattttatattaaaaatcattgttatatgattaagttaatacattattaatttttagtataaataattatttgaattttttataatttttttaatgttttttttaaatatattttttattttttaaatgaactgactcactgatcgactaactcactttattatcaatccgaaattcttcagaggctgactgactggtaggtccggtgtggcggtgtttcttcatcaatcatcggcaacctaagacaaaatcacatttcattagagttcccactttatactcccatgttgttggttcgctccaatttctagggtttatcacatattcgtatatatgctattacattaaatggacggcaccggcgacctagacgccgatgcggtgctcagcgacgtcgaggacgacggcggcgatccgattccgatcgccacgaagcctccctcgccggaagacgtctccgtcgagaaattccgggaggttctcgcggagctcgatcgggagcggcaagcgcgcgttgccgcggagaatacgaagtcagaactacaggtttcgttcaaccgattgaaggcgctggcacacgaggccataaagaagcgcgacgagttcggtcgccagcgagacgacgccgttcgggagaaggaggcgacggcgacgcaattagaagaaaccgcgaaggaacgcgacgcgctgcgatcggagattgggaattcgagccacatgatggtcaccggcatggagaagatctccgcgaaggtgagcagcttcgccggcaaagcgctgccgcggtcgcagaaatacaccggcatggcggcggtggcgtacggcgtaatcaagcgtgcgaacgagatcgtggaggagcttttgaagcagaacgaggcgaccacgaaggctaggaacgaggcgagggagcagatggaacagcggaattacgagattgccattgaggtttctcagcttgaggccacgatcggtggcttgagggatgaggttgcaaagaaggtttcgattgttgaggatttggagagggatttagctgttagggatcagaggctgaatgaggtttcggagaatttgagcaaggagcaaagtgagactttgcggttgaaggagtttgttggtgagtgtgaggagaagttgagtaagttggaatctcggatggaatcacaaaggcctttgttgattgatcagttgagttttgtttcaaaaattcataaccagatttgcaatgttgttaggataattgaccacggtagcaccgaagagctgtctgaatcgttgtttgtcccacaagaaacggatgttgaggagaatattcgtgcctctttgtctgggatggagtccatatatgagttgaccaagattgctgttcagaaagctaaggatgtgcttgaggagaaggatcgtgagattaagagtttacatgagacggtggctcggttagttagggagaaggatcaaattggttcttttcttaggagtgctttgtctaagaggattgcagttgatccgtcttctagaaagagtgagctgtttcaagctgcagagaatgggttgagagaggctgggatagatttcaaattcagtaagcttcttggagatgggaaagttgcagcttcaaatgacaagtctgatacaacggaaaaagaagaggatgaaatatactccctggttaagcattcgtttctctttctagtttttaatgaaacttgttcccatcgtactttgcattttgaagacccatcaatgaattctttgtgcatgcatgcaggctggtgctttggaggatgttgtaaaggcatctcagcttgagatcattgagctgaagcatactgtgggtgaattaaggtacttaacatcagaattaaatgcatagttgcttgcatatttgcaatttgcagttgtgttgacatcataactttttttctttgcatattgcttaactgcattaagggcagagttgagcttacttaagcagcatatagaagctcaggccaaggagcttgaccatagaatgcatcgggtagaggaacttgaagagaaggagagagtggcaaatgaaaatgtaagcttaaatttgtttgagtttaatttgatctagttccttaaccataaacagttttatctttaatatttgtatattgtagaacgtagaattttgttgtgtatcctaggctgtggataatttgtaaggcacatttgattgtttgtacttctctgtcacaaagtaacaacttggcctatttgtaatgtagattgagggactaatgatggacattgctgctgctgaagaagaaattaacagatggaaagtggcagcagagcaagaagctgctgcaggcagaggcgtcgaacaagaatttgtggcacaggtatgctattcattaccaacatttgttgacacgtttgctatatttggaggatgtgaccaaaaagaaattttcagttgtgcccaagtattcttagagtttaatgtttttaaattttgatttattatttttttcagtccaactttgattgtgcaatgttttggtgtgaaaaatcaattcttgcacttttcaatgaaaaacacatgtcccaatgtaaatttatgacagattaattggacacacatcctaattatgttcattgattcaaattaattttatcaagatcaattccactcaacattaaaacaaatgggctctaaatacattagctagtagctggttgctagtggtcatgaaccaactatctcaaaagctttagatattgggtggaagcctatgaatgattttatatatctaatgtgtcccctcatgaaagaaccctttgggcctatagtgtggatagtgtgcaggctcaccgataggaatctcagggagaagaactgaatgatcacatgaatagcagtagttgttagtttgttgtgactgagtctagttagtcatttggatggttagaatggctgcaaatgctacccgctgagttgttacgttcgtgtgtataaatatgcataagacaagcttatgcatgcttttcataatgaccaataagaatagttcatgaggccgtggctggagtgaaagtcctcttcctctagattctcctattcctccattcattgtcccttttcagcatgtaatgctctgatacccaagagctatcacttgtcctaccttgagctgaaatttatttagaagaatggggactacaacaatcgaactctagaccctgtttccgtaaacactttagtacaccatgtcatgagctaattatcccaagaatttaagtgatcagtttggtttgggaaaatgttttctgctttttacttttaattataagaatgttaccttattttcactttgttttctgatttctcaaaccaaacagcttctacgtttttagttgaaagctggttttattttatatctactactaatgacatcctttttccatgaattccgttactgcaatcccttggctctctaacattatcatctcactcttaaaaaaaaattgctgtaactaagcaagttgatatcatagaaagccacctgttggtggatttttttttcaatgctattgtattttttcatcgaattttcctagtgataattgctgtctgcaaatctgcagttgtcagcacttaagcaggaatttgaagaggcaaagcaatccatgttagaatcagagaagaaactaaatttcaaagaagaaacagctgctgctgccatggcagccagagatgcagcagaaaagtctcttaagttagcagacttgaggtcatctagactaagagacagagtagaggagcttactcatcagctcgaagagtttgaaaacagggaagattcaaggagcagtaatcgacctagatatgtgtgttggccatggcagtggctcggcatggactttgttggatttcagcagcgtcccgatacacaacaggaggcttctaacgaaatggaactttccgaacctctattataattgggccttattcttttctctctttttttgtgtatttatgttgatttcttcaaattaatgttacaaagttgtagtttataccatcaacatgttccaccatctcttggaatgccgtcatggtggtcactggttgagcattaggctactgtaaagtgagaaagtctctgaagtctgaagtatacaagtgagggtgtgttcacgcttgaattaaaataagttaagttcatcaaacactttaattttaattaacataaaatgcatcttcacttattcactttagaggttttctcaattcagatgagccgtttccctgcattatgatgttgcgcctgcttccggcttgagtagctagctattgtactttggttgttttgaacgaacatttcatgaaagcaataaacaaatacactgtcattacattacagtaagcgtaaccctggtttctgtatctgctcaatatagtgcatttttatgggtcggtgccctatttgtcaatcgagttacagcattgtcggcttctgtatggacgtttcttccattgaacaaattggtttttgggggatctatgtattcgtcaatgtctccctagcaagtctatattggaacaggtggaacaagtgggctggacaaccactcaacatgtcaaatctctagaaactatagcggtttcaacgtcgttggacgacattcaatcgtccctctttttgttttattatcaaatatattcaatacaattttactaataaaattaattatgattcttttttacctttattttgcttctgtaccgattagatcctgacattttattttgcataggaaggtgtagaacaaatatcctaaaagagactgcatattaagggggtgttcctcaaccgggttagatcttcacttagtcttgaactttcacgacattagatttgaagaagtatggaaatatacgggtttaactaaaattggacctaagtaggacaaaactaaattagtggtgtgactaagaaaaatcatgtcttgtaatctagtcgacatatgtttgtttaatggcaacatatgttgtttttattttgctttttaggtgtagacattgttgaaacaattttttttttatgagcaaatgttaacaattaatatgtcatgttaattggaacaatctttttaaactggtagtaatgttctaaacatatttgatgagccatctcaagtcctagcgcaacaccaaagatgttgttgctcatgtatgcatagattaacatgtttggaaacatgttgagaataaaagaatcgcatttgagacgtgaaagttataattattaatttttaaaaatcatatcctaaatgtgaaattaaaaacgctaaagcatgcagtgaaattacaacagtggcggagtcatgatggtggagcattaattaaacttggagcatatgttataatttttcgctgtgcaatttggtacgataaaatgtaacgtataagcatttcactttttaggacaaatcttggaccagctggtctgtgccttgtgggatataagataaaaaagcgcgatatttattggccattgaacatcgatcatacttggcgtgaaaacttaaaaagccacacacccttaagaaacttctactacttaatatagtatgaactaatgttaaagaagctgttactaatttataataaataatctctaataattctcgagaagaaaaaaaataagatacaaatttgtggtttaacaaaactacatgtggtggggagggaaaaaagaggctagccttcaaagatgttatttttcaggaggaataggcaaattaagaaagaccaaaaccccccaattttcaaggactaaaaaaagaataccaatgacatatagaatcatcatctgtggtgctaaattattgcttcagcgctttgttctgcatttctttttgagcaaaataccatcaggagggcgtgttagcatgacactgcaacggccataaagattatatgaataccttaagatgcttcccaatttggaccttgccctgaaaactcccctcacttcaaggataacgccattgccttccatttgtttcacaagcctctggctctctcttaatggcagctgaacttgactagagaccatgtggatatatgcaaaccttgattgaagccttgcagcatagaaaggctcaacatattgagtggcaataagggtacttccatagtagagataaattatcactgagctgaagtccacatgcaccttcttgtttggatttgtgaagttagccagcatggttagatcagcattgagtagatatccaaggtcaaggtatgcagcatttaaggtcacactagacacatcaaaatgaggactttgggggcgaaatacgaagtacactataaggactattaagcctcctatgattatgatgagccaaaatatcacacacaagcaagcacctaaccatgtcaagggttgagacttttgctccttgggcaactttataccactgaggcggggatcgtggcgtggctggtgccaatgctcggggcgacggttcagcggtggctggacatcagccgagggaggtggttcttgaaaatttacctttgacttaactggcaagaaaccttgattctgtctacgtggacttctttgcttgccacggcgaggctcttggagaataggtggtggtgggtgtggatgatcttctaccccaggttgcaatggaacatggtcttcatgctgaggtcgtgttcgtaatggaacacgatcttcatgctcaggtggcaatgcaactggtataggtggagctacttgtgtggatggttggtctcggcgttttcggcgtggcacaagtggataaggttctgtatcacgattatctatatattcaggttgtgatgatctagaaaaatgagggttggtttctcgacgagacatggtgtggttgtgcaaaaatgtatgaggaaaatgaagagaaacagaaaggcagtgatacgagaatattattaagctaatggaaacgagcacaaatcaagcctaaaacaaaaattaaagcacattaagggaatgagaatgacttcatgggaacttcaaggatgattcatataaaggcaaagaatcaaacataagccacttatgtggggcaaaatgtttcaattctttattttagatatttaacacccgatttgagtttttcaaacagaaagtgatatcatgtatcacttatggatgctatgattagctcaagccttggagtggatgtgtgaaatttagacttgagttgccgagcttattattgtcctatgatatagagaatttgaatccacattagagaacaagaccttgtgtgaatttacaggcggcatggattcttggactatgaaaattgtaaaggttagggaaaagacctgatcatgcaaggggaaaacatacattctaactaaagtctaaagcgctttcagtttcttgtaccacaatttacattcacacaaacaagactgcggaagatacctttcccctactttggtccaaaatacgtggaccacaaacacagactgcgaattctagcacactttaaaaagttaagaacagccgattgaagagaggaactcgttatgacttaggagtcaacattcgatcaatttaaaaagaaatcaatattttcagcttaaataaataaagcaatgtgttaaatataagagcagccttaacatactcatttcataaaaaagagacaagtatatgaaaccatttcaaaattggcaaaaattaaaggtatatatgcccataatataacactcatttatcggtggcagcttaaattacattgatgaacttcaggcggttgagcatttttttaacttttccagcaactgaaggaagctataattttcaacagatcagtcaaacagcagccccacggcactctctctcaaaaaaaaaaaaagaaccaaagttcaaagggaaaataatgcaatagctacaaaacaactacacaaaagtttctgattcatgtggctaacatcaattccccaggctcatgtcacggtagtaaatgcctcaattcaatagttggaagaaattttctcttcaattttggaatggagatggatgttattcttagaattctaagtcaaatagaaaaattaaagccagggtcttttgttgccttcaaattttctatattttccaagatctggtcagatgtattgttaacagtccccagatgcagacaggccacggtttagcaattgcttttctccattttgtttcttttcaacacttccatttactccacctcaccccaaaacagatgtaagtaatgtgatcagccaaacccataaactactaagatttcatgatcaaatgtcaataattagcattctaactcctccattcttacatcggataacctagttcaaaagagaaaaaggctacccaagacagtaaaaaacttatgcaagtagaagttttcaattgaacaggatattaataatttaataggttgttagtgtttacgccactagcacagaatgtaaatattaatcacaagttcaacttgtggaataagcctcttgcaaatgcaagataaggctgccaatggttattcctggtctaatgatgttcaaaaccggagggaaaaatccatttcttcttctaaaatcctatattcaggcaagttgaaatccagtttcattttgatgacctgggattatattagaagtggattctcaataaaactaggttaagagtttctaaaattggtgtaatatgtgtgaataaagaacttgagataccacatgttagagaaagatttgttattgaaatgaaaatctttgagaaacacaattgaagagagtgagtgagtgaatgaagaaaggatttgtcaacccagtttcaatactgtactttccaaactaattctaaaatgtagcagttttgaaactagtttcctaatacacgtctcatttgctgacatttagccaccaccatggcattttcttaactatttccatttttaatttcatactccggaagttgcttggatggtggaccctagatgattcatttctatttgtaaatcatcaagaatccaggcgtatgtccttcatctgtacattctctttgccctcctttgttctttctatttcttctccaattttccatcaaaccaatctgcaaattgctagttgtgctggttgtagttgtccttcagctagtcctgttccaaggtgcaacattatcttgggtagaatctattggcaaggaaataccagcatacaatgaaccagggtacattaatatcattatataaaaaaaagactaaggaacttattttatttcatagacatggggattgataccatgcaaaacaatacatataatcaaagttgcgtgaaaccatgttctgactccttaggttcagcacaactgcagagaatacacatcactgtggcactatcaaactaaatgtaacaactacggaaagtgttgttttaatataagattctcctgcataaatgcactataaactatcccaccaacaaaagtgaaaatttattaagtaacataagataaggcagtttccagtcagtctccattgattcagcagccttcagaaacactatgcaacatttaaatgattcatgcatccattttttttcttacattatattgtttgttttctttcatataggggttagcaaaagtggacaaaatcatattatatgtcatagttctctaataaaagaacgcgctgaaatttaaggagtagaaacatacttcggataaatcaatgtgtaatgatcatggtgacatttctttggaaaagcttgaggttccaagctgcagatacaggcagaagcatcataatttaccagaaaataatgttaataaaggtcaggcaagttgaattttgtaacagtataatcctacaaatatgtattcttgcatgctaatccaaatctcagaaggaaaacataacttgtgccagcatcacagtttttcagaaactaataaatctgaatcttgaaacctaacaaggctacctagtgaatctttttttcacatccacaactctccactgagttacatgtctagatatagacacaaatagtaaaccgatgatctgttaataaaggttccagagtttattgttcaacaatttgctaggatatagcaaggcactaggcataagccacaccaaggtgagatcaccaatgaaaccatatcttcatagttcaaactatgctctgcaaccacaaacttcatcttgatgaaacaagacaacattctaccaacatcaaggagttgttaacccaagaagggtgctatactattattgatagttagaaccataaaatattcattgattttctgctatgcaaggcaggacatgaatccatctgaattgagctgccactggtcaaagatttactcaaatagtatgaagacagcataagactaactcaaagccaccctcaatatgaactcttaagaaacaacaattgggatttgaataggcagctggagtgattccaaccaaatcatcaattactgaaattagttgtgctgggtgagaaacaaatccatagctctcaatgtataacaatcgccaaaagtaaatgaatgttctattgtattgacatatacaatctgccaagtgcatagtctgttcactctgttgacattatgaaacaaaacttggataccgttacttcattggtagcaagaaaccattagagcacagtcctctgtatggatcctttacaagaagctggcctgtgaattagtatgttatacagcacataagtatataggagcatagagacacataaaggtatgggatggcaccacgagcgtcataaaaataggataaaccaatttacaggcgccattacctgcagataacgtttcaggtcaggtcaggtttgctaagccttggtgtattgtatccagaaaaaactttttaagtcaggtttcccatttgaaagaaaggtgtgatgaatttgagtggatcaaaacacaaactagtgtcatgttgtgccatcacttgattgaatggcattgactagagtctcagagagatgtctgtcaagtgtaaagcctctctccatcatctgatcccagaccctacaggccagtgaaatcttttttccccttataagccctccaactatcaacttgtaagttacctcatcagggtacaaacctttgctctgcagttcatcaaataggcgcatggcatccataactctagaagccttacaaaacccatttacaagtgcattgtaagagatgacatccggatttaccccattctcaaccatgtcatgaaaaacactatgagccacatcaaccttcccattcttgcacagatgatcaactactgccgtatagaatatgcgatcgggaagaacatgcatccttgtcatttcatcaagcagcttcttaaccacatgggtacttccttccctaagaaacgcatctataagtacattaaacgtcaccatgtctggcctaatccccttcccatacatctcctcgaacaactcataacccctcctagtccggcgagccttacagaaccccgtgatcacagtattatacgaaacaacatcacacatccctttggtctgcatcctctccaccatcatcaaataagccctatccaccatatttgccttgcaaaaacccttcaacagctcattatagctatacaaatccggctccaccccactactctccatggtctccaccaacctcacggcctcatccaccatcccctcatcacaacagtaattcaacagtatgttataagtaaccaaatccggcacacacccattccggctcataaacgccttgatcttcatggccttgtcaaccctccccatcctacaaaacccatcaatcaaagcattgtaaactaagctattaaccttcaccccacccttgatcacaccaacagcgagctcataagccaaatcaacgcgcgccccaccgcacaacccgacaacaagagcaacacaggctttataatcagggctcaaccctctgtcaattaaacgacgccaaaccctagcagcctcgtcaaagcgtttagctttgcatagcgcgtcgataataatcgtgtaggaaacgacgtcggggtctcttcccttggaggacatggagtggaagagttcgagggcggtttctaagcgattttggcggcataagaggttgaggtaagtgttgaaggcccaaatgtcggggacgaagccgagagcgtccatgtcgaggaggaggctgtggatgagggggaggttaatgttgtcgggggcggagcagagggcggagatgaaacgggagtaggtgaagggcaggagggagaagccgcgggggatgacgtggcggcggtagtagtggtgggcgaggtggaggcgggagtggcggaggaggacgccaatgaagcggttgtagtcgacgctgaagacgcggcaatttgattcggtcatttggtcgaacaggtggatggcttggttgatgagaccggctttgaccaggttcgatatctgagagcggtatgcgaggcggtgtgcgccaatgctgctctgatacatatcaatcaaaatccaaaggcatagcaccagcaatcgcccaaatccttattcattcaccttcacctccaatgctgcctttaataatattatgcaatgcattccttcattcattgcacgttgagagttatgaacgcagtaactaaagttataaagaggcacaccacacctactgcatggtgcgtgcgcgcgtgagtggtgacaatggtggttgtttgttttccctattctcttctcgctccgactgcaaccggagggaaccggaggggatgggagggaagagaattttttattttctttttagttttgtcttcattttaatgctattttgtctctaggatttttttcaattttgtttatctctcttaggaggactcgttttgctaaatgttgtattttgtattaattatttttttaaaaaataaccttaattacttaaatgatatgaattaaaaagataaatatattttctttttttaaaatgggagaaaaagactaatacatattaatcaattgggtaaaaaataattaaatataaagaaagagaaaattcaacaattttaagaataattttaaaacatactatataaattactaataaatttaatattattaactaaattaatttatttttaaaaaataatcttatattgagatattagtatttaagtagttaactactaagaatgtttttaggcaatatccctcaaccctcataagatgaatgattgtttccagagtgccaaaacacattgggcacacctcagtatctcccatatatgccttcgagatctctggacatacattagttaaaaagcaagttccttgacactatccaaatatgcattttgatcctttctggcacctgtagtcaccagatcgtttcaaaaaatattggttagcatcattgtttaattttaagttcttataacaagcttttatataataaaaacttgttggaaataaatcttaattaaattattttcccgaatgaaccctagatggctaaaaatcataacgaaaactagtcgtaatacaaaaccgaaacaagctttcgttgtatattcaagacgtaatacacagtggaaatcaatttttggttgcagttaatttgttcttttatgcgtgcaatgttctttatttaattatgggttaaatatgatattggtcctccaaaaataatagattgtaacaattgaaagatataaacaagaaagcaatgttcctccaattgttgaaaatttgagaaatatcctaacattgtaaagaaaaaaaattcaaaattgaatgagtgatatgtaagaatggtaaagaaaattaaaagtgggataaaaaccactttcatggcatatagaaggaaaacatgtaccataatgtcaattgaaatttaagaaagtataaatgtgatgtgttgcaatgtgcacgataaaagaacaagggcataagaaaagaacgacaatggataccaaaaaaaactatacgaacatgttgtaatgcttacaattaataaacatgttacttcatgatttattgcattttttgtagcaaaacgtgttttttgtcgcgacaagatgattcctggaggagacgaagaaccacaacactctaaaattaatggagtgcagggtgaactcaccaacttggagatgaactcatgattttgagcaattctacgtgagtttatttgagttcataaaaaacgtttccacaatcaatttaactccatttgcatatgtcaatttggatgaaatttacgagttaatactcgactttgacaacaatggatgaaccaatggtgatgttgggtcattttcaaaacttgttggtgtttttaggctagaaggtggtatgtatgccctagaagaaaaaaccgttgctctttttgaagaacttttcgttatttcaaatgtccttttcaattcatcttttaataattgtcaagcatgcttaaatttaaatttcttacggtcatttaaagaataaataacatataacagtgacattatcctctaatcttatgtttttctttctgcctacaacaataaacagttgtaatttgagaacaacaatatagcaagaattaaaattaacttatagagaaccaataaaatgtaacttcagaagaataactacaccaaataatattggcttgaaaagaattgtgagttgaatgtaatttgaagcacaaattatacactcaccagaactcacaaattcaatcgcaactgtaattttgttacaaaaaatattcatattatttttagctaggagtttcaacagtaacttttcctaaattatgttaaattgtgcacaatgataattttgctaaaacgtttatttcatgtttagcttctttacgttttcccatcaaattttcacattcatgttcatttcataacatcaaagtagtttattgtgggagagccaattaagtttcatacgatggaaaaaaaaaattgtagtcatggaaagtttgtatttcttgggataagtgttggactacaataggcctgtacgcaccagatttttttttttttttaaaaaaagacatcccttttagttgcaggtccgatctatctcctattccctgtcgacatcgttgcgctacttctcatcggctttgtcacactcttcatttccggcatcgtcgtagtttggttctacaatggcttctatatcctcgacaacaacttgcaaagtctggattaacctccattgtcctcctccaaccattatacatgtgtgggtttttttttccccagatctagttgttgttgatgtatgttttctcatatatgttcatgtgagtgtttgatttgtagatcaattatgggttgaactgttaaggaagcaactctgacagagagagattggtggtgcgaattcggatagccactatcaaagcgtcagtttcacgacggtataaatggcagcgaagtatgtctatgatgacaaaagtctttgtcagtgagatgtgtgcagtggcatcactagcagtggtggttgcttgaggggaggaaaaggaaaggaacgacgggagagaggttgttaagggaagaactttgtcaccgtcattgcaaaagtcattgtcagtggtggttgggtgagtcatcgggagcaggaaaaggttgtccaatcttaaggccttgtcatcagcgacaaagggagaagagtgaatgtggcgacgacgatggaggaggaatgcaacgatggcaatgaggagaagaaacagagacaataagaggaagactagaagatgggatgttttttctttaaaataaagaaaaagataatctagtataggcaaatctatggtggaactacacttatctcagataaaaatcctatcctacggaccacttatgtctcccgtcgtgggagacttaaaaaggtttaagtcccatatgttagcttgcttctcataatgttcccttattctttttccatattcactttaagctctttttcaaaatgttatctcttactttctttttcactcaaaatggtttttcactcaaaatggtattaggcaaaattgcttctctccattatgcttttacttcaatacatttgttttttaaaaaggcttttgagtttaaccatttctcttggtcacatctatgatcaagataggttcaacttgttttcaattcagtatctttatccgttttttaagaaattcgaatttctaatgtaaattaggtttaataatattggtgtgttcaagtctcttaaacatctctttacaagtttaagtttctctagcattgatcaccatcaagtatcatgttgtaaaaagtgagtttaattttttatttttgttgttgtgattttacaagtgtagatcaagtttgatttgtcatcaatgtatttgagtctccaacattagagttttttttagaataaatcatcaccaagttcatcattgcaatgaaagtgagtttaattttgtgatttttttttttgtgactttaccatgaatgaatgtgattttgtgattttttttattttttaattatgagtttaccgtattttagttttattttagacaatgagttgattgattttttaattattttttctcactctttttttattaaaatatcatgaaggaataatttttttatataaacaacatatttataaaaaattcactttatttgctctgaccataaaatttcagttaaaaaatgttgtataactataagaaacccccggtcaaacaaaaaaaaacttaagaaatcacataagaaatccgttgaccaaatttgagtacaaaaaaatatactcccattatatattgaaatattacaaaattttgactaaaaaaatatgaactcttttaatgatgttttaatgttgttagtataaaaagaatttttcagatgataataaaatcaattcaaatccatattctagaacaaacaattatttgtctggtcaaacatttttcattgtaacatttaataataaagaactattataacagtttgactactagagatggaaaaaaatcaagaatattaaaaccgtttaaaaacacaggtaatgatcaaatatatataaataaaaatatggagcgatataattatatttatgttctgatcacttttataatttgatataaaaatatttttattcattaaattattgaattgtatttatatattattaagatcatgtatcaaattctattaaaattgaataataataaaaataattaaataattaatattttaatatattttaaaatttatattactatttgtcgttaatctatataaatgaggtattcaattattttagattcatgtgacattttgcaaacataatatgtatataaaaattaatctaattaaatggtaaattttaaaatatattatttaattataaaataatataataattataaaaaattatgctgttataatttgattcatctacgataaaaatataacgaaaattaaattgggtagaatttccttcactagttttttaatgcacattacaattgcaccttatataaatattattaaaactgatgatataattaataggggaggaagaaagtcaattaaaaataaattaaaatatgtgacaataaatgcagttttaaagaggcacagtatttattattatatttaagaaaaaagttccaaaactgaggtggcactttgacgcattatgtctaggtcaaactgaatgaccatgaccactcagccccacttttatttccatttctcggcaaactccaaactcttcttcacttccctctgcctcttctgttttacacacataccccaccgctttctctcttctctcttcaagatccaaactttaagtgcctttgtgtgaattctcctctctttataacaagaacgagtcagaagtgggtcaccgtcaatggttttaggtgagaaaaaactcgaacctagccgcaacacaacacctaccaataccataccgtaaccattttttttttaccgttccaagcttttgctttcaacccattattacttctgttaatgggtttgaaacccaattaaaaagttcgaatcttgtcgattatccatgttaggagaagagagtaacaacaacgaccgcggcggcggtcaccgtagaacaacacattccctatcaatttcctggaccgaccggtctccggttacccggaaaccgccgcgtccgcttaagcctctcgccatcaacaaacgcagctttttggagtggccgagcgccggctgcgacgatctcggcgattggtctcttccaccgaccccaagaggttccaccataacgccagattcgggttcgggtaaagtatttcaattcaagaaagactaccatgcgttctacgacaaggaatgttcgagaatcgcggagcacgtgtacctggggagtgacacggtggcgaagagccacgagcttctgcggcggcacgggatcacgcacgtgctgaattgcgtcgggttcgtgtgccccgagtatttcaaaaccgacttcgtctacaaaacgctctggctgagggactcaccctcggaggatatcaccagcattctctacgacgtattcgattactttgaggatgtccgccaacagggcgggcgcatgttcgtccactgctgccagggcgtctcgcggtcgacttctctggtaatcgcgtatctcatgtggagggaaggccagagcttcgaggacgcgttccactacgtcaagaacgcgcgtggcgtcacgaaccccaacatgggcttcgcgtgccagctgttgcagtgtcagaagcgggtgcacgctatgccttctagtcccagttctgttctcaggatgtataggatggctcctcattctccttacgaccctcttcatcttgtccctaagttggttgatcatccttccccacgcgcgcttgattcgcgtggcgcgtttgttgtgcacgtgccctctgctatatacgtgtggattgggaaggattgtggctccgcaatgtgttgcaatgctagatcagcggcttctcaggttgttcggtatgagagagcaacgggggagattgttagtgtggttgaggatgaagagccgaaggagttttggattgctctttctaccaaggaagtggtggtggagaatggagaggtggagagaatggagattgatgtggggattcgtcccaggagagttgaggagtatgatttggattatgggatttttcataaggcgcttgctggtggggttgttccacctttttctttgtctaatgctggatcagaaaattgccttcccgctagagaaaatgggtgggggagattgacaaggaagcttgctagtggtatcatgaaaggcttgttcacatcctctaagtgctgtgaatctagtgtgaacatcattgaagaggggaatcaacataagaatgttgatccttttccaccttcttcgaacaatgtgggtggctcgcggggttcctttgagtgttttgtagataatggctcggagagggtaaaggataatgttcaagtcagggatcagtttgttgtccctagtgttgttggttcatcaatgccgccaccatcgcctcatcatcgagcatcggattcttttgcttgttttctgaggagcagccccaaattcagttccaagtcgccaacactgtctcccaccagttcggattatgcaagttcctttacattttctccttcatcgactgaacccgttcatgtgaaagacgcatcttcctcagagagtcgctccttagttaagaaagaaggtgaggcatttctggctaatcacaccttggtaggagcaaagtccagtttgccgcgcaaaggaacttccctctccattgcagagcgcagagggaataacccgccacctcgcatgttgctaccctcggccaccgaatcatcccgtgccagcaaggtccgggtaagatccaggtcattctcattgcctgccttggatgatactctgatggaggatgttagttgcaagcaaatctaactatgaaaacagtgggaaaacggctaatatgagatgttgatattattagtatagctgttgagagtaacgttaatggcagaggatcattgtaatatggtactgtgtcattttaaggtaggttgttatgcttgaagtagaagacttctaagagaaagttaactttattacagtggttcagtttcttcctgtatagataatatagccatagttggctcaagtgatctatttttggacgtgaactttcactcctgtttgaatattggtgcatgcctgcaaggtgtagtgtaggctgagcaataaaaaccacacaaaacatgcaggcaatgcactgatagcatctcaagtacataacaattatcaaatttaagtgaatataaagtctatttttctctttggctgttcttgttcttgtttgttccagctactagtcagtatgaatgatataatattaaatgctacatttttaataaaaaaaattcatttataatttcaaaatcattatcctttgaaaagggcaatggttagcaaaattgatataaaattagtgcaaaagatcacctttgtagggaatcatgtagcagattaccttgttttagatgtaatcatcttcctttattagttactgtttccactaaaaaattaaaaccaagtttcagaaacaacatttcatttacttgatggtgccaactgccaaatggtttattctaatttcgtggtttatatgaatggcatcaattactactgtacgtccaaactccaataggattctctaacttgcaggatataatcttaacagtaaatgtatgtgaaccagtcatctcagtcaaagtgaagcatttaatctatgaacacgattattctttacttatttaggatacactgggagactttgtatagcagtggattcgatttcctacttaattttatcgggcatgcacctatagatattccaaagatgtattataatactccaaatttctttccaaatatatactgatatcagaatctgataatgagatgaagcatgcacggtaaagggtcatgtggataatttgtcctaacgttgaaacatatgtaatctgtgcaaaaggaacaaacagagcagatatagcctttgaaagtggcatcatgggaccatttccttcaaagagaatcacacgacgcgacgtatttgtatttctagtgtgaacctttgttagagacatgcgaccttttacttaagatgtagtggaatgcaacttccttcagcagtttgatttcccaccagttgtttatcaatgccaccgttggttgcttctgttgcatcaatcatcaaaagtgaaaacgactattttgctgaatcttagtttccaaccatgtgcacatttggccgtttccaagtactttgttttttttttgctttttgtataaatttggcccctttaatttaaactctgtgcttttttaatccctagaaatatgtagttagttagagaagagtggcctttttacagctgcttccactgcaagtcaggttttccctaccgtgcttattcgtttagtttgaagatgccaagctaaaaaaatcagtgcaaatattaataattaccaaccaaatgtagagcattttacactcgactgtgaggttcgtagccgttattatatgggaatgctgccaacctaccgttgagtctttattttggtcaataggaatcataacagtatcacaacacactcatataccctgttaaaccagttagactccgttggtacctacggttgaatcttattttagttactgtatcactagtttttaaataattaagttataatttgtattcttaaatattttgcaggtgccaaaggttcttccatacaaatcaaagaacagtggctgaacgagtcaagattccattcttcatctacttggactacctcttctattttaatactggctataaattgaagatcaggacaggaccgtacaaacaagatgctaattaaggtgaatgttactgtatcacaattggtagggagtgatttgctccatccacctaccttcttttcgtttttagtacaactaaagcacaaaagtttataaacataaaatatttaacaaactccttatgctccatgatacatcactaaacttcccttggcaacttaacctttctactttttcttcagtgggagagaaaggatgacattgcttagatcactccacaactcaaatgccttctttgatcatagtccgggaaatgctttacgtgttaagtagactttgcctgcatacagaccacatcaaccacgtcagattaagattctagcccttataggaagacgtaaatgaaaatcatcttttgcaaaaggaggagaggtggaaataacaacaacaataaatacatagtttccattattaagtaataactcaaatgatatcatgatatccaaatagtgctaaattttagttgggtaaaggaaacaaatacagaatgctttaccaacaaaattgtagaaatgtagcatcttgcctcaagaaagttggattgaaattatttcaagtgcaaaaaacctcctagatagttttagaaaatcaggtaataaattcaaaaaacattcccaaattccgtttttttattttttataatggtttgggatccatatatgaatgacagcaaagagttttgatgagaaagggaaaccattcataaaatatccataacctggacggtgatcctaactcattttgtgttgacaatgtcaacactcttttcactgaaattttagtcccaaatctttcatataattcaaatctgtattggatggagctgagtattgcgtacatgcaaaagcttctccgagtaaactcttctctttgcaagcatgactgttaggatgacaggaaccattgcagcagacaaatgcttaagtgtgtgaccactgacaatgtgaaaagtcagtatataaatcactctatcggcagcctcttgcagcatagctagaagataaaatcctgtcaagatttaaaattgaaattcagggtaattgaaaatactatctacattacatagaaaaagctattataataccaaaagtacaaacctgaagcccagagccaatatgttgaatgcgtgtacataggaggcaataaagtagccatgagaggtatggcaatgcatgatgcactttgggccagaacatataaacggatgtcaccaaagaaccttcattataaatgaataagtgagaaaagtagcaactattctcaagagcaaaagttcagtaaactggatgctcagttaccgaagggttaagaactagcctaattttgacattatcttaatcaatccaagatgtttccactcacaataaatcctatatctttatgataactgcatttatagaattgacaattttttagaatagttagatgcagtttggtgatgcttttactgttattttcacattaaaattggagtatcaactacagaactcacacaacaaatgttgacgtgatgaaactccaactttgattaaagaacagccctaaaagcatctaaagaactggaactaagttttgtccaactttttatccgtatgaagagcaattttgttcacttatagaaggactgcatgtatgtatcaatgaaaaaatatccaactaatgcaatagggtaaggggaaaaaaaaactcatgcaaatagaaggaatgaagaagtaggcttgcctccaatacacattgctcattatgcctgccataattagaggtacaattgaaattgttcccttctttgtatcaatcctttcaatgatgaggattgccaacagagacgcgaaagcagcagacatctccaataacaaacaataatcaaggaatcaaaactatgaaatggaagaatatagatttctacagcaacaatggctgaattgaattcaacttctataggagaaactcaccggcaacctgtcccacacaaggcctgcatcatctgggccaagatgatagtatgaagacccaaaagcaactgaagtcacagcaacatagaagcatgtccaaccccatagttcaccttgcaaactgatgctacatatcttaattatataattgacaacaacaatcacgtaagctaaagaaaccgatggtgacaaaatgaaaatacctgatattaaaatagttcctacggtggcaaagcacaaggccaatgagaccaataaccatgaatgggaaatttgatatcacgttaggtgcattgggaatgcctgaagaacaataaaaaagaggaaacaaataataattttaatattctattatcgcaaagatttttacattgtgaacttacaatgatgtcataaaagattttcacgtgaaagatttttgaaactggcaactaatcacaaatacaaacaacattatattatatgaaaagtttgtccgtttttacattaagtatattaatttcatactcatgctaaccataatttctaattagttgatggattaaatttaaatagaaattgaactcttttaaatttaacaatattacattatacgaaagtttattattagaaatccttataagtttgttcactcagtgtaatgtattctatttaaattcggaaaaagaaatccttctgtttgtttttacttttcaaaatttgccaacaaactgaatggaaatggaagaccctcatctgctcagttgacataaactcctctacataaccaagtttacatttttaaggttactttactggaaatgaaaggctaacaagtagtttttcgtaaggaattaccaaagaattcgcgcttgtcagcgaaatcatggtatctctgaggctgaggaatggacggggttaagaggatgagtaaaaggaagaaagaaatggcgagtcccaatgcctgctcagtgcagtttctcatttttgttgcagaatagatggaaatgcgaggaaagagaacgaattatagagtgagacaggtgagtgaaagacatcaagtacgaggaggaaggtgctggcggtggcggtgggcggtgtggaggtggtgaatggcgccatcggcaaaacattaatatattattttgatgtagatgaagtgagtagaactttccccaaaatccttcattttattttgagtaaataacaatgcaacaaaataatttcttgcgtattattttccaattaatattgatattatacgcgtgacaaaaaattatcacttaaattttgatgagaaaatcatactaaaaacactttaaaaaattgtattttattttcataagagtaacttccctccaagtaatttcaatctttttttttataaaaaaatacactttagaaaatttggatttgtttaatgagaacatctcattttaaaagataaaataaagaaaaagaatacttatttttttactaataaaaatgtaaggatgacatattgatataatgaaaattttaaatttagttatcaaatatgaaaaagtgtaataattttatgaaccaaattgataataagttatattttttaaggactaatttagtattaagttataaaatttaggaatttaattatcattaaattgtttgtttgattaatttgtcataaattttacatatttaagaactaaatttattttttctatttttaaatgattcaatgtttcatgtttttaacgacaaaaattgatatttaacttgaaattttggttactaataaaataaatagttgttctatcaaaataaaataaatagttgttaatattatatgcagaaattattcaattcaacaaaatatgaagataacacgagtaacaaaatattacttcaagttgattaacgtgtggattcaatgacaataaatgcttaaccaattaaccaaacggacttgttattgattccaatctcatttgttattgatccctacaaacgtgagaaaaaactttcttatccctctctctgtcccttcaccttcttttcaccccactcaacccatcaccaccacactaagcctgcgtgccaccaccttactgtgtgacatattggcctcactgtgccaccatctcctcaaacggaacccttttcgtggtattatttgtgggtgaaaataaattacacagtcatccatggcctacatgagggtgaaaaaattacacgataaaaatgcaattctgtcatataagtataattttttattacaaaatcacaattcttttatgtctatgtcaaaaggacattttggaaatattgttaaaagacacacagagtgatagtgtcaatagcaattccctactactaattttgcactttgaatataaaagcggttccttaaaagttaaaaaaatgaataaaattttatattaacaagttatttaattcacaaatattttttttctctctcttatatttaatatagttaaataactatcaacaatagttgcttcttaaagcaattctctttacttttaagcaacttaaaatcatatatatactaattgtttatttttaatttttataagcaactcattaggcagttctcaatgtgatgctttcaggttggagcacattgttcgcagtaccttgggtgaaaatgcagaacggccccctcttaatttcggccattggccctgcgtagataacggcatgcaagaaatgagatttaactgtaagtttgtaactatctttgcggaagtttttcatctttaagtttgcatagaacgcgtaacatttccccgcttgtttatatgaagaaaattgcgcaatttttttcattacgagaagtagattgattaggagagcaaatgaaccatatgtaatgtaaaccgcttcgtgccaaaattaactcggtttaagctatatatagcattggtctgttcctttccccagctactacatgcatttttttattttttttttatgttaggtgactgattcagttcctatttttctcaatctaccaagaaaaaatccaacgaatacaatgaaacggtggttggatgagactctatcacgtcatatgtcgcagggttggacaaaaaaactcttatccataaaaaatttatattttaattcaatttaatctattttaaattcattaaatggattagtttcatatccaaattcatttttttactttaaatccaatccaattaattagatatgaaatggatatggattggatatttatttagattttcaaatctatttttttgccaactttgattgagattatttttttttgtcgacgtcaactaatgatgattttaagccgtcatcgttgagggtattttttcgttaatgttggtaaggtttctttagtaaacattgattgagactattttttgccaacatcagtcgaatctattttttggccgacgtaagctaggttttttttgttaatgttggtcaagaatatttttatcgacatcaagtaggattttcgctcgacgtcgtctatggtttttttgtcgatgttgagcgaaaaacctacttgatgtcgataaaaaaaaactcgacaaacatcgacgaaaaaatctagttaacgtcagccaaaatatttccccaattgtcgccgatcaaaaaatcctaattgatgtcaacaaaaaaatccctagctaatgtcaactaaaagaaatagtcatggttaatattgaccaacaaatcctagttgttgccaacaaaaatatagttttaaccaacatcagcaaaaaaatatagttaacgtcgacaaaaaaaaagtcctgacgaatgttggcaaaaaaaatattaatgattgacatcagcaaaaaaaaaatcttatcaatgttagttacaaaaatcttaaccaatgttggcaaaaaattagtcactatcgatgttgataaaaatctgtagtcaatgtcagccaaaaaatgcactgactaaaaatctttgccgacctcaaccaaaaacaccattggtcaatgtcgactgaaaatgtactgactaatgttagccaaaaaatagtcttggttgacgtagatctaaaaatgtctggaccgatatctgtcgaatttgctttggttgaggtatgccaaaaatacacaatattgatcaaaaaaataatcttaactaagatcggttgaaaataactcttaaatggacaggtactaagttttcactttttagcatttaataactaaaatctgtaatataatatttaagtggatataaattgaatatatccaaatgcatatccatttaaatagattgaatcttaaatctaaattgttttcttaaaaaaatatgaatatggatttaaaattcaatccatttaaataaatataaattggatacatattggattctaaaaaattcaatccatgctcacccctaataagtcgtaattaaattttgttaacgtatcattaaaatgatcatgttccaattttaaaactttacctatatacagaatctcatttttttattcgtattagttacccctaatacgtcgtgattaaattttgtgaacatatcattaaaatgatcatgttccaattttaaaacttcacctatatacggaatctcctttttttattcgtattagtagaaaagttttggttaaaaagcaacgatcatgttccaatttttaaaacatcacctatatatagaatctcatgtatttttatatattagacggaaagttttggttaaaattcaaaaaaaataaaaaacacccaacgcacctcactctaccaagataataaattatatgagaataatttagatgaaaaatataaaataattttaagaaaggagatttattttttactttttttagtgtgagtacatattagttgttggaaaccatttcggttcgacacacaggatcaagtcttgagaaaaactttatcaaaagtgattttatataaacagtaaattctccttaatgaacactgtatagagtactagtttttattattaattaggtccataggaagaggctaattccatacaaaatgataaatcacgattcaaatattaagagagacgctttttttttcctcaagaaggatactttgcatgcgaaaaactaaaaagaaaaaaatgaaagagaagtttttcttcgacggttagaacacggattaactatgacttcggtatcatataatcataaaggtaaatgctaacaagtattttaaagatattggttaaaaaaattaaagtaaaagtatttttattgaaagatgaaaaattgtattatttatgtttattttatattttcttatgatttacacaaaaatatttttttggtttaatatttaaatcaatgtcttcatgagtaagacccaaacataaatatagtagtaatttataaaatgtttagcatttaatgagttgagaaattatctagaatagacaaagattaagattaagaggcaaaaccaaaaccaaaggaaaggtgttttactttagctgtatctttgtctgtgcggaggaatctacgcccacgcgctccaccccgcaaatttatagacacatgcccgacagcaaaccacacatgatatcatgttctcacatcgcatgtgtgaaactgacccctcttcaactcgtcaatttttattaccattttcttttctctcttctttttttctctccctttaccatataacaaaatttccatttcaaactacaaattttcgtgcacttttttaatcaccgaaaccgttcttcgttgatcgtcacgaacatgcatacaaatccgaattttggaatgaattgcaaaatttttggaggtggcagatacgtttactcctctgcaatcgggatcatgcgcgtagtaacgtaaacaagtgtcaagggctaaacaaggtcgcgacaaaaccaaaatgcgcatcccttcgaagaaagccacgactgtgttcaagtaaaagtctgaaacagataaacgtcaccgttattacgttgctttcaatgtcatgtgataattatgcatcatgcacacatatatatggttcacaacgcatcaacgcattatcattactttattctattatatttgttatttcgaatttaatttattataacttataaataatgatgtactacgaagttggagattttatcagtatttaactgagtgggaactgttgtttggtggaacagacgtgcccacaatgatgaagggtttctcagtgtccttatcctccttatgggttctccttgctctctgttctctgaggtatgcaaccatggaatcttttgcttctcttgctattgttttgttggttctgagtttcgcttgtgtagtccttaatgctacattttggatattttttaagatatgcttgattgctaatttctggttaataaattggaggctagaatccagagcctataaataaagtgttctgcttttttgttcattcacattgccattgcttgctgcttgagcttgtcaaatggactgattcacactggtttcattactctggtggatctgtgaagtgtgaacagaagtctgccttgtgagtgaacagaaatactagtgatttaccgagtattcaaaatttccactgccttttggaattattaaattgaatatgtagttgaagtgctgctgctgttgttgattagtctaatgatactcggataattcaactctgattttgcatttttagtcattgtaaattcttactcttaaagaaaatatctacttacatatttggtctcgaacagaaaatatttttattaataataataaagcactgttgtcattatttcctgaatttatatgaatacgaaaaggtatagagctcactcacatttggggtggatttggtattgctgggtgattttcagaagctggttttatgcattgctttaaatatagtatttggtagctaaatgtcaaaagctgtttgcaaaacttgcattgaatatcgtctatggtaatcatatacctatatggcaacctttaaaatcagtaacataataatgcaacttttgacttagatccacgatgtcaaatccaggaagcccaagtctggttaatttcaattagttaatttggagaagtagacttgaaactcagcataggttttaacattaatgtttactatttcgaatgtgattttgaattaatatagaatataaactagcttccactagagcagtgtgtggaatgacttttaaaccttacaagcaagcttcaattatgtccaaattaattgcagaaaatataagttgaaagtatattaaattgaaatcttatgttgttcaatcatatcctaagtgcaactagtattccttaatcttattcgtcacatattagacaataaaagtaaagaaagatataacataatatatatctgagtgtgtcatttcagtgtgttatctcaaaatatatctgagagtggcctacagcaagctagcctcccaccaagaggttggaattcctatgattccttttgctggacaatttctgaagaagaattcttacaaagtgctgaaatagtttctcaacgtctcaaggctcatggatatcaggtatagatactgcaaagaacaataacttatggatgatttaactgtgttagcagtgctttggttagatattgactgatttctttccatcaactcgtagtttgtcgtggtggattacctctggtataggaagaaagtcaagggtgcttatcctgattctcttggatttgacgtgattgatgaatggggaaggatgctccctgacccaggaaggtggccttcttccataggcgggaagggattcagtgaagtagctaatagagtacatagtttaggtttgaagtttgggattcatgttatgagagggataagcacacaagctgtcaatgcaaacacccctatcctagatacaacaaaggtgttgtttgcatttcttctatgacttgattatttttctttacttctgtattagaaatttgtagtgatggatgccttacataatacattttttttctctaaaaaaatacaaaatggcaggcagaatatgagaatattgttttatcttaattggaagttcttgttgaccttgatttcctcctcgtgcaatttcctagggaggtgcttatcaagaatctggtcgagtgtggcgtgcaaaagacatagcaatgccagaaagggcttgtgcatggatgcctcacggtttcatgagtgtaaatacgaagttgggagctgggagagcttttctgaaatccctttatgagcagtatgctgcatggggtgttgatcttggtaccagttcaactaatttataatctgcttattatgcactatcaggacttgcatcatgtcacagacgacaatcatgatgaatttaaataatttcttgctctatcttaatctaagtttaataactcaaacagttgtactgcttttttcatcaagagactaagcagacagaattcgtattttagtggtccaatagatatcaagtaatgttatcatatcaaggaacttctattttcactaaagataaaaacaacacagcctacttcattgggccacacttgtaaaagttagtttactgcaatttcctttttcatccattctaaacctctaaaattgtgtcggccttttaaacattgttatctctatgttctagatggttcctttttagtccttttcctcttcatctcccccctcctcctttcccccttcttagcttttaccatttttgttttttcaacctcctcgtatctatcattgggttcatctaccaccgattccaattagtttgggttaaaggtgctgttgatgttgatgttgacataggaaaaaaatgcaatagaaattagttagtggactcttaactggattttcattatgatctatgagaatacatatatcatcattttggctatgctttggcagctatgttgatagattttcttctgtccttgcagtgaaacatgactgtgtgtttggtgatgacttggatttaaatgaaataagctatgtgtctgaggtattctgcagttccctctccctcttaccctctccactacctctcattctcacataaacactgagattggtaatatttttccaatgatttgttggctaatcgtatggcatgtcatgacaggttctcagtgagcttaatcgccctattgtgtattctctgtctcccggaaccagtgtgacaccagccatggccaaggatgccagtggactagtcaacatgtatagaataacaggagatgactgggatttatgggaggacgtcaaggctcattttgatgtaacaaggtgattaagctgtctatatttctgtttaagattttttttatcagccttgcagtatgttgcaatcatgctacttctctgtatacattctgtcataaccatattacagaactttagttcatttaattctgaaccagggatttttctaaagctaatatgataggaggaaaaggtttaaagggaaattcctggcctgatttggacatgctaccatttggatggctaactgatccaggtaatgagactaagctgctactttttcatttgcccattatgaatgtcaatatgtcataaccctcatactgtgcatgagttgtttattacttttatgtatgtattgatccagtaactgcttttatctattattcatttgtgtgaaccagaatcctcatgttattggaatatggattatggaattatttcttatccccctattctatctgtaggatcaaatgaaggtccacacaggtttagtaaactcactctagaagaaaaaaggacacaggtattgataaaaaaaagaagaagcataactgagttgctttcctatatattcatgtatctattttgatctgcgtacgtgcattatgataatagactctgagtgaatcaattcttatctggcagatgactttgtggtctttggcgaagtctccccttatgtatgggggggatgtgaggaagatcgatccaaccacatatgaagttatcacaaatcctaccgtgctagagattaattacttcagctcaaacaatatggaggcatgtgagccatctaattttttagggaataataggcacgtgaggcatagaacttatcatgaatcatttcactttactgcaatgacagtttccttacgtcacaagctctattaacttgaagcaccctggagggaaaaaaggaagacctaagaaaggaataaaagcatcatatagacattcattgggtttgactggctgcagtgaatcaaaggcgagtggttggtctattgaaagtcttaaccaagatcttgaaataatctgttggaaaaatggtttagaaaacaagcatcaggccactttctgcgtacacaaaagagaacttcaattcagattgtaatcatgctttatctttctattttccatttatccaacttccatttaaatatttgtgttgcagttaacaatagaaattgttacattggtattgttacagagatggggtgagtatgtatcaggcagactatcgagggaaacatcaattagttgcaactgacagaatgaagttttgcttggatgcttctccaaaacgaaaggttacttctagagagttcaagagaggtacattttctccgtgcagatgggattcaaatcaggtatgttgcagtccatatgtcatgtacaagagtagcgtgtggcccttaatctttaggaagaaatcctgtgtgtgattcattaaaacaacttcgttatgtgcatattattatttttacccctattgagtaccatttgccttggccaatttgtattttattgattctgttggaagctgatctatccggtcttctacagatctgggaactgaactccaatgggaccatggtaaatagttactccggtctttgtgcaactgtagagtatgttgaaggtaaaattttgtaatcattttccactttttagaaatagtttccagggttgcttttctttttccccatttccttgtgtttatcactcataaagcaaattggtcattcatgcagctaatgttaattctggtgggattcgctcttggatcgcaacaggaaggacaggtctctctctactttctaacaaacacttggatggatgtcaagaattttcttcttttctgcaattgcaaagcatcaaaattggaaaaatgctaattgcttaaataatcatgagtacataagaacttaaataacagaatttgcttaatcacgagtaccatctgactcttaaataagggtccaatcaactactataatttcatccacttcaccctctaagaggagtcaaagtcaaatcctatattaattcatttatattaatcttatatatctattcaggggaaatctatcttgctttcttcaatctaagcgaacagaagacggagatatatgcaaagacatcatatctggctaaggttcttcctgacaaaagcatcacttcatgcaagggtaaggaagtgtggagtggaacagacgtaataacaacgcaggggacgatatcaatgaacgtggaaattcatggatgtgcactatttgttctaaattgcaactagtctggcatggcttccaattattttaaacagaaaaggataagaaaatagcatctcattgttgaggcttccccccctctatttaattattactcttcctatggtgggggttaggtgaaatttgtatatgttaatgcagtgtggtgcggtacgtaactgttggatcgcaccgtgtttagacaaactacataggaaattatagttgtatgttagtcagcctcatacctttctaatggttactttgaaagaacacattttattttttaaataaaatcgtggcctaatagggtaatgtacctatgtagtggtgttgttacttgttagggctccatagatcagtgtcatgaatgtacgatgacttaaagaacatgatggtctgtactgtagtgaaaaccaaaacgaagtatctaaactggaaactacatgcagttaggaaataaaaaatgctcgtagtgagttaagcaaaatgaccatcaaaaagtaacaacagaacagagtaaaaggccaaaagcctacttgccactaccacttaccattcagtgttatatgaaacttgcatctttttgtaactaaaaaagaaaatttttgtttatgtctgttagaaaacgattgtttgttactttgtggcccccttgaattaaggattcgaaaaaaagaattaaggattcgaaaaaaataaaactgcaccgaaaagcaatcggattgtgatattcacggccttttatgatatcgtcaatatttgagattgtggtaagttattgagagtgaaaaattcaagtaagagttttcacagaaaaaattgttgatgagttatttttttataggcatgagcagtcaattaaataaaaaggaaacaacacaaataaaaaaagaaacaaaataatctgttatcgaaaaataagattgtttaaggtaaaatattcttcgctgttcttcgttaaggtaggaaaattttatttcaaatcaatatttttaatttctttaatcaatactttagttttctgatgaatattaaacatgactaatacatttataaatttattaaaaaaatgttggtttttttagtataagttttatgtaccgtcaatattaaatttgtacggtcaactaattaaaaattatcttaattataattttaaaaatattttttataaaaaataataatcttattatatatcatatttttaattgaataataatatagtatttttacgataataatataatattaaatagtgtatctgactaaattatatatatatatatattttttctatttacacataaatatgcgcgctgatataagttattaaaatatcatattcggatggactaaatggacttttcacgtacacagcattagggttccaaaacctgactggtacataaacgactcgttcaactcaaattgccgcactgcaactttgctctctgtgaggcttcaatttccaattagggtttcgctttgagtaaccaataaccatgggagtcttcacctttgtcgttcgcaaatccggcgccgaatggagcgccaagcaacattccggcgacatcgaggcctccgccgactccacctacgatctccaacggaagctcgtgcaagccgctctcgccgttgattcctccggtggagtccagtcctccttctctcccgtgtctcctacctccgctgtgttccaggtacacattttcacatccctaacgattgtggtttcttgattcggagataaaacttcacggtttatgtttatcctgcgttcaacttcgatcctttttatttgtattattttgattttctagaatagtacattttctatgcgtcattgcactgtgcctgtttcgagtattgcttaggctttcgttaggctatttttcattgacgaatgtcctgaatccgagagagtttgctagtttggttcttgttattcatttgtgagattctgttgtggaattaatagtttgactttattattattttttctttattattttttggtttttcattcagattactctgagattatgcgctgacttgaagagaattataggttttagtgctatgacttgcaaagcttaatcattgttcattacctgaaagtatataatttgtgcacacataaaacaagtacaaatttagatctagttactttaaagcttttagtgcaattttgaaaatttgaagttttactctggtaacatttgctgatattttttagacaatttagttggtattaattttaaggatgttcttagacatgggactctgttatttacagagttcagcttctgtccattatagaaaactgactcttattttccatagttgaagctttactctggtaacattgcttagatgatgatcgaaatgaaactaattttaattggagaacaatacttaatacacttgtccgactaaatgaattattgtgctattgatgattgatggtggcatttctgccttgctggtttaacttttggattcaataattaagtgggtcactgaggttatttttcctttgttgattgttttgttcaggtgatagtgggtggtgctgtattcgttggaggtggcggtggtgctgttgcagctgcacctgcagggggtgcagctgcagctgatgctgccccggctgctgagaaaaaggaagaaaaggtggaggaagagtccgacgatgatatgggattgggactgtttgattagagtttttctgctttttattgagttttgatggaaaagtgtttttttagtgtttaatcttataaattgtgtttgtgtattgcttttcaccagttaatggtacattgaacttcgtcagatagagttatgtgctgtgacccaaatggttcttctgtattgggttttagtaggtattttctttttcaaacaaatgtctcgctcttcttttatcactggcggatagagtattgtgctgatcaagcggttttgctgttaatacgattttcttcttacatgttactggacaaacacagccatacatgtatgagaaatagtcttaacaaatatatttcctaacacttttgatacattggtaaaatttacgtatgtttaaaattgctttttctttctttcttttctcatttattggtagggtgctactaggacccttctaaatataattgcttgacataattggatcaaagaaattgggtggtttgcaagcagcatccaatgcattgaaattgagtgatacgccaaactaaaataccaagaatcaaactaaaatattttaataatttcaaattttggtataagtttcatatttacattctactttaatttaaaactttcatctcaattttatttttttggaagggaagatgaatttggcaatatgcattagcatatataaaaatattaggtgagaatggaaatccaaatgtataatttaaatgaatggctaaaattaaaataattttgatattctgatgcaattatatggttaagatatatgtataaggtggcaatgtccttatggagtatttggtgtcggtggaatactaagctctgggaaggaaggatggagacaagctcaatggtaatatctggagctatgtctgtcctgaatgatgggcagaaagctaggacagtgcaggaaggaaatagggagttggatatttcggaggtaatcataaacccgtaattaaatactcatggttttctcaattgctatgtagatacagccattttcgaagaggataataagactggagtgggtctctgcctaagggatgaagttagagtttttgttgcagtgaagacagtctggttttggttggaaactgattctaaacttcaccttcatgctttctctcatccgaagattgtccattggacactttacactagatggatgaattgtaaaaagttcactgacaattttaacttcaaaattattcacgtttatcataaagacaacttgtgtgtaaatagagctgtctcttttgggtatacttggtgggatcctctaccattttttgtttctcacgagtttcttaggtatagacaaaggctcacattttatagattcccttagtgttattccttgggtacccaagtgttttgtattttcgcttctaatgaatatatttagaggaggatcttttttgggagattaaaggttgggatgtcaacccccatctgtccttgatccttcgtctttctttctttacttttttttttttttttttaaaaaaaagatagcttggtttaaacctgctttgcagcctagagaagggaaagcacttgccctcttgtatgcaagtaaatgatgtgctgagaggggtgagcaacaagttatcttcaagactgatagcaaagtagtggtagaccaactgcaaaaagaagcaagagatttatctgaatttggctcgatacttgttgattgcaattgctcatttacaactttttctagttatcaaatttagtttattaggaggcatatgtgtatggccctaacttagctaggaaatcggcttatgcagctaatccgtagatttttcattttgcctttgattgtaatgcaaatgatattttaataagaatgatatgatgtacttctagtaaaaaaaatatattcttttcacatccaatgctaaatatataacgtataaataaatgataatataaacagtatcaaataaatattgatcatacaatatacgaatagttaagattgttagttttaattttaactatttatttgaattatacaatttacattgtttcttcttatattcttataaggatggtgtatttttaatcagaaggaaggctcaaaggtcgtacatcatcaggaacaacattgggcaattggtgaggaatgtcatcaatcaaagatatatcatgttctataaaagtaaggtgggctacacaatctgtcgctttattctcaactctatttacaaagcaaaatttgttctattcagcaacagagctcagtcttgaatcacacctgcaaagtagttgttgtcatgaaaacggttattattcgaagcatccacgagtcttttgcaatcagattcataccggacagattataaaaggaggtccgttgcagtttcaaggcccagccacatgtggttcataacaatgacgactgagtatattttggcaagtcctcaatgccaagttgaagcacttaggaactgtaggaactgtccacagcttcttccacaaatccccattcactgagctagagcagaaattcttgcggagaagaataacaagaattttgccagcaactgactcattgcctagactcatggtcaatcagaaacataacattgtgaaaaaaatgttaaacaaacataacttttttaataaaagaaggatctaatttttttagtgtgaaagaatgatataatagaaatgcaattgtagtatgaaaaatagaatacacgtgttcaagaaatcaagaattgttaagttcttaaaaacaaaaatggttaacattttctatcactcctttcaaaaacaaacatagagtattagccaattgattgatattgtgaaggaaaaaaaatgaactacactaataatgcattaaaatcaaacttataaaagaaagcaaaattactttgacaatgctattattattcaaatttaaactcgctgtaccatttaattgagaatagtgtgtacttatattagacatagactctgatataaaaaaatagcgtgtacttaagacattattattgttatttacaataatattcgaatgtcctttcttgatgaaaggttgaaatctttttttttttatatataaaaaggttgaaatctttctttgcgcgtgaagcattacattgcaattacttgacaaagtcttttcaaccaatcccaaacatgtagatatttagagacaagtactaataagttagttgagtgccaccaaagtagaaaatcatagtttatgatgtgttatgctaatcattcgctaattagattaacaagaattaagtagtcaataatgatttagttttgacattaaatagacgatggacatagagagggaccaaaacaacggacgacctttatgggaggccaatttaggccaagttagactcaataaacaaaatttcgaattcaatcgaatatattttgatttattttttttagatttatataaatatagacaaaaaatttaaagtgggttaaataaattgatccgagggttcattgaacttgactgaccaaaaaattagaactagtccacttcaaagtatttttcacacttgaacggatgattttcctagtggaatcatatcccaactttgattataatttttgttttggttaccttgggtcaggcttcatgtcctccaagttatcttgccgtgttctttctatgaatttgggctttgctattgaggcctgtatggtgtcaacctaattcacatcagtataatcacttatttttttaatcggcaaaagtataataattatatatagagaaagcacaagctgtgcaaaatatagtgtaccaggcatggacacctataagtttgcagcaaatacaacccacccataactatagaaaagtattctcccacgaacagaggttaatcactattactgattatacaacacatgaataatgattaaccaaatgtgaatatacccgcagaacaaaaatcagcaagtttatccacataacctcaagaaataccaacaaggacttcatcgcccatacatctgcaccatctatcaagacctcgagatgcctatcccaacaccactgatcgcaaccacttggtcttagcttagttttttttacgtaaaaaaaaataaatagaaactctacttttgattctttcctcaaatgctagtaatatttttctttatgttttatacgtttatggtaaatacagcaacagtgaatgaaagatttattatgatgttaaaaatattttaatataaataaaaatattgattatttcttaatctgtgtgctattatttgaaataaacatatgtttttttagactaaatattatttaatggtctttattattactttcctaataaagtttgaattaatactttcatcattttgatgattgatttgaattttaaaagatcgaaatttaagaagcataactttaaatgaaaaaagaactattacttcatccatctattataattattgtgtatatgagaaaaaaaattatccaaaaataattgtcattttaattaaccaattttaaacttaaataatgatgaataacaaaatttataaataaattaataatggtataagattatttttataaattttttatccatttattattatttttagcctgtatcaaataatttaggacaatagagggagtattatttttcatgtaaaagaatatgtaaagtaaattgaaatgatgcacgaaaaaaattgaaatggaagaatacaacaaaaagagtaatattatttacatatttttataaaaataatttttttaacatagtatttatttttaaaatttttatttatttcatttacataaaaatagttgtgaaattttactctataaataacaataagctacagaagaaggaaaaaaacagaggtcaaaacataactggtaaggtagtaaagtacacagaaaaagaaagtcaaaacgaaaaaataaattaaagtgtgatagctgcgacggcaagtgcttcaactagggttctagcgtacgagcgaatctactactgtattttataatataaaattaatttatgaaactctatttataattaaattaaaaaaaatgctaaaaatatctatggccttttgcactgaaaaattgcctaaaataaaacattaactaaaaagaaggtgggtaacacgacgacgcattgctccagggccatgaatacccaattggaatgaggccgtgaacccctcatccgcgcgtgagcaattcccaaacccacgcgcccacgctcccaaatgaaacacacactaatgttcccttccttcccattctcattctcaattcgcatcaacgcacgcacggacgctctcctaatccccttcctcttcctcttcctttgcatgttctcggagctccggctccactagcggagccccggctcagttcaaacccatttgcgaaaacaaaaacaaaaaactaaactccattttctcttccctttcgagatctcgaaatgtcgaaaccctggggcaacatcggagcctgggccgccgattccgagcgggccgaggccgaggaggctgaggcccaggctgcggccacggcggtcgagccccaaagctttcccagcctcaaggaggccgtgaactccaagcccaagaagaagaagggaaccaccatcacgctttccgagttcaaccgtggaggtttcgaccagggccttacgcgcgacgagatgctcgcccttcccaccggtcccaaggagcgttccgccgaggaaatgcagttaaaccgccttggcggcggtttcaactcctatgaccgctccggcggtcgctcgcgcgaccgcgacggcggcaacaacgaaggttcgtggggcggaggaggcagaagatcctacagcggattcgacgaggagcgcaggggtccgaatcctagggtttcggaactcgatcagccgtccagggctgatgaggttgaaagttgggcgtctgtgaagaaatctctccctgccttcgattccggtcgccagaatcgctttggtggcggcggttttggtggtggtggcggttttggtggcggtgctggtggaggcggcggcggcggcggttttggtggtgcgtctagggctgatgatgtggacaattgggcggttggtaagaagcctgttcctgttagatcttccaatttcggttctggttttcgcgattcgggagtggagcctgatcggtggacgagaggcggtccgcctcgtgaggttgaccggacggagcgaccgaggctggtgttggatccgccgcgaggcgatggtgtggtgaacgagtctccggcgaaggcatcgaataaggcgaatccgtttggcgcagcgaggccgcgggagcaggtgttggctgagaagggtttggattggaaaaagatggattcggagattgagacgaagaagacgagccgtcccccgagttcgcactctagcaggccttccagtgctcagtccaatcgttctgagggtcccgggttgcagggaaccgatgctgtggtgaaatcgaggcccaaggtaaacccctttggggatgccaagcctagggaggctgtgctgggcgagcgaggcatggattggaggaaaattgatcttgaattggagcatcgctctgttgacaggttttgttttgtttgtttttgtcaattgatgcttttatatttcttctttgatctgttttttgaacttgtaaatgttgctttgtttgtagtggatgattggtaatggtcttagattggcctctaggctttttgtttgaacttgaatttgtgtctgatcataccggatttgctcgcattattcaatagttgcataccaaaagttcttttgtccccattatgcaatgaccataaatgtgcttaagggtggattgttgtggtgtgttgaattagtttgatttatgggaatatttacagattaggcatatcatatgggcatgatttgtaggtaaaatttaatcaagagtgtacactaggattggattaaagcaatgacatttcattagactgatcaataaatggttgggaacggtttatttagagttggaaatgcttttggtagagattttggtcgtgttgttttatatagttcatgtattgttcaatggttactactctaattagacggtggtcgtttttttactactctaattagtaagattttaatgggagtaagagaagagtgtgaacatcattattttttatgatttaatagtaaatggttactatataatatatattctattcctagatcaagagctaattgtgagtgtcatatagtggttatgaaaaataagataggtatccatgtaataaattactacgttaatgaagcttccttctatttttctctgttaaattcagaactatatggtttgtaaagctatttgttgttatttcagttaaatcttatgaaagaaatcaaaccttcttaggatgatacatgaattatggatgccatagagaacttctgacttcccagtcaagttttatcatgcctgtaaaagacttggtatctgtaaaataattattgcctcatttctttagttattgaaaatttattgaatgaggacaatgcccatggtagatgcaccacaacaatcatgtgtggaatccatgtgaaaattatgcctgggattttatgttggtatatgtatacctctcacttttgattatcattgaaaggtttttatagttggcttctagtataaattctggggtttatttgtagtgaatactaggtcatccaagggagtgatacctagccccaccttctatatcttagggacagaatgaagcaaatatatccattgatattttttcaaaacagaaatgagttgagaaataaatatctgttggtgttagaatattaggggcatgtgttggatgatgaacactttttgcaaatgttataatcgtaattgaagagtcgagaggaaataaatagaagtttgggatgttgagacatgctttggattcacattgtcgattgctcttgtttaaataaacatactttttaggagaatcttgctttaggttgtttatttgggcatgtgtggagaagaccctattaggagagtagattagatgaggggatcctaatcactagagacaaaaggaaactgagaaaactatacgagaaaccattaagaaggatttagaggttaatggtttgtctatagagacatgatttattatagaaaattgtgttgtcatttgatccttgtagctgattagtgggaaaaggcttgattgttgttttatttagttctagtgttgtagagttgagattgtacttgcagaagtagtacttcttcaagttaaaaaaaaaactacgtatctcattgttcagaggttcctcgctatgcgaaggtaaggaagaggaatattgtatgcagtcttacccttgcatatgcaaagaggctatttccaaattcgaaccctgaccaacaaatcaccaacatacaactttaccgctgtgtcaaggctcaccctcaagtagtacttcttcaagttattggtataaatagtgtatcagacttatttttggttggttactactgtttgttaatttattttccccattctttttcttcgaatccggaaacaacctctttgcatgtgcaagggtaaggttgcgtacaatatccctcccccttacttgtgcatagcgtggaacctccgggcaatggtttttttttttatttattattattctttctcttctaattcttaacctataattccaacatgatattagatctgtatcttccttattgataaggatctgtcttttttgcttcactgagcttgtcaaagttgtgttttctgatctatgattttttatattatatttttaagtctccaatccttgttgtgacctaagttcgtgtcctaaacacggcagaatcaaccttggctggtgccctgctgtttaagtgaccaaaggtgggtggttgctggtgtttgcaagtcacttttggtcagcctgggtgagataacctgctggctatcgctaactggctgtttttctggctgcattctgttattgaaagctgtcctaggattactaagtttcagtgttatttgccttgggcttgtagtagttgtaccagtactagacacaatttctagtgtaaatagaagtattggattgtggtattgtatggcagatatttatcaatttcagtatattggttatctttctatctttttcttcttccttacctgaaccttatatttccaacaggtgaattgctaatagtttaatcattgttctatatcatttactcctaatagtttggcattaatcaggacttgctttcataaatctctatcatctctttgtttattttgttcgtcttgccagattatgcacaacattgctacataattttgtgtaattaattgtgaattgttgtctttcaaaagttctagttaccttgttgactcctgagttatttcaggcccgagacaatggaggaaaaattattaaaagaagaaattgataatttaaagaaggagcttgagaaagagtctacaataaattcaaacaaggaatctgcggatgaggctggtggagatcaaaccagtacacgtgcaatattacaactgaaagaaaaggagctggaacttcttatccgtgatttggatgacaaagttcgttttgggcagaaagccattgaaaggccaggttcatcggcaggaaagtcttctactttttctgataggccacattctagatctggctcctttgaggattctagaagtgtggattttacagacagacctcgatctcgtggtacaggagatatgtggatgcatcctagtgatgacagaagacagtttcaaggtagcagggaaaggggatggttttctggcagcagagacctaaataggtgagtaataagtgttattcatacattatttatggcaactggttgattttgaattcaattttgtttattctcttgtattatttggcatatatagcttttacattttgggaaaaagtgtttgagaatgttgatatttgttgtcctacaggtcaacgtcaagagatagatggtgaacagcagttttgtgtggattaagagttatcttcaacttttgatgaccagaacctaatactactattttattacttgtctttctaatcgttttgctcattttactccaggcaattggagcaacaatcattgagtaatggcactaaaacttttgcctaatctgttattgcatctcgaaacattgtaaatttgttttcccccttctggtaattttttgggtgtctggatgaaggcagaaagcctgtaattttattaggacaaaatttttattgagaatcttgaaacttactagttaatgttaatgtgataatgttctgaattctgatataaaatgatttttcttcaattttgcgtctgcacggtattgtccagtttagtgccgtaagattggtagcttaaagccgctatcctctacttgtaacattggccagttttagtatcatatttttgtttgaaaatggatatcccagtatttatgtattatcctgtgctatccttaatattggaaagtaccttttactccctaaaggtccttgactatggtttggagaatgggatgaaaagtgcatgctaagttatgattttattactggatcaaacaacccctaagagtttttaagtttatctgctgaatctgatatcaccaaccttgggaaaaagttttaaagagtgatatttgccatctctatgacaaaaagttaatagttatagtcacgtctagtgttgtgtttgcttttccataaactggttccgtaacattgtttcattggttagtttaaatatgcatcttcatacctacttgaaaagttgaggtgttagtggttcttttcatcaacggtggtcaaagatgggaagcttaacgtcgttcagctggatgatttctgacggcctgtggttcaaaggaaggggaagagactcaagaggggcgggagattttaagactagcgcttcttgtttagattttaaaataggagaatttaaaatttagcttattaatgttttaatagtatacaaataaaatcataagttcaagcaattgaaattttcaaacttattattagtaagtaccacgaataaaatttaatatttttcattctcttcaaatatcttttatatcagtacctagctcgatcaagatccaacatttgggacaagatgaagctaattcaatttgctgacatgatatattagtcttaatagctaaattatagaatttaaaaagtatacaactataaaaaaaaagtatataatatcatgttaaacaaaacattatttattaagtcagaaacttttaatattaatgcatagaaaactatgccttttaagaatgtataacattggaccaaattaggacaacttattaacttgaatcagtctttaaatacattggtctaatttcttaaacccaaatttgtcaaaagttccctaaagataggccagattggtggaacgaaatgcgtcatgaacattcctagttggaggaaaatgaaggagggataggataattgtttaattttttataccttatttgatttaaaaatttggaggaaaatgaagaaaaataaacaaagagactaatatttttcttctcatatttttatttttccttgaatattgagaagaaaagcaatttataatttttgaattatatagactaaattattccaagattgtattttctcttatccctgaataaatacataataataataaaatattttgatatagtttatgagtatacttgaagtacacactcattaatttagccatgcccaaaaatacggtaagcaacaaaaaataccacatgcatagggttatgaaattttcttttgttgttgttgcatatttaaacgtggaaaatgtaatgaaatactcaacatgcaatgttttgaatggaaaggttttgaggagggggtgatagcatgctttggacatggtgagaagtcggagtagataagatagatatacttaattgaatctcttttcttaatacaacttcaataatacagagagatgtggagcaaccaagagggtgaatggaacagagatcatacccaatttcatgcaaagatccaagtgtgaggattatttgggacggagtccattgcaccgaagctgctaataaatggatcttccaacaaatagtcaatggctccttttcagatccacctaactctttaaaaaggacttgttatggtaaatcatccatccacagcgattaatccattaggacacataaattcatgttcttgtaagagtgaatttcgatccatgtgcttaaactgacaggtcttatttagtgtttaacgaattatgtttggcaaattttatttatcattgatgtatatttaatgacatttagcatgttaattattattattacgtgttaaacagggtcttattaacgtgctaaattaagattttaacatatacaccttgcaaagaaaataattcatagaccttatgaaacaaaaaagagaaatataatcaatactataattttttttgtttttttttatttcctttattcttgtgagttttgattgctcctattttttttaaaatttattctgatttttattctttcaaaattagtattttgggcgattcatgattgtttctgattaacgagtcattttttcgcaaccatgtaacattttataattttatgtagacaatttaattaaccttttggtcactctatttatgtttggtctttatgtaaatacgtaattaataaccaaaaataaaaaatgtaaacactcagctttgcctttttcttttattttgttggtcctttctttttgtactaaagaacgaaatttaaattttcctcttccttgtatttgcttgtcctttttatttttatgttaactagagaaaaagaataaaaaataattagttttttttatctttccattcagaaaacaagaatgaaaatacatttaaaattaagttaggtataaaaaaaactaagacaataatttaaaaaataaaacaaaaatttggaacaaagagtctgaaaaaggaaagaaaagaacaaaatacataatttataatgggatgttaaagaaaacaataaatgatggcgataaattccttttgttctttattttttacatttttttattgataagaatcaaaagactatataaaaaaaaattacaatagatttatataactatttactcaattagattcctggatagtatacaataaatataagataaatatttattttatttttaaatgtgtaaaaatcaggacaatttaattattgaaagaacaaaaattgtcattaaactgagttataagaaaaatgtaactatagcaaatttttagacatttaagaattaaaatgaggatgagataaaaaaaatagtagttttttagattgaagagttgttgtgctgggataacatacttccctgtagatgaatggtagaatgagaggaattgacttatctccacacttgttgcaaggaacgaactgtcctgctacgccaaaatttagttaagagttggcagaatttgtgattggtttgtaagttgttgtaagttaggtgtagctaaggcaaatgcttgtctcaggtgtcactcacactttctgccccttcaactccaaatcccaccgcccatttttctcaacacacaccccttcgtgcttcctccaaaccatcaacgctaaccctacctccgattccgatgacgccctccgcctcaccgttccttccgccgccgcagtcgccgcctccattcgcaaagcctccacctcccccgtccaattcacccagcagctcgagaaccagcgccagagcggactggtgcttcccagcaccgacttccaccgactctgcctccaccagcttcatctccttcgcagaatcattcccgaaaccctcctctcggttccgattctcatttcctttctcctatttttttaattatctcatctgcatgcatccttgttagcttcaattcaagtcgcttaaatataccatcaatttcatctctcaagtattatcctctctaccaacaaataacaagtcttagaaatcgtgctaagtactctttcaaatattgaaaaactcttcaaattgatcccggactattattaaaatatatcaattttctatagatcaaactaatggatattcaatacttgagggattactgtggagagagaataatactttggggtggcgggggggggggggaccgaattgatgattcattcgatataagtcaaacaaactctaatctgcttctttaaattagtatcatccatcaatcaaggttttaagttgccatccccgtttaggttttgttgtaatccatttatattgcagaaatttgagggaaaatgcagttgatataattgcaatttcagtcccaaagacaacaaaagcctcgatgtggtggctgaaatcgcggttgcagagtgttttataaaaccttgccatcaatttagtcttgaatttggccaattttgttgggtcttcgtgtatgtgcagattagtcagtcaattgggtccctcatggctttaaccaaattaactagcagatgttaggcactagattggctaatttggtaatgttagggaccaaattggatattgatccaatttcatggatcaaattgatcgacagattgttaatagagacagggactaaattttttttttttttctttttgtaatatttatgaccaagttggctgttattgacaaatttagaaactaatttgatgttttactcaattttgggattaaatttacattcctaagtaagcactaaaatgtctgctttcttaaatttgaactgagtgatgtggttaaggagctattttgtttgctttgttcaggtgtatgttagaccagctggtagttatgtgatggatcggttggagctgcggcgggttgcactgtaccctggagatgcggaggcagaaggcattgtcattcttgtgggtcattttaatattcctgcaggcttgcgtgctgctgaggccacgctttccaattcgcaagtgtgttgaataccttgagcacacaatgtgcttctcttctgttccaccgtgcttgattattcttgttgggtaggatgaatgttaatataggtttgaatgttaattgtaggttaatgttgtccctgaatgtaaggctgtggttcttccgatggtgaaacacccatttgttgttggtttcttggttgctgagcttccgttggtggagcaggaacagtgtcagaaatctcaaattgatggaccagaaaacctcatgtctgttgaggaaccttattcatttcctccctttttggatttagataagtcaagggaaattcagaatcttcaggtcaagaatgaggcagttggtatgcataacttcacttctgagcaaagatcaaatgctgtcaacatttcacagtctctagctatggcatatgtcatggatcaggtttatatactgcatctttttcccctgaaaaaaaagagagaagaaaaaccattacattaacgcatcactattcaaatatgaaatgctagaaagtttgacgctactcaaactttgtgggagttgccttgaaatttgcatttcataacatttggtacttgaatgtgtgctttgcaagttgttgcattgaagttcacaattatttaatccatcactcgagtaagactgagtaactgttagtttttagattgcaatgcaagtcttttaatttatttctctttaacttttatgtatggtttcacggctgttataagaatagctttgacaccttgtatgggcctaaatttctagctcatggttatgctacttttacagaaagcaatgttacttcagcaatcaacatggcaaaataatgtcaggatgggtaatctggttgagcaagtatgagttattgactgttgttgcattcctttaatctctcattttcatcctattctaattttttttttaatttatacagatccgcggtccactttcaagtattcaaaccttaagtaaaatcctgtctacacagacaaagagaactcaggtttgaaaattgtctaaattgtacctgataattcacatgcacttacatttctgtaattggggaacccaatagctgggttggacaaagtcccagctgaactgacacatgatcatgtctagtctctgactctacaatgcacctttttaaagcatcattaaattacttttttaggtggatttaatattctgaaaagtctttatttcagcatgcactttatgtgtactgaatgtgctaacttagtgagttggtgattagtagctatcttattcatgatgccttgaatcgagttctatcatagttttaaatgcaaggatatagatgtttggtaaaaatattactaaataaatatagatctatccagaaaattagagtgaacatgctgcaaaaggaaataaagagttcaatctcaaaggatgttgaatctaaactatagttatccataacttatagttattgaatgtcaaaaatgtcttataattggtaattgcacagatttcatatgacattgttgaagacctcttggtgcaaggtgatcgtctgagggatgtcctccaacaactacaggatgctgtttatttgacaaaggtacttctttctcttgtacttataatcatgcatacatgcaaatacattttgtatacctacaatcaattaatgacttattgaatttcaatgtacgttggttggaagatcttgaatcttcatcacttgttgtctcttgactcttcctctatataattttgcatgcaaaaatacacttataggcaatgtgccttgtcacaaaagtaataaagggatttgagtcctaagtatcatattcaagggattaattcaattcatgtttattgaattagtaaattcttttaaaccttttgctattcaaactatcaaaaagggactactgcaaaagaattaaaagaggaagatgaattaggaatttaattcccaaagaagatgaattaagaatttaattcccaaagaacatgaattaagaatttaattcccaaagaattaaaattggctagggctctggcctcacttgcattctaatttctctatacttatgtgttctcttatcagttgtgaatcacctcttctaacctattagcaatctgtggtcatgaactgttatattatttcccttgtcaaaataccaagtttggtcatgtaaggcacaaaacaagaaaagcataatgaaccaagtgacctgttaatttaataataataaccaattggaattcaagaattgaggtttggtcatgcaacaattctaagtgcatgtttgattcaacttattttggagaaataactgcttatttttgctagcttgagaacttatgaaaaacaatgatttcctcaaaattaatcccaatcaaacatacatttaacctaatttatcctataaatctgttaattaactgtgcattgtcatcaacctatcaattaactcaagtcattaataatggccaattcctaacatacaacaagtacaataatttaaacccaattgaaaaaggaaaaatacaaattatattaacgttaagtaactcccagttatggatttagttactcatgttcaaaagatatactaaataaagcaagaattcattaaacaatccataaagaacaaaaacaaggacccctttgaaattcataaaacacaggttcctaaagtgaaaacgtttaaaaattaaatgttattgaaataaacaaaaaaggaaagcaaacactgatagaaaccagtgcctctgatgttcaatttttgtccaatatgtagacaaatatagtgcgctacaatgaagaagcaatcaagaaaatgaatagttctactcacatacttgctgaatcatcaagatctcagttgttagatagcaatccaggtgatgtctctgcaaataaaatggaaaaatctagtgagtcactttctctaagtgctgctgtccaggatatagagatgccactaccacctttggcccttgctccattgcaacatggaatcaggtaggtttcattggttggttaatgcttatgcttcttttcatagtgtcatgacttatccccatatcttctatataatatattctcttgattctgttatatcccataataataaactcctaacttgcactttttgttgcatcaacaatcaataatatcttatatagtttgtttctttcattagcttttagatatttatttcttttacctttcaacagttaaattttttctgcatttattttgcttatgcttttcattaatgtcaggaagaccatgcaatgtttctgaagtattggcagacttggttgattcagtgagaccacttgcccggggtcaaaaacgtgtagtagaactaactgaactctcatcatcacctttgctagctgctgtagaagaacctgcattgcgccaggctttcagcaatcttattgaaggtgctttactacgcacacatgttggaggaaaggttgaaattgtatctacggcagcaccagctggtggtacccttgtacttattgatgatgatggacctgatatgcactatatggtaacttcagcccactcccactccttgctgtgcttactcatttttcttttggacaagctggaaattgttttatgcatgtaatttgcaaatttgaagcatctccatgggaaacttgggaacatttaatgctttggacttggcaaacagcgcattgatgccattttgtgagggaattagtgcagcttttcccaacgtataatttgcatgattcataatcatagtgacatgtctgtaagtctatagaaatgtggagccctccataaaattaccattatattgttgatattcgaagacttcctttgtggtacacatagcacttgattcataaaatatgacatctttcaagcacttccttgcttcttctattcaaacaattcttcgattgagtgctttatgcctagggaattgaattttgtgaaaatggaaactaattgttggttatgaacttgcctgcagactcagatgcactcactcaccccttatggacgagaactgttgtctgataatatgattgaagacaatatgacttggaactttgttgctgggttgactgttgctcgtgagatactagagagttatggctgcgtcgtccgcattgtttcacctcgtattaaagatgctcctcttggagctgggggaactcgtgtggaactctggcttccttcatcaattgtactgtctgatttgagtagccacgcccaagaggtatagcatgagtttgaagttccattgaagataaatagtttccttctcatacaattctacattgtagcacttggccagtatataaagattgtgaaattcaggagtggtagatattactagttctttcttcgttgttgctaaatataagtatccggttctgtatatagctcgtaaaaatttctttagtagagtttattttatgactttgctgtgtgtcaccatgtaaacaataacataataaacagtgtatgcatattatatgacaggaaaacttgttgggtttttacaagagaccacttatctgaagcttcagcatttgtaccatgcgaatccccttaatccaatataaataaacgaaaagagattgacctctttgagtaaactaaacttcagtcggacaatcttccctttgttaaaacaacaaaatttaggtagaagactaaaaagagtctttcaaccaccataaataaagaataatcgttattaaataaaattaatagatatatatatatatatatatatatatatataattatttagttgtttaaatttcaactattcatttcaatcaaaatgacatggattccccggagcccggacttctttagactttagatgatagaatgcataataattgttaatcagaaaattaataatttaaaatataataaattcattcacatatacaatattaaaatatcaaaatgcattttaacaatttaataatttattatatgtgtaattgtgacaatttcaagcaattaatatcattatttttaattaacaattaaagtaatactgtcaatctgtcatacattgttagtctccataccaaaaaaaaaaaagtctaaaaaagttattcctttaactaatcaaaaatcaccattaaatatcttttcataaaaatcaacaaactgaatgataatatgtgattgaataataatataaaattatttacatttaaattaaattctgatgatattacattttttttcctttaaatcaattttacattttaaaaaacaaattaaatttatatccgactactgctgcatatgataggctctaaaagaccatcccattcacatattaatatcttatttatcgttaatgtgtgttctgctagattccagtgaatagtggtggctaataacagtttcttgacctttcgctaacaagcaagcctatctatacatcctccaatttatttatttatttatttatttttttttttttgaggattgcgtattgctccaatcattttcaaagattagttaacatatcactttctccgacaaaacatacatgcatctaaatggggcaatatgctaaagttttggtgaggctataccaagtatgaaataaagaattgaagtttcagcccattataaaaaaattagttccttctgaaatgaaaagagcatcaaagaagatatattcagtaaaatctttttcataagaattgatctagatacatcaactttgatgcgttggaaatactgtgctcaaatttgaccctgaaaacttataaatccaaatttggcctacgtagcaagggcctgtggcacattaaatataaatttcattccacacaaaattgcttagttttggaatttcttttcaccacaacagaagctccagacgattatgatttatgaccttatatacttgtcacttatgtttttcgatattagtcatcaataaaagtaattgaatattccatataatataataatatggtaatccaaaaattatacttgtgagttacgccaaagtaagaaacgcctttaattgctaactattaccaacttttttttaaaaagctaatacaagtgacagaagcttaggcctctataatttgaagctgtggcggtggaactcatacttcatgttgctgaaagaaacttgatatttttttttaaggaaaataatatcaatgctcctaagtcctaaactatatgtcttggcagtaaacttaatcttcttgattaattaaaccaaactaaaatttttagggtatatatatttgtaaaaaggagtatggtttaggatatgattaaatactcttttaccaagtaaaattctgcaaatgatttgtgttatgaaaaaaaaatgttgagggtgattagagagttgagaaatgttggtaataaattattgattgatcaaacttacaactttattaaatcatctggaatcattttttatagaattaacatgactattaagataataaatattaacaggtttataggagcattaattaaaaaattaaaaatatagtttattatataaaaataaataaaacttgttctaatcatgtttccttaaataatacttatagttaaattttacacaaaatccataaaattgctacctagctaggtggggaagtatcccacttaaaaatcaataaatattttctctgcgaattaatagttatctttttatctattgtagattttgtttttatcaacaaaacaaatgttagtttacattttttgttaaaaatatcagtaaaaaaatttaagcccattatcttttctcttcttctttcttcatccttccttaagcctcttttttttaaccaccaagctcatctaatacagacttgtttgcaggtgcaactgtatgctcaatccctcccgcttatctccattgctttgcttcttgtctatttttacagatacaaggacaactagtgcaacctattttacaagatccattcatataggccattttgtttagctagattattagttcatcatcatcattctacattttactattcgattcacataaaaaatagaaaacacacacacacacacacactttaatattaaaacaacttctttgctgtcaataatcaagataaacattgggcaacatttaccttaatttccattgtctatatgatgcaaattcaactttgatatttgtgttaaaaagatattttagataacctgtttacagttacacagtcattatttgaatttctgcgtagaaaacttcaacgcgtgagttttgcacaataattaacatacatatacttttatcgtacgtcccatctcatttttctctaaaaccttttttttcatcaaatttatagttttctcactcttcttttatttttctcttttatctctcttattttcactcgtacacctaaaaatggagtaatatgtttatctctactctaacgcatgcatatttttttacatgacttgaggattttagtattacgtatatattatgataaaataactaaagattgataatctggatagaaaaacttcacacgtctctactctctcgagtaaatggctaaataactaaatccgtccacaaaaatgtaatgtgtagataaattgattgttgatagatgaaaaatataaatttaattttttaatatactttgtaataaattaatattataaataaataaaaattattttctaaattttataatttaatgtcaaattatttttaaaaaatattatttattattaaattagtctttgaacattataacttaatgataaaattgtctcacaaaataatatgattaatttgtcacactttttaaatttttaaaaactaaatttatatttttcatgtgatcaattttttatttcatctcactttcaagacaaattttactctttattcccctataaataatttccaattgtttatcacttttcatcagcacaagctgaggcatgacttcagtacaaccctccctactcgtgttgctgctgcttggagtggtgaaaattaccactcctgtgctagccaatttgaagccacgcttcttctatgcaatacgaggtgatactatgttatcgttgattggttggtctgtttaaactttaaaataagctatatacaaatatttatatatcttcatttggtctttgtaattgtgtaaattttactttttaatccttacataaaaataatttgttttagtctccatataaattcttttagtttcattttggttccaaccgttaaaaataactttgatatcttaacggttactgacatggtaacaatggaaaactatttatagagagagacatgccaaattttcttgcatgtcaagtttatcaatcttaattaattttgttgttttattttatgcataatattaaaatcccccaactcgataaaaatgtaattgttggtaagtttaatttgtgtgtctctctttggataaaagcgtttatataaccaaatgttgttaacacaagtgatttgatatttgagttttttcattaagatttggatatcgattcaatttctgacttggacatggataaaaaccggagatatcactttacttaaaaaatttactgacttggtgggagaaagattaaacttcttagttatatatacagaatttttttttttaaaaaaaaactttttatataaatggatattgtaaaataggttgcatttgtatttataaccattacacatgaagcaatggagataagtgggtgggattgagcacttgtacttgctaactcgtttctggtttcaaatgcataaaaattatattcttagcagataaagtatttactactttttatgtgggattattttcctcttaagtagaaattttatggattttgtataaattttagtgatattattatttcaaaatataagtatataccaaacagttaataaaaattatataataaactttattttattaaacatttttttaaaaattatttacgtcactacagcataggcattcaaggtcggttatttggaccatacaaagtcgattttcgaatcgaccttgtctccgactacaacataggcgtacgtttctaaaaataagtaggtgtacatatttcaacgatatggtgtagcccccaagagagaaaaataagagagttattctggtgtttctcctggcctatttcttatatagatatgtgtattctcttatttataagaaagacactgtgtaattattctatttttgtatatttagagagattgtaatgtaatttttcttttttttagatacatgtaattttcttttacttagtaaaaatatttttttaattttatctgtaatttttttcttatacattttgagggttttttcatgttaaaatagagagcaaaaatgttactttattggcactttcatatatctattgtttcaaaaataaattatttaaaaatacattgagagaataatttaaagatattgtatctaatctttatgaagcagtctaaattttaagatattatgtctattcttaattaagtcattctaggagtgctaaaacacaatgggaattgccatcaacaagctaagatcaaacaattcaaatcatacaaataatatggactctacatttaacataaaacttcaagacgttatgtgaaagtacagtatacctctccaccaaccgtcaccaaaaaaattcaaatgaaaagcattgcgataaaatacaatatacttttggacaaattcttttcttttaaaaactcaataccctattatttttaaaatgttaaatgtgaaagtttgggttctttttcagagacatcttggacaaaaagatttccagtaggcaggactacttgaacttacatataaattagactactaatttttcaaattatatatctgaatcaaattggatcaaataacctttttgcacacaaattctcttacacatgcaggaagatgcttccgacagcatgtttgaaaattttgcctcggatcaaaattaagcaagatattcttgggtgggaacttatatatgcttttttttttatacatggagggcccttaaggccgaacttatatgtatgctaatcagtcttaatttgattttgtaaagttgcacccccaagatttgaaaaaacggtatgcgaccgtgcacgaatgaatgcaatttaaaaccttagttgaatgtgccatgcatgtgaagaatatgcacgtatgtcactgttagattaatttaaacaagtacagataaaattatatatgtttaatttttattattttaacgtataaagcgagaagatttaagcacaaagaaaaataaacatatcgtagtcatgcatagataaagccattattaatatataattgacattacaatatatagttgctgaaagggaaattaaagttattccagagaggcatatatagagcttttattttgaagaactattgcaggcaaaggacaaattgtactttccatcttaaaccggtagcttctcatatgaagggtggttggggcttatatattatgaaatggttgtggtagtattcgtaagtgctcatatgtgaatcattacggactgtggggtgctcttgatgatgaaatgaatccagtagtggatttggggggtactgctttgaatgaagacatgatttcagtggttgattttgggggtgctttggatgatgaaatgaattcagtagtggatttggggggtactgctttgaatgaagacatgatttcagtggttgattttgggggtgctttggatgatgaaatgaattcagtagtggatttggggggtactgctttgaatgaagacatgatttcagtggttgattttgggggtgctttggatgatgaaatgaattcagtagtggatttggggggtactgctttgaatgaagacatgatttcagtggttgattttgggggtgctttggatgatggcatgaattcagtggtgatttttgggggtgctctggatgaaggcatgaattcagtggtggattttgggggggctcttgatgaaggcatgaacttagtggtggtgagtggtttctcaagatcatggtctggggcaaactcaaaaaatgatggcttgaaattggctagcactggagtagtgagaaccaccactccaagcaacaggagcaacacgagtgggtgtagtacagaagtcatgtctcagcttggaaatcaaaagtgataataatgagaaactatttataggaagagacaaaggaagtttttttgtctaggtcatcaatcttcagttgttttattaaatatatacataatattaaaaaaaaacatttaatcatgtaagaaatgtggtaggtgcgtgtaatttgtgaatatgttgaggattaacttggaatgaattttttttaccaatttagtgcatttttgtttggattaaaattgggagaattgaaaaatatttttgttccatatgtaataatttttttctttcattaaaatatacagtttaatattaaaatttgtaaactactttttataactttaaaccaaatatagatttaagtaattattttattctcttcgtcacgttctttttcctaaaatgaaacattcttttttcacctttcatattctatgtcacattatttatcttttttatttatataacaaaatatcttggtgtccaagtatctatctttatcatataatttattttacctaatatttttaaagcttaattatcacatgctttaaaaaaaggtttaattatcatctaatgttattaattgacttcgttggttatgatcaattccggcaatgggattattattgtgcaaattaaattgacacacgtttaagctttgtacagaagctataaaataggttatcattaattaaataagataaattttaatgaatgtcttaacatcattggttaaagaattagaaggaaaaaaattattgggatacataaaattatgttatatatctataatttttttttacattttcctatattgttcataataaatactttctctttttaattttctaactaatgcacaaacattaattagtgaaactatcaaataacaagttggtgggctagggattaggagggcgagcaaaagttatcaatactcctatggccataattttaaaatccatattgattggtttgatcgtgaattgataatttggtcgagtcggattagatagaagaatagttatgtagtcaattaggtgcaacctagtgtaacctgctaactaagcaaggttgaaccagtgtcctgatcctgatggggctgaatcattgacccaggttggggtcatgtagcgtttttttgaagaaaaaaattacttcaaacgtcattttatcattaatgactaaaataataaagaaagaaaaggcatgcttgcatttaagtgtctcactccttcgaaaactttaaaagattaatctttggcgtcaacaacatttcctcccaccaccttaaagcttatgaattatgatgttttcttattaatttgtcgtcagtcatgatttcttcattttatgtttcctttttggttgtacatttgattttgttgttgtaatgtgattgttgatttggttttcatattatttgttaaatatgatgtgtttaagcaattatttatgttaactgttttagatacttgatattgtaattttatttatgagtagtaatttttttggattttatggtaagagatgtataaactttttattttttaaatattgacaaataatgtggatcaattagaaacttattagttcgatcgttagtttagtgacatagtattttaatttcatctgatcgatttttaaaatcatggctataggaatctcaatcatacacaaagcttcctgaaggaaaaaataatgaattgttgagatacatgcttaaaggctactagcttaattgaataagttgcaggttattttattttatgaggattactggttttattttccttttggttagttcaagaaacataggggtctcacaaatttagaaatgcaaaattagggagatttgttgcattgtgaagaaaacacgcacttagagagctcatgcaaatagtgcagccggttttgttgctgcttgttagttacccacatcttctctttctaactcaaaatggtatatacatcttgtgtatgtgagagttttttttataagtaggaattaaagattttataaaaaattataataattaatgaattctgtttaattaattgaattagaattctttctaagattattattaataaaattatatttattttataagaaaactaataaacaattttttatatgagaaaatcatcatcatagaatgataaactctctttaaatatttaacacaaattatatatgcagctacaggtaatattcctatttgaatcatatagaattaatatcaaagtttcaatagcatattatattttttctgtaagtatttaatgtaattatatatataaaattcaaactcaaaattgattaaattaaaataattcgcccgaacaaattcacaccaagtataaataaataatcagttgaatttgcaccatatagatgacgtaactataaataggtgaatgctacccaaggtttatcttaatttattgacagtaaaaaggttgttttaataaagtgtacatatgtgtgtttctctctaaacaaaacgtttaaatggatattgtaaaatagctaggttacacaagttgtccttgtatttttataaccacttaacatgaagcaattgagaaaagtgggagggattgaccacttgtacttcctaagtcctaacacgtctctagtttcaaatacatgaaaataatattaattattagttattaccagataaatactttacggattttgtgtaaatgttagcataatatgcatgtattatttcaaaaaataagtatcaaatataaataacgaattataattttttatatgacaaactttcatttttactaaacaccttatttttaattttttattaacattcctaaaaaaacccgttaatatttatttttcttattagtcgtattaatttataataaaaaatgatgcaaaagtatttaataaaattgttataaagttcatctaacaataatatattattaacatttttcagatatatctgtaatgttgatccttcgacaccatattctttgtcaatatacatcaatcatgaaactaatctacacacataatgagtaggctattcataaaagatttgtgaggatagtgaaactaacccaaacacgttatcatgagtaggaatgtaggatatagacgtcttacgtttaatcggtacgtaatcgcactgtggcacacaacatgtgtgtgagaaatttttgccaaatttctgcttcacttattatatcggataaattaaagaatgcatccaccttcatatctttcattaagggatataaccgcaggattaattttttgccagttttatgttaaacctattatatcgggtaaagtcaataatacttgaaccttcacatcttccatataccgtaagcacttttggatagattaaaaaagacaaaagaaaatgtgtaagtttatttgggggtaaatgacataatcaactttcattttagtctttatatttaacgaaattaaaaaaaaagttccttatattgatgttaattgctcaaattagttcctaactcattcaaataatatttaaatttgattcttaattgagataattattaattaaattttacttaccacttcagattaatcagactccctactaaaaaaataatctccaaagtggagtatgttagatacctccctcgtggatttcagggacggaaaaaataaagaagagaaaaatcttccttttcaacttttaattattttctcttcgtgcattaacaaaagaaaaagaaaaaacacgtcgatggttaatgtggattcgcatccaactttaaattcttttgtctctatcctccctcctagtttcaagcctttcgcatttgggggtgaggaggatccatgagccatggcgcaatgtcgttggacggtgttaagtaacaacgtggaggtagtgaccaatttgagtgagttcatcaatttttggggacttctttttaactttttaaattttgggactagaatatagtgggttataaatttagggaacaatttcacctttactcttgatttggagcaaaaaatggtataaaatatgtaaggacaaatgcaacctcttacacaatttttaaagttctgatagcatttttatacaatttaggctaaattatatatttagtcttttatcttaatttgatttcttatcttttaaaaaaattaaattagtactttatagtttaaatttagatttttttttatcaatttagaattaacatttgttaattattttaacataatcatagttaaaaaacaccatacagttactagacgtgttttcacacatgcgaagaactttaaaaattctgtgctcattttctctcttacggtttcataaatcttaaaattaattgaggagttttgccgccgtgtgtttcaatcaatataattaaaaatcaaatgatttcattaaagtatgtgtaaaaattaaatattttcatgccgcaaattttaagtgtatcttatactttcatattatgaatggtatcgttcttctagatatctatttcgtaactaaaatattatacttttgaaatgtctatttcgtaatacattcaaaagtaattaaaagtatatattcctaaacaccttaggatagttattattcatccataacacctattccataaccaaagtatcgtacttttgggatatcaatataagtattctaaaataccatacagataggtgtaattctttaataacacttattctataactaaaatatcaaacttctagaaaagtctattttgtaatttattaaaaaataattacgcaacaagccatcaaaaataaacaatgaggggtattttagaagtgatacctaaatttttagtgagaagggagtgtaggataagtttttcgggtgccggaggataaggcctacctattatcataggttacaatttgtatttgatccactttaggctgatccgcattaggcccataaccccttttggacagaccagttttaatatttctttaatttacatgtactgatatatagttcttaaattagtttctattctttgtcacaggactataaagttttttttttattattattattgacattattatttaatcactgtgttatttaaataattataccattatacttttcgtttaatgaatagttaaaatagtcttattcatctggtcactgtttatgaaaatgaaataacttttatatttaatttctttcttttgtagtcatgcagttatctttcttaatttatttgaatttttgcatcaaatcaaattaataattttaattagttatccagtcaaagaaaaagttagttttcttaattatttattcaatactcacattccttaatttacatcaagtataatgagatgtttgactttgtaaattattattattatttgacgatcattattattatttgttacaaatatatcattaattaaattaacttttaagatattttttaaaaaaagttagatgcattttttgcatttctaatttattatttttactactaatctacatatatattaaaactatccaacaccttggcatgtgttggtgctgacagtgctaacctatttttctttcttttacttttttttttcttattctgattgttaacccacacctagttactaataaagcaataagtcaacttttttttttcatgaatgaggagaaaactgtgtaatatgaattttcaagtagccgtaaaaccggtaaaagacacattaaagaaaatcagttggaaagagtcacctaacattattccgcttcaattcccgcactgacaattatcgatgggaattctctgcaatcacatttttgtgactgcttcaaattctggccataaaaattaaattatacattaaatataaaaacaaaatataacttgaaaaattttggtccgttagatgaagactgcataccctgcactgcagttgaaaagggtccgacaattatccgaacagatcttatcgtgcaacagaagcaggcgaaatccaataacaaattactgcaacagtagtattcacaaattcaaattttcgtgtccgtttatatattttttatcactattttttcccagaaggaagttgcatcaaaaccaaaagtaccaaaagcaaaacaaatccgtattttggctacaaacccaaacctaagagagaagattccataggacaattttgtgcctgctgctaaatctcttctttttcacctttgttcctctcctccaagaactcagatcactaccaccagcaacttccccgagtgttgtttttcactttttcttctcaaaatccactctcttcgccagatcttgcttccagtcgttccaggtgcgcgcttctctttctcccctcttctgttatcttttacggtttttagaattcagttttatatattaccctgccatttgcattaatttaattttcgtttggtgttctccgtatttcatgaaaatgtcacatgttttcttaatagtggagcattttggggatatcccctccctggttgcttatacgtcgcttgcggtgattattaggagaaaagcacgtgtgtgtttttcttgcttattgtttattttatttttccaacaatttggggtgtgtgaatgaaaatgcctctataataggagattcaagttgactaactgttgaaattctgggttatatgagaaaaggaaaaattgatgcgactgacgtgtttagattgtgacaaaatgcatccacatgatttataacaaattatgaagctgtttgaatctattttctcattaaggaacataactccttacttacggttctaaacttaacaaatccctgcacaattaatgtaggtcacgtagtactaatgtagtaagactaaaacagtaatagttttgatttctaacgcttcccttcaagttgatgctcactaagatcttcgtctgttacaaataagcacaccaaaagacaatcataaaaatttaatgttttctctatcatgaatagtgctgaagagaggcaggaaagacatcatagcaaacacttgacaggtctgaagagaaacaacaaaacatgatgactgggggttgttgacacttggcagtctgaagagctggtcagaatgttgcatggccaaggaggaagggaaactgatggaaagaggtgctgcagaaatttcttgacaaacaattatacacttcaaggcataagctctccaaattaattagaaacaacattgggaagctcttcatacttcaagaattctagagattcaaaattcaaaaaccttgaatactaaatatggcttgaaaacagctcgtggttggaagagaacacaccccagttgtagggaagcatagccaacaggggtaaaataagtttgcatttaaggcagccccaaagaggccacaactaaggtgggccagagatgactgtaattaaggcagtttttcaacactcctcctcatgttcagggataccggcctggagcatagcaaatgcaagtggcccaacaatagatctaggataggctctggcccaacaatatttttatttctctgatgtttgaataatacagctactgatatatacacaaagaggaatagaaatctgctgtgatgaggaaacaaatcaggaagcaatgaatagcctatctaataataattcagattttattcaaatctgattctaaacacatttattacaaaatattttttatctcatacaatggtgtattttcctcctcttttttttttttttggaaccattttcttgttccattattaacatgtttagttgttctttgtactttgtacagggactgttttcttataacaagtatctttgcttcttataaggagggtacatgccactggctgactagcgaagaagaacaacccttgtgtatcgttttatgagcatacaattggaaaaccttggatataatggggatcagttctcgaaggtctaatcttcagagatggctaactttgtttatgctgtttttttattaagaaaaattttatctgctatttaacatcagaaagtctgatcgattgacatttgcatcttgttggctgcagttctaccaatagaaaaccaagtgatagtatgaggcttattgtgacaacttttgttggaatagtttttggcttctttataggagtatcatttccatcattgactacaaaggtgctgacttttagcatcttcttgttaggcataccttgtgccttggcaattggtgataaaatgttgttggacttaataatggaactctaatggtgctttaacaatttgcagttgaatctcccatccggcctgcttcccgccattgatatttcttaccttcaagagaaatatgcaggtgtcaatgcaccgtcttttgtgaagaataataacagcatctcatcaaagcatcaattaataaatgatacattgaaggtacacatctcatgtcagccttgtgaacgatattaaagttgctggattcaagttaatttctgtataacttctttcattgagaaggaaaaagatttaatggaataatatagttggaagaggtttcataatctcatcaaagattcatgcacattatttgttgaatgaaggatggtaaagaaagtgggatgagtaagtgggccagatgaatgaagtatattttatcaattgatgttagtttacaattttaaggttttaagaaccatgctttaatgggttgtagtggataggcccttaagattaagtagatggaaacttgagtttttgaggaaatgaggtgctggagttattcatttctgttgttagtcttctgcttcccttttatttatttattttttccaaaggaaatactgctgtagtaacaaactagagtaaaattggctggctttcttttacctagatcttcctttcagtttcagtcatgcaacagttctgagcctaaatttatcatcaagcattgagtaattttattaaattcataaattgtaaagctctctgtctctctctcttgtttttacacacacaaactatttcaccatcaacaatctagagaagttgaaatgtagaaaccaaaattccttatgaacagaaacagggtgcttttattaattgataaaatattgactcaaatgtaaggaagagagtaagaaattactgctagggtgatgttaaaaaattggaaaaataaaataagatcaagcacatagcaacaatcagaatcagaaagactcatgcttcttttgttaacagcttttgagtatgattttgtttacttaatattgggaaaatggtttgttaaaggctcaataacaattgctgcatattttcttgattctctgcattgcagatatgggttccatcaaatccaagaggtgcagaaagattacctcctgagattattgaagctgagacagacttatatttgcgtagattgtggggtcagcccagtgaggtgtgtatcctaaaacaattttgttatttcttttttttttttcattctatttttgggagcatctgggggttgaaacatagaaaacatgttctttttgcatgcatagaaaaatacatctaaatacaaattatggtcctgctaatgttgttaataaacttgttaaagaagacttacatgctttcatcagattctttgtttcgatgaaataaactaaatataacaccccaaatccatgagggcgagccctggcacagcggtaaagttgtgtcttggtgacctgttggtcatgggttcgaatccggaaacagcctctttgcatatgcaagggtaaggctgcgtacaatatccctcccccttacccgcgcatagcgtggagcctccgggcaatggggttacgtggcttttttttataacaccccaaatccaagattgatataatttgggaaaggatagtgacatagaaaacttatgttgcttgccacgtgcattttttcttctagcttgatttttttttctgtttgtgttattaggccaatctgtaaatttttggactggagaggcctctgatgtttttattgtggtatatcatcgatatacagagtatttgattaagttgctgcttgcaggatttaacatcaaagccaaagtaccttgtgactttcactgttggttataatcagagatataacattgatgcaaatgtgaaaaaggtcatctcttagtttctttttctttctgatgcataagcttgtgtatgactgcatgggtctttaaactagctccattacttgtaacagttctcagagaactttacaatagttctatttcattatgatggccaaacaactgaatgggatgagtttgagtggtcaaagcgggcaattcatgtgagtgtccgcaaacagaccaaatggtaagaatccattgcgctcgatcttggatgacaaattttccttgcaacttttaccattattattgtttgcctaactaaaatcaaaagtgttctgctaattcatctatgttatgatattaagcatttaattgttttccctcctaggtggtatgccaagcggtttctgcatcctgacattctggcaccatatgactatatttttatatgggatgaagacctgggtgttgaacattttaatgcagaagagtgagtatttattatgatacaatacacagtttaattttgatatccatgtaaagttttacactatcatccaattatttgataattcctcattacaagattttgacttttaagttagtttgtcatcatctaacttgtccaatgtggtaatacaagatgtgattagatgatagtgttagaaacttccataattgatagtggatcaaaataaataaataaaatgtatatttatatacgtaaggattttttttttaattttactcatgaagtttgatatgctctaatttcaatcacagatacttaaaactggtgaagaagcatgggttggagatttcacagcctggtttggaacctaataaaggattgacatggcaaatgacaaagagaagaggtgatcgtgaagttcacaagtaagacaataatccagtgttagttttcttctggtacttattttgttaaagaatgtgtactaactgtttatttttgtgatttctattagagaaacagaggagaaaccaggatggtgcagtgacccccatctgcctccttgtgcagcgtaagtatcagttgaagcattatttttgtcttatcaacccataccaaactgtatcgaattatgttatgcatgcagatttgttgagattatggctccagtgttttcacgagatgcttggcgttgtgtgtggcatatgattcaggttaaatgtttactctttattcttttttaaatatccattggttagttgtttaatgtctgtttatgcactcgttagagtctaacaattaattatgattgtaccattctgggcatttcagaatgatttggtccatggctggggccttgattttgctcttagaaaatgtgttgaggtgagtttgtggtctcattacttaaattcatctaatttcaattttttaattgcaattgctatgctatagaacattaaactaatatctctcactatcatgtagcctgcccatgagaaaattggagttgttgattctcagtggattattcatcaaagtgttccctcactagggaatcaggtaatttgttttccatgattattaatgttagatttaaatagttttactcatattgccgatgtaagatatgatgtttttctttactttgtagggagaatcacaatctgggaaagcgccatggcaaggggtatgttaatgttatgcatgtttcatacagtttgattcgtctctcaaaaattcatatatacaagttttctatgctgtaccgaaccatgaataggcctatatataacatttttcttgcatagttgtttaacattataactcttgatttaatttatcgagaagctgtattacaatggatggagctgttagtttatgcaaatactttgactactaaatatgcatgtctgttgatgaaccatgcatggtgttggtggcaggtgagggagaggtgtaaaagggagtggacaatgttccagagtcggttggcaaatgcagaagacgcatattacaaggccgtgggagttgatatgtttaactcgactactccttagtggggacaacgacggaagttgacttgtacacagccatcaccatagttcgattttgcatgatgtataattttattttatttttgttacttaagtttgtggcactagttacttgcacttataattgagagtcctagctaaggacaaaacaacagttcaatgtgggattccagtgctgatagagaattagataatatataggtaaataaaacttactgtgtaagtagtgtatttgattataatattctttgaggaccttgcaggaaatatgaatgcaatgccaggtataaacaatttggatgtgacaaggaagccatatacctattggaacggcttcacatcttcgttaaacctctaacaaatcaagttgaaaaaatatattatcaaattagaagtaaaacagaatggaaaaaattaaaatgaaaagataaaaaaaattaatagaaaagatgtgttatttaaatggatagaaataaatgaaaaagtggaaatttttctttttcttatttagattagtgaaaataaataaattgtatacaaattatattaattaaaaaattaaattttttattttataattcttttctaaacatagaattattattttgcaataaaaagttatttattaaaagccaaaataaaaaaggtaatgtaaataattgagtctaattattatgtataataaagcataaaagttttgatattgtcaattaataaaaaaattatgataaatatgattcttaaggtaaatgtaaaagttaaaaagcttatcataaataataatttataattagataaaactgtaaaattctattgccaacttttgatgacaacctagaagttttctcatataccagagtgaacaagtaaatcttctttttcatttttttctcaaataaataattaaaaattgatatttctattccattttttttctctgttttattctcaaatgagtcgccaagtgcttttccactatttcgtgtggaatttgaacagaaaatagtattctaccttttcttgtgattgttgtggccatggattattcttttgggtgtggtgtgatttcctggtgtgtgcctttttgaatcattattagttaatatttatttctcaattcaactaacttgttacattatggtaggtgacaagtcaacgaggttccttgaatggtacttttctttgcttcaatggtcctccaagtttgccaatattaaggaggcagatttctcaatcacgtgttggcgcacattttagctgcctttgcaatgtaaccacaccctgctttccttgaaagatttctcaaacaagcacttggaaataacgtagatatcgtcacaacggaacttctataagaaaaactatacacgtcgattattaaaaaaaaaaaaaaaaactatacacgtcataagctagacatgaaaataagaaacagcatataccctcaaatgtggctttcgtgtttctgctgtctcatattttagtggattatcaaaaaatactgtatacaatagtatatgtaagagaagcccattgtgaaaaagaaaaaaaaaaaagtcctctccatcaacaattgtactcaaaattaatatataagggttgacgtaattaatatatgtatgtatatgaatatattttaaaaaatatgatggatgattagttaagttttattaacaatctggtaatgttgacataatttattcaagtcgttaagttttattcttatgatttaatggattggttgaatttatacatgaataaattagatgattagagataaacagtagcaatcgccatccgaagttgtacgaatacaatgttaccttttgtaaagttgaaaaagactagaaatcgggttgaaaaaaatgattaaccagttgaatttgttcgtggaattcctgatggtactttttttttaatgtagttcctgatgtcactaaacatttttacccgataaaaatgtaatacaatctctatctatatcttatatataactgtaatacaacctttttaatacatttttcatattggatgaaattcatatagaactcacaaatttagtagttatttaggaaggctattgtaaatttcacttaataataacaaatatcgtcttgaaaaaattgtgagttgatacctcaagggagaggatccatcaacaccaacggatctatatggccatgaggatgggtagatgcacctctcatttcaatgaaatcattagtatttgtcctaaaatattatattttatatttagtaattttatatttgtacctcttaattttatgtatttgaatctctttaccaagttcacatataaaaataagtaaatgtaccctcttatttaataaatattaatatttatcttaaaatattatattttgtacctcttatatttgtatctgaatctaactattctataatataatgataattataaatttttattttttaaataaattacacccactgactcagggtcttagttctgccactttacagcaaggtttaagtatatttcttattagaaagaaagtgcacttagttttttaattgctaagctctaagctgtagatatatatccttttgtcaaagaaaccgcttaagttacttgcggaggttatttgggcggaaagcacatgcgttacttagtaacggttcagcagtttcaaccttgtgttatttcttgggtcacacttataaggcgtgctttctaggtgttcagactttcccaattgtcactttatatgttggaaaaaactatctcgtgatgatattttacttttccacttggattgtggaagtggaacgaacaccttcattgtggaagcataactaatttcatttgttaatcccactatataaatatttggggtgttattttccaaagtatgatctctttctctcatagcatgtatgtgtgtgttttccttttgttcttctgaatggtaatctggttccatttattaaaccatttagctttcttctttcgactttaaacagggctctattcatttaattagcatctcagtttcttatatggaggaaacaatcagaaaagcttggatataatggtgaaagctactcgcaggtataatatttggcgatagatacttcgtgttgattattatgtttgttcttaagaaattttgtatatgctataatttaagtccacaaatcccttaaactaacataattttgcattttgttgcctgcaatcttactattaggaaaccgaatgaaagtatgaggcatattgtgttactttttgttggaggattttttggcttaattgtaggattatcacttccaccactctcaataacaaaggtgcagagattgaacatcttattcctggtgtaccttatgcttgagagcatatttcatatttattcatgtagttgatgttatttaactttataatggaactctaatggtgcttaacaatttgcagctgaatctaccatacggcctgcttcatctctcttgtgtacaggaaaaatatatagatagcagcaccgcatcccaagatcagtttccaagtgatgcaacaaaggtatgcatctcttcttgtcatccatgagaaggacttgaaaattgtagggtgtacagtgattcaagaaagttaggggaaaaacatattttattcaattatatagttggagtaaaacccataaagtcaagaaaggttcagcagcttataattgagcatcatgcttcaaaagtgattgactttaatttggaaggaattagagattagagatgtttactcccatttagagcttaagtatgatcattaaacactgttattgaaagcagaatgccttgtgaacagaaacagcgttggttaataattgatcaaatcaaatgattgtcagaatatatatggaagaaaacaagatattattagaattttatgtggttatctgacaagagtgaaaaggaaaattaaatatagcagcgtgagatccataaagcctcttgcctcttcttttcctctccatcctcttcttatttgttaatcaattataaaacataattgtcaaaggatttaaccatgatttcacattatgtaatatttgaaaatatgacatgttaaggtctgtatatatgatgataagacatttgctacttgttttcatgattgtctgcagatttgggttccaacaaatccaagaggtgcagaaagattacctcctgggatagtcaatgcagaatcagacttatttttgcgcagattatggggtcttcccagtgaggtgaagtctactacgagagtttatttatgtgctcaatgtagctacacccttcgaatgtaataagaaaaatgcagctaaacacagattaatgtgctgttaaacattatgctaaggttatttaaagagaaaaaggatcatgcactgaaaatgtaaaaagttctatacaatcatccaatcgcaatccaccatatattgtaagtatattgacttttaaattaattatttaagtaattcaaactataatttatgattaaatgacaatgtcagtgcatagacattaaactcttattaaaagtaacaaaaaatttagcttgccacatgtgatatttttctttctagcattattttctgttttttctttattctgttctttatttacttggactaggagtgcctccgatatttttgttgtgtgaggttctccatatacagagagtttgataaaatttccacttgcaggatttaacctttaagccaaagtatcttgtgactttcactgttgggtatgagcagaaaaagaatatcgatgcagctgtgaaaaaggttctctccctttctcttcctatctttctctgcataggtttttggacgcgtgtttaaactagatatgccacttgaacagttttcaaaggacttcacaatcctcctctttcattatgatggccgaacaacggaatgggatgaatttgagtggtcaaaacaggccattcatgtcagtgttcacaaacaaaccaaatggtaaaaattctatgcttaaattttcatgatggcatattttcagttaatattgtttaccaaactttaaatggtttgttatttctttttcctcttaggtggtatgccaagaggtttctacatccagacattgtggcaccatatgactatattttcatgtgggatgaagacctgggggttgagaatttcaatgctgaagagtgagtcttagatatatgatgtatgtgtattttctttaatttttgcttgttaaggaagtttcacttccccactaattccaatcgcagatacctaaaactggtgagaaagcatggcttggagatatcacaacctgccttggaacctagtaaaagtaccaaagcggtgtgttggaatatgacaaggagaagagagcatagtgaaattcacaagtaagagaactacttttcttgtgctgtgttttaatgtgagtgtgttgactgggtatttctttgatttcgactagagaagcaaaggaaccaggaaagtgtaagtaccctcttctgcctccttgtgcagcgtaagtaactgttaaagaattttttattttattttttttttgggaggggggttacaatattttcccatctttaattagctgattccaccattctgtaacatgcaggtttgttgagattatggctccagtgttttcacgaaatgcatggcgctgtgtgtggcatatgattcaggttcaatggttactctattgattttttttcaaatatctcattagttattgagaacaattcttgtatgagcacttcatacctcataaaaatatcagcatgacattgaaataattttagattgttattttaacgtgttttgagattttgatttggttgtgtctagtaaccaattgctcatacttaattgttaatggtttccaaaataagttatgattgtaacacactgctcattgcagaatgaatttgtccatggatggggtcttgattttgcctttagaaaatgtgttgaggtaagcctattacctgatattacttcctatggaactgatatgctatatggaatattaaactgatacttcctatgttatagcctgcccatgagaagattggagttgttgatgctcagtggattgtgcaccaaggtattccctcactagggaatcaggtaattatttttccattatcattattcctattatgtttaatttaattctaattatttcactcaaatgcaactgtatatataatatttatttgtttttgttatcctgtgtggttggtagggagaagcacaaacaactgaaaaaccggcatggcgagcggtaagttatgtatctttcatataatgaagatcattagcacatcctttttaacgtattttttattattgattaaaatttattaaaatctacaaaatcaaaagacccattaaatgaaggatgggacaacctacaaaattatacctaatttctaataaatttgagttgtaaagaatgtgttgctaatattattcttttagtagttgtttaggatcctctttcttgaccacatagctttttgcttctttttttttctcacattagaaactgttacctacattgatcaagaagcagtgtaataatgttttgtttttcttaatgggctttgattcttaaatatgtggtattggtggcaggtgaaggagaggtgtggcatggagtggaggatgttccagggtaggttgactaacgcggaaaagggatattacaagtccaaaggaattgatttttctaatttgctcgttcataattagggggacaccaccaaattcttatacatacatcgccaccgttgtttatgttttcgagatgattattttgacatatattgttttattaatcttgtaagataaagtttggataaattattcaataaacagaagaagacaaaagcaattaagataaacgaaggatttatttaaaaaaaacaaagattttttttacacaattaactaatcgtaaattgttaacttgtctattacaaaatctttcttcttttttttttccggaaatatccaatacaaaatcttgtgcttaggttatatggacttttctattcttttcgtgtggatacatttaagccatcaacaacacatcatgtttatgtccggggaaatttctagattcatttcccaactcccatggttgctgtgggctgtgacaaatgattcatttatttatttatcatttctaccattattatcaataagttcaaatactataactttatgttcgattacaagccagccatattccttgaataaaaattttcttttcttcaatgatactccatctttgaacatattaaaagatggattttttaaatagaatgatgacgcagaaagttcgcaataacactttgctttcctttccttgaacgattttaagcaataaaagaaagtacaatatagtccacaaagaaaagtactaaatatttaattcaactatttatccaagcaagtgttgtaattcagtgggtattccgtattccaaaggcaagagtcttacattatctagttatacattatttatttatttgtttatgtttcaatttgtttttaagaattttaaagtggccagtaaaagtacgggactcccatatattaatttgggccttgtggggcttgatgtaatgcgataatatgcctcacatagaacatctttatctaaaaacaattcacttttccaaaactcctcttctcccttcctttgttcttgggttgaaaaattactcttgccagcaagttcagattttaatatatattgtgcaattactataactgatgcagatggcatcataacatattgcatggttagggatctacgagaaaaataacatatcataaacaacacgtatgaatatgttagagaacactgtttccttaaaatatatttcgaaatctgaagactggtaaaaaaaaaaaaactgaagattggcgtatttcggtctaatgataccaaacatgataaactaattaaaatctaaacactgaacatatatacattctgttgagctgaaattttcaaacaggtcctaattaattatttagaaccaattgtacttggaatttatttagaacacaattttatataacgtatcattgcttgttttgcattctttctacataacatgtactgaaatagggggaaatctatagcaacaacccattatcactataagaaaattgaaaggagaggactgaaacaaatacaacacgccatatgagtgtgaggccttggtgcatttatttaggtgaaataaaaagaaaaaaacagtaaaacccctgagtagtagtacttcagttgtagattatttatgatttatgatatgagatgtgggtaatatggctacgagtcaatttgatgccattttaaaaggggagctacaaaaattgagggatgaattattcgtaaaactttattataaaagtctcaccccaaaatcttttaaccattttaagggtaccccaaattaaccatacacaatatgtaacaatgcacataatgcccctatgatataataatagaaatagctatttatatacaacagaggctcatcaggcaccccttgttgacatgagcctggctaattccatcctcgtatgctcagactgaataaatgcctcagcttcttggtccacacttttgtaagcactatgattccataacctggtactttcgtaaccttgttcacgagcctcaacgttggattctacttcggctatagagtcctgctcatagttggttctgaatgccatatgacccttcttgtgatgatgatgcctaggactatgatatgtagcctccactggggggtcgtacacttggtactcgtcagaggggaatcgccaccctttgttgttgttcctattgtagttttggtatgccatttctaattataactttgagggtgttgagctaggttgtggtgttgcttcatcttaatttcagctaatatttatagtttttattattccatgatgataagaaagaatttaattcttctctctcttcggcatgcaaaaggatattcggaggaggagatttatttgatatttgtgcatggagctagcatccaattcggtatttttcttattgttcaaagattccaacgccaccatcatttaaccaactttaatttgttcctagatagcgcaactcggatgaaattcgattcgtacaaaagtttatatatatatatatatatatatatatatatatatatatatatatatatatatatatatcccgctttcatgtgcaatttggaattttattttagtggcatgaccaacacttcagaaactgacgtctgtaatagttcattatttattaacaccttgcagatctaagttaattataaattgaaacaaaatagttattcaatgtccacagtcatgtatctctctggttatattccttataattttttttgaaaagatagagtgggataaaaaagaagctaagaaaaagagttttaatctcaatattttactttaaaaaaaactgaaaagaaaataaaaagtgtatatataaaacatagtaaaaacgtgtagagataagatctcatgcaattgtataataattggagatgctcctaatctatagaggacgacttaacaacgtcaaaaaaaaggatgacttaattaaaaaataataatgaaaggataaaataattttttactaactgtaaatatataaaagtaaatagtctttcacttttttgaaaatgtggaaagttgatcagtttgatgtatttcgttaattattgaatttttattaagcagtcaaggatcaaagcctataatcacaaggcaacaaagttatctatgaatcatgaatgtaattttcttttaaagtcatattagaacgtcactattaatctccatttctatattcaccacgaaaggagtggaagaaaaaaagttaaatttgattcctaatttgcggaggaaattaaatggcatattaatattccttttctcaactacaaagcatttgggttggacccgtaattggttaatcttcttgttagcttttgtgttgggccttaacccctccttagttctgaaaaatatattcaaaagtgttgcacctaaatggactagtaaaagccagattaaactagttggtttgaccagttggacaattggtccctcatctggccagaatgacccttggaattagtcctcataaaactagccaaataatcagtgaactagtcaatgaatgtgaaaattgaccagaactggggttcatcaattttattcttctatccaaattccaaagtaaaaccttttcctaaactctgatagaggcaagcttttaggttcctttagaggataatggaggataaatgctagtggacgttggctaagtgacatgagtcatatgttgaccaaagaaatcaatgaagaatgaaagaggttttatgggaatgggaggaagaagatttcagtagctgaatcatgttgtgtgtgaatgttgtagagcttatggttcccaagatctaagagtgattgaatgtcctatattcttagggatcgaagaatgcctatttgggcttcatattaaggagctcggaagaatagacaatggttggatcactattgaatccttcactaattgtctaattcaatagctagtctagttttataaacatggcttaaatcaatagttaacctattaattataacttctattcgtataacaaactcattacctttttggtacatttgtttcttttttttggtacaacaaactcattatttaattataaattatattaatgaaataaatataattaattttctcttataatatgagttaaagaactcatcttagaaagtgaaattgtcaccctccccactctcaatcaaacatacttaatattcgctttttcccttctttagaaaattgtaataggaaacttaccatcgaccctatataaaatgaaaagaaccctaagggaaactgaaccaatatcaagtccgacacgatttggttttcaacaaaagaacttcattgatgatacatgcacatgtcttattgttaactggttaaaattagtctaatagaaggactttagaattagaagataacatgaataagcgctaaatcacaagctatctaaaccatcgtctaacgaaagacctcagtaaatagcacatccccacgctttattgcatattgtctaaatcagtcaaataattttatagagcaaaatcaatgttggcagattccaacagattccaaataggaaattaccattctacagagggaaacggaaataagataaaataaagcaacatatgtcgcgcccgattaatatcacatattggaacggcatccaattgaaagtaaccaaactaaatttatgtaatgcaaagaactgagtcagcactgttatgaatatagaccaaccccaatcggattagatatttagcataaataaagaataataagaaaataaattggtctgcagaacaaaacttcccaaacaggaaaaagtggggaattttaaactactctcgtatatcggggatcaatcacactaataccaaataaacacatttcatgaaggcaaacccgttctcaaaacagcagtttcagtcctcataagtagagatgttgctccccttgaatgaaactccagctctaaattatatacagaactccccctagatcaaagaatttatctgaaattaaataattcccaaagaatatctcactggacaatgatacagctatacgagtgacacacaatcatcacaacctcagttaaaaacctccgagagaggagagtcacttgagctgtacaagctacaagctcagaaacaatgcagtatcataaatgactttcctagatcatctctctctcttgcaatttccaggtaaaagaaatttatacttctcagaattttccagaagaaaagcaggaagatgaactgcagaataggaatggggtattggtcccattttaccaatgatatccctgaaagtgtactcctccggcagcatatcaaataaatcggtccctttgcagattaccttctgaattctttcaggatttaaatagtgagagaacctgactctatcataatggctgtaggctttcatcttgaaaatgaaatcatggatttggcggaagcaaaagctacaatgccagccagcatctgccaatatgtcatcagactggcgataatgtgcatacctcgtcttaccagtctcatacctgtgaattgaagccctccagctcttatcatccacatgaaattcaaatgaatagagataatttttcagctgcagatgaaggattgagggtacttcatcacaccacctcaggaggttaatagtgtgagcacttggtatctcatccacatcagacataatcaacaagtcatcatcagtaataccagctatcttcaggagctggtccaatgctacacgctgatatgcctcttcaacaaatgggttttctcctttcttaaatctcccaccaatggtcccataagttaaccgcggctcaacaaatttgaactgctccctgttgctactgaaaaccagaggcttaggcaatccggtgaaggtggaatttgactcaaggacaacaaattcagttatgtaagggtacaattctttccagcgcaaggttagtatttccaactcattgctaaacaacacagcatcataaacacgtcgagggtactcccggactccccatccatgaagcctgcaaagattctccatggtgacattttcgttatagtaatgagggatgacattgaaaggcttgggtgctttttcccatagtggccgcagaaagtaggagatcttttgcccatgtatatagaatccaaagacacacattgggataatagcaaacatgaatatataggttttcacatccagaccacgcagaatgcagcgaattcgtgacatgcctgatactttacttgattcctgcaaaattaaggaacaaacatataagtaaactgtaaaaatccagcttcaagaatgaaaaatcatgaaataaatatcatatgcagcttcattaaatcatacacaatcttatcaaaaacccaatgctcctctctctattgatgaaaattttcaagcatcatataacttaaatccccaattgtaatcataaagccaaaagctgtatcatgaagaaaaaagaaaccatgcccccaaaaaaccccaaattgcaagctcttcatgcgagaaaccttgcacccattcaaatccaattatggctacaacataaacgaaacccctttccctcccaaatgaatcccccaaaaaataggaacaagaaggaaagaaaaaaaaaaaggtgtcttcgtttgcgttcacttacaagccaaaaaaaatagctcagcgggtttcctaaaattagagaaaataataataataataataataacaacataaaaaacgcaaccttatcccatacctaaattcagatctcgaaaatctcgttcacacaccaaaaaaaaaattaaaaatagcacacaacaaacaacacctaaaaagagcaaatctaggacaaaagtttcatcacaatccagtgatagattacatgacaaaccacatcaacagttttctatggaaaaaccattcaaaatgactttttttttcctccaaaataacgaaatccacaaattaaataggcgaagccacagctgaaagattaacttacatcgacaccacataaacggaaaagtaacatttaataaaaaaatattatggatgatatacctgaccacagacattggagcacaaatcatcgctcttcttagaacagtaattgcctccagtctcgctcatcatccaccacatttcggcgtgtctttcacagtccaacgtacgaatgaatcaaaacaaaaccagatcgtgaacacaaagtcgcaaaacgaatcggcgtttgaaattttagtgttaagcaaagaaacacgttgtcgttaaaacacagcagaggaaacaaaatccgaggtggtttatatgtttattcacacgaagagagtataggacggaacaaacaacgaggaaaagtaattagtaaatagcctctctgtatgttggaatgggtggcagttgtcgtctccacacagctagctatggaactgataaaaaaaaaaaaaagagagagaaaaagttccgttacaagattggtgattccactttctctatcccaatttctttctttataacttaactaataaataaagtcttgacctctacttttactgagtctctcttctccacgcgttgttgtgtgtattgagtattgactcgctcgcgacaactggttcagttctctgctaatacgtgttattatttcatctaatctattacggaaacaagagggtatttattcgcttggcattttcatattttccataccacactacacgtggcagccagcgaatgtgtgcccggttttgcttttttatattcaacacaaaatattcgttacacaaacaaacactttctcagtatccaaaaaaataaaacactttctctgtttcacttcttttttatacattgtttttgttgctacaacttttccaatcatactatttattgttaattattaaaatttatataaaaaaaatacataactcttaatataaagtaaaacttgccaacaaaatcttgttacggacttagttgttggtggtcgtttcttaatgagttgacaggctcaatttacttaaattttattatataaaaaaagaaacctgtaaattatgtaatttttaataattttaataccatcaaccatataggtcttttcttatagatttattgatctcaagactatttttaaaattatttcattacttttaataaaaataattttaattattttataattttcataatgagttgttttaatatatgtgaaataattaaaaaaaaaggcactaagatgtttatctagatgtggtactagaatcctaagttagaaaagacaatcatttaaaaaaaataagattattaattattatcatgaaaaaagtataaaaaaaattaaggacacgaaatttaaatatataaaattgagaaatcaaaatatagatatttaaatatttatatgtaatttttaaaaataagggatgcaaatacatctctttattcatatatgaattgtcatttcatgaatagatttttacatataaaaaataataacttaaatatttttttagttttttgtaatttaacgatttcttacatttagttcctgtaaaattatgtttttgtttttaatttttatagatatatttttctgtttttcattcctgtgatgtttcagatagtttttttattgatcaaattcctatttaaaatgttttaagtactaaaaacaaaaaataattttgcaataattctaaaagaaaaaaatacaaaattgtaagaaaaaataatgaaaaaggtgttatattcgaaactcgaaagaatgaagaaagtatacaagcgacatttgtcttggttacattacacttgatgatcaaaacaaagagtattgttagaggaggttgtaaaagaaagcggcaaaggtcgattttttgttatgttattgtttagtgtgtgctggaacagtccaatacaacactgccaccatgaaggttgtgatgatattaaagatgttttatttgggagcattaagttaagctaactataattaattaatgactaatgacaattatgtatggggaagaggaccacgttaggagtgggcccgtttagcaatgatatggccccccaccacgagcttgtcgccgttggctcgtctcgctagtttttaagcaagcctcccttttttctaataaaattattattattcattatgtctgtttagatataactgtttgatagttttttatgagaaatataaaaaaaaaaaaaatcataacaaaaactctcaaaaattacttttaactttggatggtataacatggacatgttaactaatgtattcttcctttaacccaaacattcacactacaatgctcaacactgggctgagactaactgcctcaacttgtccaaagtcttcttctctagcctcctttccaagagcatgatcgccctccgatttgagttcggtgagcccaccttccacccccacatcactgttgttggagccatcaaaacacccccgacaaagccctcaccaagcttcgatcagcgtgtgaagccctcaggcccttccacattatcgtcaacggcgttgccgttgacaccttcttctactagtgcctctatctcctcctctgccccgaccctcaccttcacgaaactagcgcatactatagggaatctcgatggtgtcattgtctttaagaagcgaggtgaaggttattgcaacggcgaggcaccgatggaaaacaggattaaggacgccgtggatgagaaaggggagcccttggtcttgtaggttagggtttgggtctagagcatggccaaatgcagtcctattcaatacgaattgggacccaatatactgttgccgtcgccagcgacagtgacaatgacaacaacggctgcacctaatcggcgagaaagtcgtgttttctattttaggggttttgattttggatctcaatttgttgtttggattttgggtctgtttgcaagtctgattgaggttgcaagagggagtagaggcgacgaatattaagggattcacagtggtttggaggtaagggcgatttgttgaggtccatggtgtgtctggttgacgatggatttgagattttgcagaggttcagagtgggggtggtttgctacagacatagtatatctttctatagttatcaaacataattcagttgattttttatttattagtgaaaatgagtaatgatctattgattttcagttgatgtgggttcttggtatgattcagttctctctggttgaaagcagaagcaacagcaaaagagtgaagacttttaaagaataacacgtttgtgggtagggatagaaataacccaggtcatctattaggggtctttggtctgacctgtttaaggcctaggtctaacttgtttattataaagatcagacttaggttttttgaaaagtctatttaaataaaaaggtcggattcaagctttacaaaaagcctattaggcctgtcatgctagtttatacatatttttttttacaaacctactacaaagatttcaaatcttttttattttaatatttatttatctatatatatatatatatattaaaactaaaaaatatataaatcaatctttaactgagtttgttgtgattagtgaattttaatctcatattagagtgctttaattaattttaatttttttcacccacaaattaaaagggaagtatgtcaatgtgtgtatttctttatattaaattaaaaaaagtattatgcgaattctcgaagtttcactaatatataatatttattgtaaaatagactttttaataggcttgtaggtcaagtcagatttttaaatagactagaccaagcctaaaaaaaaaaaagcctctaacaggtaaatagattaggcaggcttgatgtttttaaataaggccaaggttaggcctaatcgagcctgtcctatttccattcctatttgtaggggcatggacaagggtataatgggtaataagaattttaattagaagaaaggggggcttgcttagaaattagggaggcttatttagcaagatcttaccatttggtttgcttcgttcgaaagtaggcttgccctcgaaccgccagccaagtcacagtacgctttaaccaaccgacgtcttcttgcaaaaggcccaatactttattattattattatcgagaattaccaatgtgattcccaaaaaatacacaagaatcattgatgcagaatatcttaatcaactgcaaaaaaaaaacaactaaattctatctaaactagaatatctttcctaaattgtatattttttttccttttcattgtcgttttgcaatttggtctccctttgttttaaaaaagagtggccttcacatataatgtttaacgaaaatatttacatatttgtacaataaagtatcacgtcaataaataaattaaaactgctctataaaaagttcatcaacaataaaatattgtcactaaaaataatttaaaaaaaatggagctctattacaagctactaattaccaactaagactcaaaatttaacagttttgtacttgtcacgtgttagaaatcatcttatattttatcgaaaataaatcaacttatttaataatttttaatctcgtgaccatttataattaaataaaaatcaaaaaatatttactaaatcaatatattttaattaaattatgttttaaactacaccctatgtttacttttatccttccaaattgggtaaggatgaaacaacttacaaattatatggatttgtttggcacttgtaaacaaaaatcttattcttgaacttaatacatataggcacgttattgttggtctcatccatgatgtcgatatagaaattaacatgttgagccacttgaatgcgaggctaaaggaaaaaaaatatattaatgagttagaaatataagttttatagacgaaaatattacatcatttgcggtacactcttctcttcttttttaccgattaattgtaacccaactatttattaatagcatatagcttacccagtggattaataactttacagcctttacagcacttgtataatagtattaacggactgcgtattatattccaatatcatccccttcagatatccgacaatgcaaatggcataacaattatacactatacatgtgggaaaccgtggaacgattccacctagcgaattgacaattaacgagtctaccacgatcaatatcggaacaacttactgatttgaatagctctatttacaatatttaaatgatcattgagttggttcaacattgatggtatactttatgagtgaggaaataagcttgatggtatactttatgagtgaggatataagcttccttgtctggggtcaaaggttgtttatccaaaatattctagggttaaaggtttttatccaaaaaaatttagtgtgtaatttgtgttttttaagctagtgttaggattttatttcactttgtgtttcaatacattttttggattttcaactataattttttcatgattttattattatttatgttctttagggatatgattaggagtgaatagattggactatgtcgaatcttatttaagtctgatctgatctactttatacttttataagttaatcttgggtttattatttgtcatggatttgtttttttggtctagtcctaatctctctataagtctaatttaatctattagcttatttaaatgcatgtttcatgttaaaaagtgtaaaaaaaattattgtataataataaaattattaaacgttaaactattaaagtgtgaaccaactatttatatgttatttccatttactttttgtttatttaacaaagttgtaaatttcattaaaaataataaaataattttaaactaaaagatgtgacaaaaacttatctaatgcctataaatattacacatgaatgtcatcaaaactttttaagccccaccaaaaaaaaataatctctatttctgctacccatatatgcatatagcaattaatctataccaaacattaaattcaatcatcaaatcactaaaataattttgtaatttttttgaaataattatgatattatatcatattaataataataatatctttattaaaataatattgttgctaattaggctcaatccatcaagcttaataagttttctttttaagtttatggccttacctatttaattaaaaaaggtttttttaaaagctcgtgacaaaaaataatataaaagggatatattattagttacaagggtatatttatcgatacccattaaacaaaacctttcattttgatggaccattaatatttgtatttaacccatcacgacttacatatgacacttatattctatgcgttcttaattgcatcttgcatcttccatttttaaaaaatccccagcctaccctttctattttctcccccttattccttttctttctcacgcaaactcttctatttgttcttctcttcttcccgcggtgcactcgcttaacagttcttctcttcttctccaaccgaattcttcttccaactctcgacaccataggttctagcgcagaagtccatcccctccttcaactctccacgccaggtacatttcaacatcaccgttgtggacatttttccagagctggctttttggaacggtttttttgttttcaaaataaccattcggaaaaaggttttccaaaacacctattatggaagcaattcctttccaaaaagcttattttggatttttttttttcatccaaaaatgccctgtcaggaacaccttaccaaaagccaaaaaaccattccagaaatcctgttccaaagtgcacttgtttcttctagagtgggcttttcataagcccagtaataccttccaaaacaccctttttgtatatctcattcctaaaatttttgctttcaaaatgaccgttttgtaaaaaggttttctaaaagcttatcctttccagaaagcctgttctagaatgtacttgttgcttccgggaaagactttcttaaataccttttcatgcttatgaaaatgctattctgaaatcattttttggatacggaatggtccttctagctgtttaatagataattaaatttgatttgttattttatagttttagtttgtatggaagatgattacttcaacaaaagatgttggttgaagttgacatggatatgaataataaataaaaaaagttatttttggataagaattaaaacaactacaatgaacattgtaatcattttgagagaagagagtgattgcactaaaatattattgacaacattacaaatcaaaaaaaattaaaggtactaataaaacaagctgtcacaacaaagaaaaatgacaattagagaatgatgtcataaataatatgtgtcttcttttatccagatgaatggaagttattcaaatttgaatccacaaaaaaaaataattgtgagaaataatcttaaataaaatttaaaagaacctgaaaagttttaaaaaatatataaataaatctatttcaagatttaaataatctgttaattagcgttcaagaacagatatttcaaaatggttattccattaaacaaatatagaattgaaacccagtttaagaagcatatcacagagatagttccagtcaaggcgatcatatgccttatttatgtcaatttttaaggcaacatctcctttctcacctccctttttacaatttgaacattaaatggatactaaaatcgtagtatattatattaatttattttatcttatctaatacagtgtgtgaactaggctcttaatgtgattattttaggataagaaccatgtgatgaaaaaaatatattaaaggacaacgtattattaattattatttttattgtaaacggatgtatctttattatgacaatcacgtacaagaggttccatggagctagatgggctccatcgatatgcttttgatggtttgcagatagctccatttcactgtatagaatgggcctacaaatgaacgggctaactagtaagtcacattcctaactccgtggatgctttcgaataaataacggggagccggatatgtatcctcacaaatgtggcttgcatattgatctttgcttaatagatggaaagtgaattcttattaatgccctaataaataacatatcacgcatgttttggctacagttttttgtatttgttatccgtacatttaacatgcttaaaactaatgatggtgtgagtgataacttaacatctttgcttattggaatcttgtgcagtctaattatgattacgaagaatatgtttggtttaaaatttgtaaagtatactttcatttccttctcctttaaactgagtttgaaggtaaaattgaagaaaaactcagtttacagtcagactcgaatctaaatcaaacaaaataatctttcagctgtactttttaacagatgttcaaaactcttaatataaacacaacgcacacacgtctcgtcgccctagcttcttttaggcctcaatagtgttcactgttcaatggccagattctggtatattccgtataacatatccaatcggaccaatcctatatcttgaacacttcgaccacgcccatgaagcatggtccatggaattatggttggtggcactttataatgcctatttatttcataaccatctgaatggtataacaaactagctaacaccagtcatgttgtgctgtgctattgtctttatttttcagctggggtagcctatttatttatgacaatttaaaagatagatacaacctcaccttcaaggcatacggagtagaagggagaaagaaaaattaaaagatgaaaatataattaataatgtgatattacgatagagataaaaagaaaaataagatataaagaaactgataaatgcacgaatgtatagttatttttatttatttatactggttcgttgcatattgcggggttcctgaagttacaactcattttgttaggcttacgttaacaagttggtagtcacaactcacaactcaactcatgttatgccccttctaatcaattaaaaacaagaagatatctttggatctagagtgcacctgcggctcccaatgaaagattcctctcgaatactactacttatcattttcctctatatgtattattttgattgaacacaacacaaggcagcaattcagttccttatcacaaaccttacaataattaaaatcacatgcaatcctaattacaaaaaacctatccccaacccccccgtattcctaattacattgacataaaaatgttaaatcaacctcccggaggaaaagctgagaaagtcacgagaattgagaagccgagcagaaaagcgatccgattcactgacccttaattttatagtttcccttcgcaacttaccctcttctctatacacctgaatccctgctttgtccttaacctctctaaccaaatcccacaatctaagttctcttgccccatccatcatctcttggcactgctccaacctcttcaaacaacaaatcaattccaccgcttccccaaacttaaaccctcccaacctctccttaaactcactcaccctcacgcgcacctcaacttgcaccacgccccaatcctcacgcgccaggttcacaatctcctccactaacctgttcccgttgggctcgggcctcttgcaaatcccttccaccaaagtcaccaaggagtcaaaatcggtcaacaagtccacgttggccagacccgacaccctgtcttcgctgtcggtcgaggttccgaggaagaatcccaggatcctggaagtgcataagagctgctcgatgtgctgcgcgaaccatctgacccaggacgagagttcccatgatgtcgggtcggtgttgtgtcggaagttggagaggttgaggtagtttctgcccccagcggaggggtacacggagagctggtcctggaggatgaagctgccgtggtggatgatgtggtggacggcgatcaggcacttcagggccacggcagcgttgttggtcccctgaagccggtccatcaggacctccacggcggccgaggcggtggcgcgtgagccgtcgcccaaggagaggagcgtggccaggtgcttgcgcgtggggggcgtggaggaatcgtggctcgtggcgcgtaggagggagagcgtggtgcgtttggataacaacgccgccttgctctgcgatgctttgtccttgattatcccaattagatgcgtgagttttgtcatgtttatgtggcgtgcttaaagataaacacatttacacagacactactcgcgcatgaaaatttttatggtggaaaatggaattaaagcccaacccaatctagtcagctgtcttggcttggccctagtgggatatatgattatgaaatgatgttgccttctcagctataatgcccagccagatttttattttatttttatgcgttgttcaaatttgcgcatgttcaatcgagtggttgatgacttgatggctctagaacagtgcatatatacacacttaagttttccattttctttttcttaaccctcgatcgataaatgaatcatcattaatacaaaatttaattagaaaataaatatagtctaattcaaaattaattttaacaaaaattacttgtattcaatcacttaattacttacatacatattatattgaatattaatttttattttttataattaaatttattacttcttttaaacttatatataaacaaaaataactaatatcatatcaattaagaaatttaattgatattatttaattttttaatctcagtaaaaaaataaaattatttttaaaatattttttatcatgaatatttttttatattaaaaatagaattaaaatcatatgaatgatattttaagaatgataatattaaatatgataaaattagttaaaaatttatttatatttaaattaaacatatttattacttatatgtttcgaatatatattttaaatatttatagtcgtctttttttctctttttgataaatggggatagtgattttcttttttaacgggatactttttttttgacatgttttgataggatacttaattattagcactattgtttttttttaggaactagtaagtaaccgtgcataatgtatagataaaaatccagtgcaaaatacttaaaattaatgagttaactacatatacgtgtttggttacctatcatttacacacttagcttatgaattcaaccattctttttaaccgtgttagatcacactagttaaaaacaaataaattaaataataataaattaatgattaatatttatgattattatacttgtaaatgcttttttaagaattataattgcgagtgataattttgaaagtatttgaccaattgttttaattttatgaattaaattaattagaacttagaattttagatgttatcttctcgttttataatttttaggaaacaattaaaacgaacaatattataatttctgaaactaaattgatgattactctacaataatagtactttctaaattaacatcccaaattaaataacttgcttcccaacttcctccagagtttacaggtccataacgggtatatttgccttttattttcttttctatctttccataacttgccatgagtttctggggaaaaaattgccacgagtctaatattatttttttaacaacatttaccatgcagcttcgagaggtcacacagtacgtaatatgttattgtattgctttggtattgaaatttatgacctgttgattttgatattgaaaattggatattggatagtagattaaaaaaatgtaacgaggaaagagaaacagttgaccagtagtttcttgactttcttctaaaaccaatctaataatcgtagacttttaaacggattggaagaataacgattgattgtccatatgctacgtaccaaatatacacaagcagtgccaattgaaagggtcatctgttcaattggattacgttgaaagagttactttaattcaattttattggtattattttatttttatcattgaattaatttgattttaaattttagtaattttattcaattgaagttaaaaatacgatttttttggtattgcatctcattgaatgagtttcactcattaatctatgattttgtattttctaataattttagactaattccataaaaaaaaaaaattagactagtagcaagagagtttattaagttgggatttttggagtatttcaaaaggctcatatcccatattacttagtttaatacttttttctatagtgtttatatatcaatttgttttaaggacttttagacaacaaagtaagaaacaaagacttgcacacatgagattgagttaagtggatatgatgtggtgtaaattgtcatatatgtccctttacgggcacaagaattattttaatttacagattaaaaaattattttcagagtttagttttaattttggtttaagcttaattaccttcaaccaaaaagaaagcatatgcttatcatcacccttgaccctccccaaaacaagcatatacggttatggaattgtaattgatagcaagtaagggtgtacaagaacatacaatgactaatgtttttatcaacgtttttcttcttctttggatacatgttaaaatgtttcaatggacagcgcattcttatatcatttgtgtatgtaggcaattgcttcctgcccctctggctttgcttcctgcatcccataattgcttctatctttggatacatgttagtatgtttcaattagccattccgaattgcattctgggttacatttcgaaaaggctaatactaaatgtaaaattacaatttaaattatactttccagaagattaaaaaggtacagaaaacaaaatggaagtgcaggaagcaattgccgtgtatctactatatagtatatacacaagctgttgaagcccatgcactaatctggtaatgtgaagggccggggaatatataaatttctaagaatggtgcttcatacaccatttaaaaattctacaaggccattaatttttcaaaaacccgaaaatacccctgctgctttggacacttattttagttgagctgagcaccatttttgcttcttgtttgttgttgatttttggttcgcctcagttgcatttgagaagcattggtgatttttggtgccattttggttcatttggttggagttgtgggtggttgccggagcggcgaactcgtcgtcaaagtgtgcaaagatgggtggtgtctgctatcgtacggattcgataatccgtatggatgctacgaattagataatccgtatgattcttacgaattggtcaatccgtatgattcatatggattaggtaatccatataactcatacggattggccaatccatataattcatacggattgaccaatccatatgactcatatggattacctaattcgtatgacttatatggattgaccaatccgtatgagtcgtatagattatctaatccacatgactcatggattggccaatccgtaagagtcatatggattaggtaattcatatgccttatatcagtattttttttataaaaaatcaaaaaatatatatttaaatgagattgatttgaagttgacaaataatttcgttgacaaaatacaatacaataaatggatttgccaatccgtatgaattatgtgaatctgtatgaagcaaaaggcataaaatagtgaaggatattttggaaatttcactgttacgaaaatggtgtattagaaaaacgaacggtgtaggaagcaacattcttgatttaaaatatagaaagccagaatgggaattgcttcctgcgccccctaaggaaagtgaaagtccagaaagtttttttattcttttatattgtccaaaacaggttgttgggggcaaattataaattgacaagccattacctgagttataatgattacgaagttcgatataatgaatcagaaacaaatgcaattagatacacattttgaagaaggaaaatgccccacatcggctcctagtaaatgttcccttcttaaacgttttttctctcaatatctacatccaatgatccaagattttggccttttaaaattaattgtcgcaaaagaaatactagtacttatataaattaataatctacttgtctcaaactcattgattctactctcgtttcaaaatcagtaactcatggattctactccatgcatgtctttcagatcctgttttaaatatgaagtgctaaagctgtaaacatggatagaattatttctgtaagattgcttttgcgcaatattagtaacaaggagaatatgatgagctgtcaattacgcgtaaaaatgcttttggatcctgattattctcactgacgattggactaaaacgatgctccagttttatatgtataactttacaacataaacttttaaattaaagttgattagttatcagaagacatttgtcgggcatataggtcgacaaaatgtttacaaaatttaccaaatattctacattatacatatattaaatgaaatataaaatatgaattgaaaatgataaaatattaaattcaattgatgaaagattgtttcttaataaaaatgtaaatttaaatacagagatacaaaacgagtgaaactttaatttgttgtttcgtggcaaccgacttttaacccgtgttgctttatgtagtagtgtatttcaaatttaaatctctatataagaattaaattatattagtagtttagaagttaatttttttttcacctatagtaatttcattcagctcaacctagagattagttaaatgtccaatgtaatatatatatatatatatatatatatatattaatggtagtaaaaaaattaagaaagtcgaagattctttgattaaatcatggaatcttgatcagatagatggattccacgaagaaccaagttctttatcagtttctttgtgcacacaaaataattaaaaataaataaaactttaattaaattatggttgacaaaacttgatgtgcctattgatttgaccatgagctaacgatatgtttgctcatgcatacaaaatcagttatcttctaatttgactttgagcgttgaaaaaccaatcctgcagttattttaaattaaagtcaatggtaaaaaatttgctggcaacgtacttattttaatacattctacactatatattagttaaatttatcaaaaactgtataagtgcgacctattaaatatcaaactgataatttattttttcccaactcaacttaatttgtatttaaaactcattcttctaaaacttaataatactgttcagatttgagacaaaacgcaattcattttgattctgctaaacgggaatcaacaaaagtaaaaccaagtagttaatattttcagggaaagaaaacaaaaacaaaaacaaaaacaaaaacaaaaaacggtatcagcgtgccgttctcctccgaaaccatcacaatctggccacgatgtcctacacaactacgagggcgaataaaatgaaacagttcgaaggacaattaaagccatgctagcagctctggtctggttgaccacaatgattaagcacagctcaaaaagctaaggaaagtggtggaaaaataaaaataaaacaaaatgtcacctggacctaaaaaagaaaacactgagttcctgatcaatgtctccctctggatcaatcaagtggaaagattcacagttgtctgagccacgaaccctctgaaagctagctctaaggtacataagttgatcatcttctttgttcactaactccttgcacttcataaccccagttccgacaaccaccgaacgcatcaacctcagcgcttcgaaatcagtgttggagggcctgcgcttaacggcataccccaccttcctcccattgcagtacatagtccacaaaggcgtggacaaaagtgtgtctatttcgccatcgccgtcgtcgtcgttgttgccgctctctagggcgattcggagggttcctcctctcatttccttggccaagatggttgttggaactgccaactctaggaggagaattggattggtggagttggcgtttgcctgaatgcaaaagctcacttttcctctgcgatatccgaagatcgtgcctgtgatattggtggtggagctcatcagtgacaatgatggtgaataaatatatttgcttgtgtttcggagggtctcgtttgttcttgttgtttcatcttggtcttcttctataatggtggcgcagttacatgtggggattagtagttgcatgagagaacgtagcagcctccatgatctaacttgtttctcgcagtccactgtagtcacgccactggccatgtagatctaacttaatgtcgctattgtttcagtttatagctacctcttcagcatggtttagggtttgtttatataatacatggatgatgtaaaatacgctaaaaaatatactactagttaaccttaagttaatataatttttatttaataaaaaataaatttatgataaatataataatgtttgttggtataaaatattgttagtatatattgatataataaaacaaatttataattaaagatgttgatcaattaatatgagattattttagattaattagtatttttgaatttgaattcttatatgtaattggatgaaatatttgaaagaaatattatatgacttagtaacaaaattattttcagtaaaattacatgcaatctggtatatatactaaagagatattaatactcaagtttttcattagatcaaataaaaagagtaccttttcttcccaataatattagttagatctcattttatgttattgtgataaccaaaaatgaataaatattttacaagatatatataaaaaatggttgtccttttcgttttttgattttaatattcaacggttgacctcatgcacacttgttcaaaagaaatccacaaattcacggatcacagcgacatgtgtcgaatagtgtggaattggccaatcgggttcaacatttttgggttgccaactaaaagggttatctaatgcagccccgttgcttgattctgaaacaactcatgcacacgctcagtggatagctcctgttcccagtttttctaatttaaaatatttctcttatttattatttgaggtttcttttcgtttgtggacaaaagtacctgtagcacgctggagcagctatgtctgaaaataattaatatgtaaatattaggtgtcttctttcttttctctttatttttgtgagattaaactttgatttcagccattgaaaaatgcagaaaatttcggagagatttccgtacagtcataacccaccaattcactatcattcaatcattaggcaaatagatttcggaccataaaactccaaattcatacacactgttcaactcttatttaatttgctctacacacacacacacgagcatctttttatacttttcatcaatgataagacctgcctcaccaaaataaaagagaataaaacaatgtgtcggacttattatagcagacccacaaaactagcactaaatcttattctcatgtattattttgcatatagcatgtgagatgaactttggaggcaaagcgtgttgtgtggaggctaaaaaaaattggatgtgtttagctttctagcctggttgctccactcttgtcctcccatttcctttcgcttatttgtcgggtatcgaagactgtcacaggaaaaaacttgatcttccatattttttcagctttcctagatattcagtacgaattttgatgctatgagcagacaaattttgatgccagagataatgaatataatttacttgatgcataagttaatttgtagaattattttttttccaaaaaatgagttttaacttataaatatattaattttagtttatgaaaaatttatttatttatttatttattaatttcccccctataaatacttaaaagaaaatcttatccaaataaaccctaattgaataagagatcatgacttatatatttacttatgcaacataatggcggtaaatccatcttttcattgcaacaattaataagaaaatcaaattagtcgtgtatatttagataaggatataaacaacttctattcaatgatgttctaaactattacatgatagaaaagagtaaatatttgttttgaagaggagagtaaaagtttttcttcaagaacaaaggttctcttagtttatatatatacaaaagttattgtccggtcgtcgtcatctgtgaacgactgaataattctacattttttttaacattctcctctctcacttaaaaaaatcatacatttacacatgacctactcctaatttaaacaaaaagagctaacttaagcccaatactaagacacaagtcttaaaccacataaaattaaatgaatatgtttaaagcccaattacatattagttattagagtgaaactttcggtagcttcaatttttacttcagataccccattagattctataatatagaattatattttggagtggacattctgaaatgtaatgggttgcttgagaggtgcaggaagcaacactctagttatcaattgtaaccggtattttgttttcgggctaattaactaatacccgtgtttataactaaaacatatatatgtggtcatgttcgatattattttatctatatcttttatgttgaaaaagttaaactttggacttgtactgcattctaactatgtatgtagttttcaacttgatcatccctgtattttttcttatcgaatccataatgtaaaatccgaaaaaaacaaacgtttatttttcgttcacttatataagatgtaattaataattatatgcgttttttaaaaactctttttaggatttttcacacacacttagaatacaataattatgattttcaacaatatcaagataaaatgtgcccggggttggatttcatgccactttacctacttgtattaatgataactaaaaaacttcaaattcaacaatcaatcctcaaccataaaagtcactagaaatctaatcccttagtggttaaagactaaatctcattattaattcctattccctaagtaaatcaataatgaaatttgcattaagcacatggtttgcaagatggctaagtattcatgcatacaccattcctagtgtcaaacccctagttatcttaccctaggtataggttttagtaacattttccaaattccaatgcaataaaagccaaaaatatgtggtttatcatgccacaactaaaatagagagaaagagaataagaaagaagattgagaaatgaaaaatatattaatataaaaaaaaatgcaagatgttcagggtcattacattccaaccccaaatactaggagaatttagctagagagagacatgaaaatctcaaaacatgaagaagggaggcaaggtcttgaagagagagtcatggaaaaagcttcacaacaggtcccaacttcaagagaaatgttctctaatgtaaatttggtcaaatcctcgtatcctgtccttagagcagctccagcggtggtatcttccgcgtttcttatctgagctggaacggtttcttatttttcttttccattggagtaatccagctggcaaaaatatgaacctgaaatttaagatgcgcatctaatataagaaacgtttcttaaagggcccacaaaaaatccctaaggactgcatataagctcccaccgctggagctgctcttaaataggatctgacatgtgcctttttaaaaaaacacatgtgacacacttgcactcaagcgctaatttcagctcgcttaaacgtgaggtagaccatagcgctaattaagcgtgagttaggctgtcttgcttaagcgctacatgatatgtgcttaagtttgaggtttaatctttctatttgtatatgaaaaaatatttattagaaaacaccaatctcctaaatagatattcatattctaaaaaaaactgacgcatgattagaagatatcctaagcatccaaaaaaaatgtcacttttttttattaaaacaataagaaataaagaatataaaatgaaactcttgtaggatctgaataatcaatgctcttacaacattggttaagaaatttaaaaaaaaatatttattgtaaaaatcataagaaaaggtaaacaaaagtcactaccaatgtaatttgtatatcccaataaaaatctttttctttttagtttattaattaatattctaaaaatactggttaacatttgtcattcttgtatgtaatgttgtagagaaattattaaataattttttatttttacattttcatgatctcaattaacttttgtaattaaaaaatggttctttaattaataataataaattaaacaatgattgtgtatataaacactcacttaaacaatgcagtgtcaagtcaatctgttataaacttgtcaattaacgttggttttactttggagaacctctaatgaaaattttcattttgtataaaaatattaatatatttaataccgtgtcaaatagagattaacgagacagaatgaagaaaaccatgtaataacttcttttaatgatgcgtgcatagtgattcatcactcaagcaaacacttaacggtactgaagcacctaactttcgtctctggttcgttagttagaagcatgagcgggaactaaccttagattggcaaaaaaaatgcgtgctatgttcaccttctattcaaatctccaaccatcgatcgaacaacatgtacgtacatgctcctcacttttttctcaactattgtgcttctcttcctctttcattttttcaatgctcctatgggaagaaccaaagtctccaccctctttgccaataaccacaacaacaattacatgcttccttattccaacaccatacgacaaactcttgtaaacaggccaaatacccacaaagaccggttccccttttcaccctttgaattattgcggcgccttattcgttcaagtattccttaccatatcttcttccattttcattcacacttctctctagctagttattagttactgttatcttatatactgaagtatttttatttttattttttttttggttttctacttatccgggttgagttcaattgcattgtaggaaaagtagatgtagactcaaaaactaaggaagaggagaaagtctactcttggttatacaccttggcccagtcagacaaaaacctggttttcgagtacgttaggtccactgagagaggcaagtatctgcactctgcagtaccttgtgaattctacattgatactgaaaaaaatgtctactttccgaccatataagacaatcttatccatgtgttatatgattatgtttaacttatttatattttattttatgtgttgtcgctctaaagttagaacttataactacgtagttcatacaaactatccaaaatccattaagttgatgctagtgggtcttggttgcatgtaaactagactgcagggtccagtgttttcagcttttcatttctgtgaattgtgatcactgaattaaataccaccctctagttttgtgccatatgaaaggtagtatttttcaattctgtgcaggcttaagtttcacagaagccgataggagactgagggaaaatgggccaaatgttccacttgagtattcctttccaagatggtggcatcttctatggaacgctcttttccatcctttcattatcattctgattgttttgtcagttctgtcattcattacctgcgacagtccaaatggatttatcatgctcatattggttttcatcagtgtcacccttcgtttctatcaggtttttctacattaattagttggttgcattgaaacagtggaattagtacttctcttcccttcacttcactctaattccgacctttgtttgtgtctattaggaatatagcagctcaaaagcagcgatgaagctttcggaatttgtaaaatgtccaataaaagttcaaagatgcgctggtagagttgttcagaaagaacttgtagttcaagttgatcagagggatgtagttccaggtgacattgtgatttttgaacctggtgacctctttcctggagatatcagattgttatcttctaaacaacttgttgtaaggtgtgttatgtcaaccggaaaatcttctggtttagtagattagagattagtgaacacttgtattcttcccattgccttttcagctaactaaattatcacatggtgatttcataccctgttaacagccaggcatcactaactggggaatcttggacaactgacaaaactgctgaaatcagagaagatcacagcactcctttattggatttaaagaacatctgctttatggtgagttagtaacacaattccctattttgtattttgtttccgttgaagttatagcttcattttaagatgtagccatcaaaaatattaaatttccgatcagagatagtctgattgaatggagaattttgctgagaaatgattagttattaacatcacagggcacaaacgtggtatctggtactggaactggcctagtgatttccactggatccaatacttacatgagcaccatgttttcaaaagttgggaagaagaaaccaccagatgaatttgaaaagggtctcagacggatattttacttgcttatttctgtcattctagcagttgttatcatcatgtttgtgataaattacactacatctcttaacttgagccaaagtgttctttttgccatctcagttgcatctgccctcaatcctcagatgcttcccctcatcattaacacatgtcttgcaaaaggagcacttgctatggctaaagacagatgtatagtaaaaagtttaacatctatacgcgacatgggatcaatgtaagtataaattcacattgaaaatcaactgattgatgacttggacactaaattcatatgcagttgcacacatttgaaccaacttataataaaatatgaattcaagtttccattcttacccagctttaactacgctttcccctgtctctaccatcaaaatcaaagaaagggaaaaagagaattggaacctacaattaatgattagatcagcatgcgttttaattttgcagattaaactagtggaaaccagaatgtaaaaatctatcattattgttgattaattttgaataaagaaagatcagcaaggcacgttcttaacaattatcaagacataaatataggaattatgtattagaaacattatgaataaatatgaacttgtagtaataaacagagaaattgataagtcggtctaaattgtgttctaacttctaatcaatttggctaattgtatacgtggtgctaaacttctagtatatcaattattgatgcaactgcatcattaacaatgaatgaaaacataaggtccaaaaatattgcaaggaatatatgtcttgttttaatccaaatatgcatctttctagcaaattctttttctgcgtacttatatttttaaatgttgcagggatattctttgtattgataagacaggctcccttacaatgaatcatgcaatcatggttaatcatcttgactgcaggggtttaccccaagaaaaagttttacgctatgcctttctcaactcttactttaagagtgatcagaagtatcctctggatgatgctattctagcatttgtatattcaaatggattcaggtttcagccatctaagtggaggaagatagatgagattccttttgacttcataagaagaagagtatctgtcatcttagaaacagaaggcggacactcacaattctttggcaggttcctggtaacaaaaggagcactgttagaagtattgaaagtttgttcttttattgagaatttcgataaagatgaaatctctcccttctcttcagatgattatcagcagattttaaatctctcagaagatttgagcaatgagggattaagggttatagcagtagctataaggaagctggaaatggtgtgtcttttcttcttgcatcatccaaattgggcgtacatttctcttcatatattttagatagaacactcactaaaaagatcacattgtcaaaattattctcttaggtgaaattattttatggttcatgaccaccacttatttgtagtcctggtcaatctttatataacacataactaaggttttttattttttcaattaacgaaaaagagttaataaattcagctacgtgtcaaggggaaattagctaaactatagatacttagcagttgtaaactatacaataacttcttattattgtagggaacggtcctctcatgttgattttttacatgacaacacgtgtctatctctctcatcataagcattaaataggcggaatcttattagtatttgtgaatattaatggagatagttagaaacaaagtttccacacaaggttatgtaaaaattcaatacgagaggataagagaataaggagcacctcattagctgtggctgactcactttcaatttcaatttacgtgtgacattgcagccgcaaatatgcgaaacaagtaatggaagcaagagagaagaagaggatattgaaagagacatggtgttcatcggcctcataacgtttttcgacccaccaaaggactcagcaaagcaagcactgtggcgtttgtccgagaagggagtgaaggctaaggttttaactggtgactccctctccttgacaacaagggtgtgcagggaagttggcataagcaccactcatgtaataacaggtcctgaactagaacaacttgaccaaaatactttccatgagacagtccaaagagccacagtacttgctcgtctcaccccaattcagaaacaacgagtggtgcaatccttgcaatcaattggaaaccatgttgttgggttcttaggagatggagtgaatgattcactagctttagatgctgccaatgtaagcatttctgtggagtcaggtgtagccattgccaaagacatggctgatattatcttacttgagaaagacctcaacgtgcttgttgcaggagtagagcatggtagactcagttttggcaacacaatgaagtatgttaagatgtcagtgatatctaacttgggaagtgtcatttcactcctcatagcaacactgttattcaagtatgagcccttaacttctagacagcttcttactcagaatttcatctacagtgtgggacagattgcccttgcttgggacaagatggatgaagagtatgtaaagacacctcacaagtcatcagagagaggcttgtccatgttcatgttgtggaatgcaccagtgtgcaccctttgtgatgtggcaacacttttgtttctttggttttattacaaggcttacactgatgtgactcagaagtttttccattcagcttggttcattgaaggtctcctattgcagaccctccccatccacttgataaggacagagaaaatccctttcatacaggatgttgcatcttggcctgtgattttctccactgttgtgacatctgcaattggaattgcacttccattcacacccattgggaaggtcatgggattctcacttatacctctctcatatttcggatttttggtgcttctttttctggggtattttacagttggccaggtggttaagagactttacatattggtttataagagatggctttgaatatcaaaacattcatctgtttagtcgcataaaatgctactgttataaagtcaatatcaagtagaaacttttcgtgtcatcaaacacatccaacattgctgtaatcgtaccctacaaatttcaaaacaataggaattacattcatgaatgaataatacgtgcattaaaattttgtatactatatttagctaatttcagatagttgtttatgttccgtccgaaattccagtgcttcctgtcatttttctatttgtgctatcagttcttgatccgcttatcaccttcagacaataagcatctatcaaaacatgtggaacatttgaaatcttttacttgtctgcatttgtatgagttgcatattgtcccaggccatgtattaattaacaaaaccggtttagtatgtactatttgataagaaaatttagtttgttagtcactaaaattatgtactagagattattcagatagaatttaaaaaattaggctaaattacttagaacgttgaacaagaaaaaacattcataaaatgtaggaaaaggtcctaccgggagtcgaacccaggtcgctggattcaaagtccagagtgctaaccactacaccatagaaccgtgtgctatatatttcctatgattataacaaatataagatgataatagtgtcttaaaaaaaagatgcagccaatagaaaaagaatttgagatccatgcaaaaagcatatgaacattgtcactctaactattcgtttatttattttttaatagatccactttcttccttatgatgtgctgatttcgctatttaaaagaataaaactttttgaaaggagtaaaaatgtaaaatttttagcaaaatgttgatccccattccccactaacattttgtcaatagaaaatctactttagattttgtggggaaaaaaaacaaagtaagaagaggaaacgttgagaataatattgcaatcaattaaaacaatgaagtaaatgataaaataggtttcaacaaaaataaatataaaaagtaaaagaggacattgtaaaaaacagcagtattaaatttgagtagcacgacaagaaaactaattaaaaaaaaaaaaagagtagaagccatttagttgcgctttaatttttttgtgagaagtaaagttataatctttagagtaaattgttcaagccttccttttattttgtagtttttacataaacctctcattttataaaaatatgctataattaaatcccgaacctttgtttttatagcatgctacatttaaatatagaatcattgtttcataaatcccgaacctttattttattacatatattgagtcactatacaaaaataaaggttttttttacgttgaagtgtagaatataaatccctcaaaaattttgtcactgctttaatccttgaaaagattgttatcgtatgaatatatcctttgaagatttatttagtcgctcatcaaagattttattcaccactttagtcattattcacaggatccctttggtgaaatttaacatctcttctctcaaagactaacatgattatattttaaaactttgaggaactaatttaatgataaattaaatctttacaaaactaatttggtgataattttttaagaagactaaaatgatagtatttttatttcgcttagtaaaaacaaattaaaagattaatacagtgacccacgtaagtctaaggatgaaattttaagttttatatggttgaaatacttgttaataaaccttaaaaatgtatggagtttcatgaaaggacaaatatttgggatccactagctagtaattctaagaaagagacacataaaatatagatagaggaaatggatttagcgtttaatatggatgtattgtaaaaaaaaaaaaattagtcatcaattttagtataatttataagattgttattataaaagtcaataaatctacttacatgatgggtgtaattgaaaaatagtaaatgatgtttaatacaagttttttttttttttgacaagtatcatgttttatgaaaacaagttcaatgcacaatctgagtattataaatccattggatggcatcatgtttcatacaagttaaccaaacatagccaaccaagtttgatgcatgattaggcaaaaaaagagggaggggttatagaataaaagagagagcatccatattcatatccgcaaactcatgttgaaacatacaaaacagtggtcaaatttcccaaacttttcatataattgtatgatttgtatcactatatacgtaaagcatatagataattgctgtaagggaagacagacagagacatatgtggagtagaggcatcactgctttgctttggataaacaaacgttcatcctccatcaacagcccttgatctttaaagtggacctttcatcctcctaaattagtgctttacaatggaagagttgaactctgactcctagagtgtctggagaacaaaaacttggtgttatgtgaaaaagatcttctcattctcattgagacggagaccggcctctttggcaacgcacgtccaattgaagccaacttgttattaatagtagttgttgaagttgaactcccactaccatgcttctcatcagcaacaacactcatatccttgttacttgaataattcactttttcaccacaatgatgggtatctaaatccaccaccacatcacgaaataacaccattgaataagcagaagaagaatccatggaaaccgatcttctcagaggatgtgtttcctcttccacttccactgccgaagacacatcatcttcaaccctctcatgatcagaactctgcacgcgggcctcttgatgatcagaaacgtttgaaaccgtgtgattattctgatcaacggctctgatcacatgcgcgccgccagtttcgtcgcgtagcacaggtgcacgacacaaggggcaatttttgtgagaccggagccacgtgtcaatgcaagggatgtggaaggcgtggctgcacttgggcaacaacctcagactctcgtcgtgttcgaactctccgaggcaaaccgaacactcggtgccgtctatgatgccttcgcctttcttgtatttgaataccgtgatagagtctatgagggactgttggagacccaccgtacggatgtaccatatcgggtggacaaccgccaactcctccacgtcatcatcgttatccgaactcggaggagaatctccgttcaaatcgagcaatatggggccgtcgactcttctgttttggttattgcggctatatcttcttgagtagaagtaccttatgagtacggacacggtgcagagaaatatgatgacgccaaccatgcatgccatgacaatcatcgagagttgaaaaacatttctgtgatgttctttaagggaaggtatcgtgaatttaggatgtggggtacgatcatggtgttgttgggttccattcttaggaagaggagccattaacggaacagaggtagaagcaggggtcaagtattctaatattctatggatgtggaaaatattgttgcatagagtgtggaatgattaaatggtaacatgagaaattcgggcttattttgatgggatgggaccatttcattttctattggagactcagactcactcgcgaatttacttagtgctttcttttttttccaagtccatggactttgtgatggtttccgcgttagctttaatggtggtggggcgttaccagattcttgtaatctacaatccttttcatcaaccaaactttctcttttttgttttttcataaataaaaaaaataggacatttttggttctcgctttattttatttttttaaaaaatagtttttgactaaacaagttatttgtgtaattttaaggtgattttatattaaatagtatagttgtataactataagtaaattacataattttttattataaataaataaatcattctcatataagaatatcttttttacacaataacataatttttgtcattaattaacgtttttctatgcaataaaaataaataagaaaaacaaaaccaatatatagaaaaagaccattcccatgcataatatataaaagtaatgtaaaaaacttattcttataaaaattcaaaatttgaattattattttgtacgttattcgttatctcattaaagttcattagctaaagacatgatataaatagtagattaacccgacatttaagtaattacttgtgacgtaaatatatctccattttttagtctataacagcataaatcacatgtgaataaaacctttttaatttaacataaaaataaatacaaattcgactatatttatataccttttttatacaactatactcaacaatttctttacattagcatctatagtcaatcttgtgttaaagaaagaatttgaaatacccatcatacttgataattttttttaaaaaaattaattagttgtattcgatgtcttattttatgtcacaaaatagatattattaaaaaagatttatctactcactttgaaaacttttcactatacaccattgtagtataatcacaattggattgtttgaaaggttgtttaaaagatgggaatcaatgtcaatagcaaatttatcccacattgcacatatgatcctattacctctatttgatagaaaaatgtaatttaattagttaataatttaatatatgtcattttaaatattaaaaactatggaaaaagaagaatttatttaaaaaatactcaaaatctttaagggtgatatcaataatttttttcgaacttgtatttatcttgtccttctcaatcacatggcctataacattatattgaaactaaaatttaaacacgttagtatagaaaaatagttaatattatttaaatttaaattgaattgaaattatctccaaccattgcaagcaagaagagttgtaattcttaattcttcgaaactctcattctcaccatagatgatgtattagttttttttttttaagtgtgaagcttaaggaccaacaattattatttatagacattctattgatattctaccataaaaaatattattagtagtcattaccattataatgatagttactaaaaggttaaccttgcaaattcatatcgttcactaaatagaattaagcatggttttaataaccatattttgtgtttcgatcaattaaagcttattgtttttttaacatcgttgcaaattatttttccaaaattacccccgcttacttccttttatattccaaaactaccttcacctattttcttttatacatataaagataacattcttagttattaaaatacatatataaatatttactcttttaatgcaaaactattaaaatataaaataaatttttttattttcgtaattatcaccttacaactcatcccgacatcgtttttcacaaggctgaataaaggtcggggtataataggtttatttttattcctatctaacctgaaattttgactcaaatcatttatttatatatgaatccagtgagtaaaacctgagatatatggaacgaaactaggtcaatctaattttttaatataatatatcgattttaacattatatatatagttaaaacataaaaaaagtataaaggtaaattaaggtaaattttataatatatagtttacaataaaaaattattataaatttaatattatattatacaaaacattatcaacacataattattaaaaagaattatacatttttaagagacattaatggtaaaccaaactaggacgacccgaaccacaacctaaattgattctaataaaacacacagtgtttattttcaaaactttaatccatccaaatcaacctcggtggttaggttttactcatccctagtttttaattgattaatagtgtgaaactttttatgttaatagcgaataaaaaattaattcataaaaattattaaaaaaatgagagataaaaaaatttcttaaattatcaaataattttattatttataccttaaaagaactacaaattaatataaaagagtgaaacgaaaaagaaagttgtataagaagaatactataaaaaaaattcatcttataagattatatcttacttaaggaataaatcaaccaaatacatttaattaaataagttagcttatcaattttcaactaccaaatttatcagttagatctttaaatactactttaaattcatcaaagaatgtaactccatatataatttacaataaattctttcactttgttttaaattcctacccataaaaaaaatactaccttaaatctctccttcaaaaccccgcagcccttcccgcttaatccccgttttcttctatcaggatcaaataatgcaggacgaaaccaaaaacatatagtcaacttaaaaacaaatctgcacgtcataacagtaatcaaataagagcatcgctttatgactgttgatagatcaagaatatgatatgttacacaagtaaaagtttacccaaaattgaccattatttcatttttttttcgtaataatgctgtgtttataaatcatatatgattgttgaaatccaatacctgtcaaatttaaatgtttaattttcaagtatctcatgatctgtcttggcggtgcccagttagtggtgtcaaaagaggaacttttcctgcaattgctaagccataagctttgagcccgtcgtactcagcaggatattttgtcattaaccttattgtttgaactccaagatctcgtagtatctgtcagagatttatcattcaattagttgaaaaataatgcttatgctgccaaaatgaaacaataatttacgatgaaacatgcatgagcgaaaataaattgttccgtacatatatgacggttaacagggataaagagacactaaattatatttattttgatttcttgttctggatgaaatggtaagaaaattgaagtcagatactaagacaagatatgtcaaaattttataaatactattgttatagtatccaaaagataaagatttcttgattaattaggaaatgacgactcaagataactatgtattaaagatgacaagaataatcaataatcatccaagaatttaaggttgtggaagttttgagaaagtgcaagatttggaattcaaatatcaagagtttgaaattcaaaatgttagttatcagaagttggatgcactttctacacctgtggactaacttataaacttaatatgaattgatttcaagatagaatcggaacatgtagtacatttcagttggttttaagatggaatctaatattttgtattacacacttccattattactagtaaatttatcatttgctgatctcaaatttgactttactgatatacattaccactttgtattcttttaattacttatttaaacagtagaataactcattttctcagaagttgattacttatttaattacttatttaatatggtgggtggtccgttatgatctaggatagattttaatatcatcttataagagtttggacctaactcaactcccagagcaaattcaaaggatgaggatcgttcccacttatatactttattttagcattatttctagtcaatgtgggacttgcgttttcccaaataatataatttatccttcacctcacatagaaacctcctacctctaacttgggaacttgtgcactggaatgcattctcgcactctgctgtactgggaaaatcaccatcttatctacctaccttccttccttctttctgcctaaggacacttggattcaacatatggagagaaaaaatgacaagccaacgttttattttacatcaacattaacatcaacagcacctttaacccaaattaattggggtcggtggtagatgaacccaatgataaatcgaaaataaagcaaaagagagaagcagagttaaatataaaagaatggtgagaggagaagagaaaagaggaagaaaagaattaaaacaggaaacaactggaacatagaactactaaagggtttaaccctccatcagacttatagcttttctccactccgtcctaagacataccgtccgccaatctaaaacccactccattaggtcttgtttaactacctttccccaggtaagttttattttacatgcaggcaaatattgacattacccatgtttcaataaaatgcaaggaatctccgttttatttacattattacaataaaaactgtataaaaattccaggcacacacaatcccaaaattcaatattaaccagatggatttcgaaatctgcaggtattactttgaacttgcgccagactcactcttactctctaattatagtgtacatattcaatgttatagattaatgtaggacttgtaatccatttgattcattttcatataaatcccaattaatgttttctatatatgaatatatgaacaacactatatatataaagtgatgtagggtacgtctttacatgtggcataagtggaatgtatgcctggacatggcatggaaagaaattaaaaaagagaatatacataaaaacaatggtaattaatgaaaggctgaaagctcacttggaaaatgtgtgcagggacatggaagagcaatgaaaattgacgaaagccattcagtgtctgatagatacggacaaaggtacgtaagataagaagagcgaacaccagagattcgttcatctgcaagatatggttccgcgattggtttatgtatatatattggtagctctgctgaggtaccacttgtctcttcataaccagttacacttacaaatccaattgccttgtttgtttatactttttacgttctttcctgaagaagaattttctacgtgacctttggtaagcaggaatgtgaaaatgtaaaaatttgctttggtttacaaagaaaatcattgtcatgataggaattagcgggtctagtatattctttttcgttcacaatagtcactgtttgttttatgttcaaccacaggtatctagaggtcatcctgtttaaactgaaacaacttaagttcatccacacatttagtggttcacaatactcatgtttgacatcttattcaaagaaaatcaagcattaattatttcaatcaaatatacaagtacccattaatatgtaattttcatattatcagattcatcaaagacaaattcaggtgtttatattagtcttcaataacatattttcttataatattcttttactgatcctttttaatatttaataaaaaaattatcagttttttttataaaaaaaaaaaggtattcaacaaaaatatacacacttgatatttccaatattataacttggatgttgagattttcactagagcttaatggggaggcaaaaaaaaagtttttcaattgatgtggtgatctcattgtcatatcctgagtcctacccctaactacctagaaaggcaaccgaggttagtataaatgccatttccgcctctgagaagggcaatgtcagtggttatggaatgaccaccctagttaaattccataccattgccaattgtaaatatatattgaatttttcttggtacgactttaggacatttaaattcccgaatgccgtgagactatggttaaatatttccaatttagcactctcttagaatcatacatagtttattcctagaatcatttacatttgtccaagccaatgctttagagttagagatttacaggaaatgcataacttggacattagaaaatgcaaattacagcatgccatgcctcaccggtcttcaggattgcgttaatttacctgcaccagagtaatgtttgtaactttctgttgatttcaaacaactttcatatgacgctcaacttatgtttatgtttcaggtcttggcagtagtagtactaacatttttttattgacaaatgttagttgttaattgttaatttttttttgttagtgaaagaatcaaactcactatcttttcctcccttttttctccttctatcaccaagttataactccgtggtactaacatgttaactgcaacagaattcaaactttgtgtaacattcttatcgttctcttttatagacatgcataattgtccattttgagatgcatattacttcattttcatatatgaggataattttgttttttttctcaactttaggtaaattttataagttgaaatttctggcactgataatttaatatttgattattttccccctcggtgagctcatgcccaatgagatgctgattcggattaggaactgcataagctcaaacttacatagataatcgttgtaaaagatcatgccttatttcggcatttgggcaattgtattaaagtaattcaactgtagtgttcaggtatgacaactgagaactatcaaaagttgtgatgaatatctagacatgtaaattatgaaccttgtcttggtgttattgtaaaatgtcacaatcactgtcactgaacatttcatatgacttggatacaaagtagaaatgtattatcagaaaatacactacctttttttttaatcttgaaatcaagtccatttcagctttgctgttactcttgtttgtttaagttcattttcttgaaatcaaatactttagacaatgagaaaagcagttgaatagaggaagaagaataaaggtatgtttgaatgtctgttcaagatgtggtgcatgaattccaaagtaaatataatggcccacaaatttcgttttgcaaaataaagggtcatggatgcttcttggaaatggaggttggctcaaacttaggtttacaccagaaatccaaacacgcactaattggttatacaacagatgctacctgaaatattctccaaaagtatttttctgtctttttggcttattgaccttggtgcatatgtggcgtgtgccatttttatgaaacaaagcatcctgtctagcatcgtagacctgaaataaggattaaagtatgtggttttatttccttacatgttttataatgtgaatgtctcctgaatcagcaatataaaaaacgacatttcaagtgtggaggatcaaatgcatgcggccttatctccaagagtagagaagaactcgtaatcatgagatcacaaggctgaaaccttattgttccacctaggctcatcatcttcctaaattagcaatataatcaaatatggaatgtcttgtttgtgttcccctacatatagactgttacccaacttgttcaaaatttcaaatggatgtattagtttgtttaaatttagaaaaagaattttttaaaaaatatttttttagtaagtcgcttcttaaaataagtataaaactattttaagtaaaagtaatttatatagacatattaaaaatgtaaaaggttgctttttttattaaaataaatatttattttaacaaataaatttaaacaaattttcctcacataatcagtaattttgttaagaggataaaacagataatgggattaaggatcattttcactagtctatataaacaccaagacaaaggaatgatcattggtggaatgagcttgaaatgtaaatataacatccaaataaggaaaggactatggttgatgggaaaaaaatggatgtcttggtactctgccttattgtgtacggatttcattaattatacattttgcatttcataaatggatcatagtggctataggtatcggattcatttcgtttatttatgttcattgttttgctttgcagaaacgaatgacaaatggttggtaggagatccatcatgttattctttaaaaaccttaattagtgcaatgcaaactttcttccttttagttcaatgtattagtaaagggataactgctctgattcttgaacacttgaatctcaatattgttttaatgttgttgctatggcttctgcattttattttaggttattgactttttcattccgttaataatgttatgtggtgatgttatttttaactgatactttttctcccatcatactagttccatttgtatgtttttgttctgcaatgatttttttgtcttatgatgacagagtcaaggcttaatgagttgactgctactgatgtgatcaagaattagttttataaatcttgattttacaaaattgattttgcataaaattaaaattgaaatgaattgatttatgttagaaaaaagctattccaaaaggaagtatagagtaaaactttgtaagaatctctcaactcaatccaaaagctacaaaggacaatatttctggtatccgaaagctgttaaatgttttgaggtgatcatttggttgtcatagtaaagcatatcgacccaaattgaaaggtttattaaccaaatgttgggaaacgaaagggtaaatacgggccagattttcatcaatgaaaaatcgaacaaatcacaatagtgaatttgagacgatactttaacttaacattaatgcttatgtttatgaatagttgttttcaattgtcttggaagaaagagagagaaaaaaacaataataatatcactcttatgaaaaaggaagccctcctcgtcaagattctgttttctttcccgtaacttttgcttattctttctttgatttggatagcactcacaagttagaaaagagaacaaagttgcttaccactaggtgttatgcgctgtccgacaaagcctctcacctaatcaaaatcaagccttctttttctttgatggtggggggattcatctattaatttctcctttgtttttctcttcgttgtgtatctttgttgtattccatgcacagtaactggtaggcccttaccaaaccaaaaaggcctctctctttcttactttctaaagcattggaactaatcaaaatcactttaatgaaaaccatgtgattggctgattgatcatttgttggatcggtgtaattcactagttaactaaggtggtgttagctttgtttcccccccccccaaaaaaaatttcatattcattgatcatcatgcccttgcaagttgcaaattcaaagtttccctcttcctccatgcaacctcaaattttgtctctccacagcgtaaacttacactgtcttatgtgttcttgtttgtacgatcagacaagggacggggggcaacgtttttacgcattagcaaaggttgtgtgggtcctaagtttactgtcttatagaagaagttgagactaatatggcggccaaagattttgctaggagtctagattttggacatcaattatgtttgaattttgcaaggtgtgaatacagcccatgcagtgttgaaaaatgaaaatcatgcaccctagactagaactagcttttgcttcctaaacaaatcttaaatcacagattctgactttgtagaaagaactctctacttgcaagtgttccgctttttgcagttctacccacgatggcgttttatctacctaattgggcacaccacttttttccacttatgatcaaatgtctgatattgtttgatagcagaattttaattttgatgaaatttggctaggaaacgtgataaacgtttggctgcttcttctagtttatggaaaatattgttagtattactttatatatatatatatatcaagcgtcaaacgaatgcattggatagattttaaattgaattatactaatatataataggaggaagtttcttacctataataattttacaaagttcgagagtcattgtttctcttgaagaaaagttgtagtctagataaaagaaaaaatatattcataatctgtaaaaaatatttttttcttgtgaagaaaaaaaaaatagattaagagaaaacgcaccctcttgcgaagttagaaaagaccgtcaactttaaccagattttatataatgaaatttacatattgtctatcaacattaaaagtttgaaaattgaacccaagtctttgatagtgtgagttctagatgtgttaacccctacacactattatgtggaaaatgtattaaaaatgtagtctatgcatgactcatttaataaaaaaatgtttaaacattgaacccaagtcatggatagtgtgagttctatatgtgttaactcctatttatagactaatatgtgaaaaatgtattaaaaatttaatctatgcatgactcattgaataaacaattaaataaaaatccatcccgtttaaagtatattgtcttttatttataaaaaattagttaaacacattcatgtatctaaatgttgtaaagtctaggatttgtcccttaaagtcctatgctcgaccaatgaactttgaattacttaacctaatgtattataaaaatatgttaaatgattcatcattcatccaattttattttatttttatgcgtattcatccaattaaatatagtgatctagtcttgctaatctattttattttttttataattggacggattggttaaatttatatatggatgaatagaatagttagtaaaaaaatggactaaattgtcacccgacacaattattcgtttgctgaaagtgagagttcggagttccatacctataacctctactttatgggttttgttgacaagagcagagtatataataagaacattttcatataaaaaatgatagaatcgtggttttatttttttattttttttccagcttgtattaggagagtgcttaacaaccaaatcgggaagttaaacccagctggagaagtgggattcgtcagatatccattaaaaattattagtgtttgaaaacaaacagtgccttacccagatgcttttgaacaagtcagcgacacgaataattatgtcccagtgaccatgcaggcttattcttacgcaatcttaggatagggttcacgttctatctgggcacatggattcatgacatatagacatgtcattgtattcacaaaaatgatgccccttgtcggaaatgctctgtttctctgttcttatattgtgtttgcctaaatcttaggttcacgaaacatattgcttcggaagcaaagttctcctatagttgtctacaaattggacatgtctgttccccccatccaaggttttgagctccctgcaatctattcttgtggctatgtttggttctgcattaggattgctacacccaaacccgcgtttgagcatgtgtaacatgatttagttagggaaaaaaaaaaaaaaacaattgtaatttggatggtttaactaggagtagcttatgagttactgagttagccctttgccctgataaataatcgagaaatgctagtaacattaattttcttacactttctcagtgatttagaagtgagatccatcataattttaatttataataaattttagttaaatgtgttaaaaaaatgttgtcagcatttttcaaaataattaatattaaaagagcttaaatccaagatagatgataatgtgcctcccacaaaagcctgagccaatgtttgtgtgtctcaaaattggatctctaaggtagatgttgaaacttaagaatactatttatgaagatttggacgcttaaatccgtgaggggtagaggtagagttaagagacaattaaggttgaggtcatatattgcttgctattaggtcatctttgcatgtctttctaatgatgtgataagaaaaaaaatgaggaatatctgttatctgttatcagttcttcacccttaacttgcctgaattctagttttagacttttcaggtgttttgggtttattgaactgaatttgaccaagactaggttgtgtttgaaacaattataaacttattttttaaataaagtattttatttcaaatttaatatttagatttagcatttacagtttaattgtaaaattaaggtcatttaaaattaattttttgctatctcacccaaacaaatacttaaatttatataaattcctaacgattcataatctcgcacatgatgaacccatggttcaacttcgaagtctgtatgtctatgaggccgaagtatttgcagtaattatctctcgaacatttttgttgaatattaccccgaatttaatgtgagataaaatgctggaaacttgaaaacattgtatgggccggatcagcttgtaaaacggttattttgtttgttatgtttctacctcgttatttaattcactgccatgctgggttgggtcactatcggcctgcctgctcaatatttattttaacatttcataaaagaagctcaaactgtgaatattttttaaaaacttaattaaaatatattgacggtgtaaatattttttacattatctctccattatttttttatttaaatttttaaattttcatttttagtcaaaaacttctcaaattgttattattaaattgttttaaactttctttcactaaaaggtattaatcaaaattccaaaggtgccctaaataaaaaatatatataatattttctcgctcttctgatcttaatttgacattctactaaatcattcaaaattcattaaatttatatcaaattttaggaacaagaacattaacatacaaatgagttgtggatcacatttcaactagaagttgttaacttgttatatacctacatcaaagcaaaatattaaaaaatttaaggatctaaactcacccacaatgtaaattgaaggtaaaaaaatgaagtcaaaattaaggcaggtaaaattgaactgaattgttcactctccagttttaatacaaatgaatatcaataaaatctaactcaattaattaaatgaaatttataaattattataaatttttaacactatttataatttctatgaatgaaaaaacaaataaaagagtgtcaaatgcgatcttgataaccccaaaaaacttattgtaaatcgcaaagctggttctcacgctttcaacccgatgaagtcctcacaagtcacaacagtttccgttcccgtggggttatctatgccatggcccaccacacacgtgttgctaccattttacaaaactgggtcccattttggacataaagtatgcatattttctttttgatttttgtttttttctatgggagtagggcccaaggagtgatgggcatacttttgtgccaaaactcgctttctcccattctattcatgcttgcctgtcactggtcggtaactgctttgaaagggcctgaaattgcgtagaaaggagcacattagtacaatgctggacacaccacacaatttaccacatgtgccatatgtttaggggaaagtgtggggatctcttgcactttgctttcgcaacatttatcaccatatatgcctagctagctttccatttgccatgtaaaaaattcttattcaggaggatttcccattgccatatgttcttcatgatactctctagattcttgaattgaagaaggtgctgtctggtgccaagttatgatcatttttgtaaggaattgccaatgtatataaatagactccaaattaaaatataacgatcgtttttataaattgaattaaatttatataaataccaatggagtactcttttttcaaagggaataaatgtgccatgtacggggaaaacgtcaaataccttatgatttgtgagttgtttatttatttagatcatatgaacatggacctttagtgaaatgaaggaaaatagcgagggtcggttcaactggtaaacttaagcttcgtgacaaaaagggttgcatggttgttgaaggttttcattggcgcctgtcaattgcgatgtgctaacttattcaccttttaattacttttcatgaaaaaaattagcaaagtaaattatgttatttaactgttttactatgtggaatagtgaattatggagtggtttactaagcttgagatctaagagagaagaagataaatgcattctcgtttgtttgattaatctatgtcgcacatctaagagagaagaagttttttttataaataaaaaaactaataagtatataaaagataataataattctataaaattaaccttagtattaatattatattaaataactaaatgacacttattagaagtattagtagaaaaaaacaattaaaattccattaaaaaccaaatataacacttattttagaattttttttcaaatatgtctaactcaattcatttatcaatatccacaaattattataaatttatgatatttgaattggattcctaaatgtaaaaaatgtaaaatatataaatatatgttacataattattacatagcgatagtgatgattttaaaaaatgaaataacaattgttttttaagtctaaagtcaaaatttgttatatttgtaaaatctaaaaatatatttaatctaacaaaatattaaatgaatgaatgaaaatacatgctaacgtaaggaaaggagacttgtgtgattcactggctagagcagcgcgtgatagtagtataatagtattattactacgctgacgtaacgcaaaccttaagccggcttaaatagtggacgcaagctgccgaaagccacgccgtttccattttcatctgtccacactgtgcgctcctcgaggaaacggtcgaaaaaactgaagcctaaccggctaacccggtaccccaaaaagttgcatttgggttaaatttgggttcatttcataaccaaccgcagtagcagtcacctaaccccggtcagattctaacccgccttggtttatttaaagacacaaactctcatcaacccctggcctgtgaacttgttcacccttccccttctccttacttctcacgctccttccaaaacactccctttctcttttcccttacgacccttcttctgtgtgtgatgatgtagatagagaataaaaagagaccagtgtgcaggaagaaagagattggtcacttcttgtgtggctttgttttgttctgtgtgttggaatttgttgatgggtgaagagggagaagaggtgtcaagagataaggaacaacaacacatgggagtttatggaaatgagtggtcgtttagtagttgctgtgcaaattggcgccgtttaagacaccagaattcctgttccatgcctccttttaagtgaaaaaaagaaacatcaaaacaaaaacgtgttctctctcagcttttcttcttgagatcttaatatacattgactaaaagaaaaataaagggatcaaatttaagttccttgatctaataagatccgtgcttttgtttgtactactcatgaagagacttggcagttcggatactcggggtgctctcatgacgatttgtccaccaacaggttaattgaaaaaattgaaacttcggcttttaactctgtttccatgatgcgtgtttcatgtttgtgccttgtcttgtctcaacttttttcacgatcaaccatcccaattactcaaacctttcctatttttatactaaaattccttattctgttttttttttgtgtgtgtattgcatcacaactcatcatcatgttgaattatgctctgtgttcgtttgtttcaagagacaacaacagttacagttacactaaccatgattatgtcttgatttgaacagacgaacacagtccgaggaacaaccacgtgtatgggaaggagttccagtccatgctggaaggactcgacgaagaaggatgcgtggaagaaccagggcaccactctgagaagaaacgacgactaagcgtggatcaggtgaaggccttggagaagaacttcgaagtagagaacaaactcgaacctgaccgaaaggtgaagctcgcgcaagaactcggcttgcaaccaagacaagttgcggtttggttccagaaccgccgcgccagatggaaaacaaagcaattggaaagagattacggtgtcctcaaagccaattacggatcacttaaacttaactttgacaccctccaacaagacaacgaagccttactcaaagaggtaatttttacactggtagcttaagatgtgtatatatatatatatatatttatatatatatatatatatactattttgatctcatcactggtcgatatgggatcttcaacaagtattgaaagtttgtttgattgttttgttggcagataaaggaattgaaatcgaggctggtgcaagaagagaacgacaacaacactgaaagcgatgtttcggtgaaggaagagatgataaccactctgcaggatagtaacccgctcggtgaagccgccattcctggatcggactcgaaggagttgagttacgagtgtttcaacaagagtgatgaggtgggagggggttctgtattccctgtggatttcaaagatgggtcttctgatagcgactcaagcgcgatcttgaacgaggagaacaacaaccacagccccaacagcaacgcggcgatttcgtcgtgtggggttctgcaaagtcactggcttttgtcgtcgccttcttcttcgtcgatgaacaactgtttccagttccagaaacagtaccagacgtcgacgcagtacgtgaagatggaggagcacaattttctcagcgccgacgaggcctgcaatttcttctctgatgaccaagcaccaactctgcagtggtactgttcagaggaatggagttaagaggaagaagaagaagcttaattaattgagagcattttgcagggtgtatagtaattggatggagagagaaactttgtaaaaatgaaatggtcaaggattgaagaagagagggaaattgaagagcttgagagaaaggagaggggggctgaagcacgcatggcgtggggtcggatatgagaggttgatgacgataaataaaggggggtagtaatcatcatcatcaatctctcggccgtgcgggaaaaggggggtaatttatgaataataataatgattaggtcgtaattaagttctatctagtgagtaatgctgtaaaaaatccacaattcacctctgcttccacctttctttctatctctcaccagttttatcggcttttgtatttttatatctagattaatttcttttatcaaaaatctaagtttttcatattggaattaaatatttatggcattttaaatattatttacatgcggttaactgtttatatattattttttaacacaacttgaattttattttgataacttatattaatatttattgcaaaaacttattttgtaaactatagagagatttttttttattggcatattaaaagtatttaaagaattgtatttgtgatttgactttatttaacttgactttaagttttatgtacactaaatactttaagggcataaatgaattataggactgagaaacaggaaaaatagaaaagtaaaaatgtgttgttgaaatcattttaaatatatagtaaattatacgtaaatattcttaagattttgtgaaattacacatctaatctattttttctactcctgtatatcgtaaaaacatcacattgtgtcattatgttcttctacgagaaaggttgatgtaggctgttttgttatttggggggcaatttttttaagaaattactaatttgagttactttttaaaaaattatccgattaatagtaagttgtgagagtctctcacgactttgtgattaaagtcaagcacattcttactacttctgaaatgtttttgttttcctttttttgtgtagaagtaataaatataggtaccactctcctttattttcataaagtcgttcaaaagattataactttagttttttttcccataaatataggtatgacttctgaagtgtgttcattattcatttatttctactttatagttgtttgtttcatttcatttaagaaaaatattttgttttaaaattttctttataatactatttttaatttatattaaaagtagtgaattattttttatttcaaatattattaattattatttgtgtaaaacagaaggtcataatcatggtaactaaaatatttgaaaacaataaaaaaataaagaactaaaaaaatacaaataataaatgattatattagaaattaaaaaataattcatcacttttttaataaattaaaaatagtattataaagaaaactttaaaacaaaatattaaaaaaacgaaatgaaacaaacaactcttcgataaaaataaatgaataataattactttaaaagtcttacctctatttatgacataaaaataaaaataactaagaaaataaccttttaaacaacttcaaaacataaataagagttgtacttatatatatgacttcaacatggaaaaatataaaaaataaaagcattttagaagtcataagaatgtgttcaattttaatgagaaagtcgtgcatgacaatcatgatttattcctaatcggataattcttcaaaaagccatagtcttttaaacgatttcaaaaaataaatgagttgtacctatattaacgacttaaaaataactaaagtcacaatcttttaaatgacttcaaaaaataaataagagttgtacctatatttactacttctacatgaaaaaaaaaaaaaaaaaaaacatttcagaattcgcaagaacatgttcgactttaaccagagagttgtgtatggcaatcatgacttatccctgattggataatttttcaaaaagtacccccaatgggtaatttctcaaaaaaattgtccctcaatagtaaaaaatccgttgtaaatgttcaaaaaatagaaaaaattcagataaagaaagaatgaatatttaaatattacttttttggtatctatatttataacattttttttagttttatagttaaaaacatctcatattgaactcaatagtcatcatgttttttactattttgatccttgtaatctaaagttgtttaattttatttgcgatgaatgtgaattaaatgggtcatgttatattcgtttaaaatgactttaatcgatacttgataacgataatcaaatgagtaaagaaatgcaacttttggaaccaaaataggatgctctaaactataaagactggaaggaaagtgaaagttaccacaactataaggacaaaaaaataattaaaccaataatggagtgaacaattttgtttattgtttgtttatgagtggaaaaaatagtgaaaaaaataaggatgaaaatatttttgtactaattaaaacatgatattttacccaagtactttccaacataaaattgctagtttaaaaaaatatgggctaaattataattttgatttgtgatttttatcctcctatatttttcatgatttaagttcctatattttacaaattttacaatttcgatctaatcatcaattttgcattcattttttcttttattttgtacattttaatcaattaaattatttctttataatatattaaataaatttgttaggatttgattggactaaaaaaaacatatgcaaaattaacaattggacaaaaatagcatattttctaaaatgcgggacaaaaattttggaaaaaaatagcataacaaataaagataacaaagatgcagatcaagaacgagagagagaccaaaataataatttaataaataaaatttatttgattttattcaaaaataaaaatgaaaaaagaaaaagataatttttcgtatttcaatcctgttgaagaatggtaaataaaaaaataacttcactccttcaatttttttaacttgaaaaaaaaaagtaaaaatctaatacttccattagcatttatttttatttcatttgtatagaaaaagagggaaaagattaagtataattataacattaaggtggttaaatttataatagtttaaagtttattgtacattaatttatattttatcacaatttttagttgttgatctttaaaaatatactatatttaaggggtagtaataacacactttttaattacgcttattttttaattttttattattttgaaagctacaaaatcataagtgaaaatagataaataaagagtgagacccacacacttttatagtttttaataaattttaactgtgaatttaaaaagtatatgttaaataacatgttactagtattttttaatcctttaaagtataacttttacctttagaaaagtctcaatgataaaataaaaagaatgataagttttcactttaacacttgactttgtccttctaggtaaataattattatgtagaaaaaaacaatgatttgtgcttaattattattttagcatgtataatacacaagtttgatatttataataattataataaattagtaaaagagacactttgtggctctctatatttttgtacaaaaaaaggtataattgtgtttttagcaatttatcaattatattttggatttataataaaataatttaatttgtagtgtaaaattaatattaaattaaaattaacaggtagctaaaaaatcatatatatatatatatattgtgtaagcgaaattctgaagttttttttctctctcttgctacgattattgatatggtcaacatttactttttaaactttactatcaaaagattttcaaatgaaatttcagaactaataataggggtgtttgcatttcattttattatctaactaggacccgtgcggatgcacgggtcgcgctccgctacgctccgttaataataaagaattacacaattaattttcaataaataaattaattaacgttattatgatgattataataacaattgaatctaataaaaaaagtttaaaaatttcaatttttcattaaatgtaaatatatatatatatatatatattaaaccatttcatttgacttcaagtatttattggcatgagtcattaggtaaactatatatctaaatatatttgttgtgtcgtagcagggtcattattggacgcacaggtaaattataggtgtagatgaaagtaaaactttgcatgtttttatgctggtaatcgtaacaattgaattaaataaaaagagtttaaaattttcaaatgttatatgatgaaaatttaaaaacaaaaaatatatctaataaaataaatattattgattgtttgatatggaactatgttaaatatttgtaaaaaaactttttttccataatggttcattggttcagtcgtgatgacaattgtaatatttttctatataaaaataataagtaaaagtaaataatattgtgtgtgtgtattacatatatgaaaattggctaatgatgttaaaggattttcttcttaaatttttttctatattcaggtttactcatgaaagctttattagtaataaattatttccttcttaatgctttctttaatatattaatatttaatttgcttagaaccactttgctactgctaacactttttaaaagacattaaataagtttttttaccatgcttctagtgattctacgacttggatcacctgctataacaatatagtaaccaactatcccaaaagtataataacttattattgataggtttaattgtgtttttagcaatttatcaattatattttggatttataataaaataatttaatttgtagtgtaaaattaatattaaattaaaattaacaggtagctaaaaatcatatatatatatatatattgtgtaagcgaaattctgaagttttttttctctctcttgctacgattattgatatggtcaacattcactttttaaactttactatcaaaagattttcaaatgaaatttcagaactaataataggggtgtttgcatttcattttattatctaaagtcttaaaattaataataaagtgttttaaaattagttatcaaaagggactacaatcgaacattaaaaattgtagtgagattaaaagtgcaattcactaaatatgtacatcacataagcatggaaaattaataaataaataaaatactgattttataaggctaatgtttacaaaatattaaaaaaaaagtttgacttttacaaaaaataatatttacattaaaacttttagtttttttttttataaaatttaaattacacacacgaaagagtatcaaattataccaattgttaaaattaagttttaatatcaattgtttatttttttcttatataagaattgaggatgatatttataataatttatacatcctatcctattaaccgagatagaacacttgaccaaactttgttaaagggaataatcatctgtctgggttttatctattttttaaattatttttaaaaatttaaaatacctttgaagtttgaaataaagttgacaaatgtgaattctaaggtgaagaataaaaaagtctgtcacttatgagggaccataaatattcgttaaatatattattaaaaataattttttattggttaatattaattattagtttttgttaaaatatggaagaatttaaattcaaatttcatctctctccttttaactcttaaacctctcataattctaacccatcaagttaattttataaacggctataatacagacgagaatgattcaattatgtcagtaatttaataatatatctaactattgtttttaagccacgtgaataagaaagtatttatttcatccctcaccttaaaattcaccaaaccttttataattgatgaacttcacatctcatgcacaaacaaagctagcggaagagaatttagatgctgatgaaaattatgaagcgaagaatattccgtcaccttcaccaacactactagatgaaagccttggtgacgttttttgctccccacccccactatctttatcagcaacactacaaaggataaactaagttccataagcatctgtaggtagctctagcatcaactactatgtgttatccctcttatccaaccagttttcactacaaacaagtttttttattagaataactatatatgaaaaacgaaaatattaatatattaaagagtttttaaaggaaagcggcaagatttaatttttttttttcaaaatcaagagaaaatatgaaatataaaaacgaaaattcaaaaaacttgtttgaggtttttcattaagttatacagagatagttttttaattttataaacaagattcttggaataaataatttttcaagtgtatccttaatttgcagagcttataattagccaattttgttctatctacttataatgtgaaacttccattacaactgtctcattatatttattagactattatttcattttttaaaaattcactccttttattcattttttatttttaatcttttaatttttattttcaatcattatttttcaaggcaaacaaaaattccaattaatatcttattaattattataaactaaatatactttattatatacattgatcttaaatagaaaataaaaaatataaatttctattatgcattattcttaccctttttataataattttcttatgttctattttattcttgtgaactttaataaaagaatatttaatatttaattaatttttcatttgaccgaaattcctacattaatatgttttagttttatttatacttgcatcatgtcgaccctctcggtcagtacttggttagcctctcttgggaaaggagctcggaaatccgatgatccatgttcatgctatcaattaaacgtcaccaaacccttagcatgcaaacaaccacaaacatacagattataatacgtgtccggaaatattggatcattcaattgtggtatacataagtataatgtatcaatgcaaccaaataggtaaacacatacaacacaatatgaattagattgccttggctggtgctgattagcttgatataggatatcaaatgggtcaatctaacccaactcaacctaatttaatttaccttttaactcattaaaatgaataactaagttgatttatcacataaataaataaatataaacataatattacaatcataaaaactttacaagtttatcttaacacaaatctttttggaaactatcatcctaagttaaataaatgtaaagtaaagtaacaacataacatgaaatttacaacacttcatataatttttttatccaataaattaaatgtttaactaaacagtctataaaaaaatctaaccaaaaaagtatgagtccagcaaatcaatctaactcaatccaataagttccttaactcattagattgataggttatgtgagttaaattatacacattgaatcattcaacccaacgtattttatgggttatttggattgatctattgagttcatcccactttaacattttcaaacttgagacaatgtagttgcaatctcgattattaaaaaaaatatttgttaaatatttaaaatattgattaatttaatataaatctttaaagaccaaaatggtcatcacctatgaatattatattagatatttcaaaactttaaagtgacagtttttttttataattgtatgaactgtagtaatcaataaatcaatattataaatttaaggattacttcgatagagaaggatttgaactactttattattaatcgaaatgttgtccaatttggcatctaagagtcgtgcatgagattttgggagccagtagtactagtaggtatgtttgtgtttcctttacgacctatactaccactttaatcaaatttgatgctaaaaaagaaaaaggcaaaatatgattaaagagaacgtccctaaaaagctgtgccgtatgattggatcggcttcgtaaattaaacatccttcacttttgtgttaaaaggttaaaagctgaaaataaaaataaaaaatcccccaacacagtatttttcgattttctatcaagtaggatcaaagcatacgcatcggggtcaatgcactccttatttaaaagaagaagaattcttaaaataatattatgattatgaaaaaaataaagtaagagaaagcaaccccacgaacagccaataagatgatgcacgacacgtagcctgtgtttgcttcctgaaaatgcaaatcccctttcttttttatattattatattttctcaaggcaaaacaagaaaacaaaacaacatttttattgtggggtgtacggatggagaaatagggatcggcacacttgataaacccgcttgcattgcagggtcgcacatggcaccatcttctctctctgatattctgtgcttaacttttgtgatcgtgcgtacgagtacgtgttctatttcttcttcaaacccattcattgtacacgtgtacggtgatgaggctggtccaccactctgtccaaacggtcccccatcatgaacacgactgcgtgtagtcatggcaccttatttgacaaatacatttaattaagtactttctgaaaccataggtaccaataatcttttcccattcaaaaccggtggaggctaggagaacgaaagagtaactcttgcgtaagttacgaaatatatccataatcgttagatcaacatcatggaatttattgagtaactggtaatcggacagtgttacattattttacttattaatattttaactttttctaatacgcgtgaaagcgacatttgctgacaaaagtcatatgcaacacaacgtgtcatttatgaatcatataagcgtaaaaatctgagaggacaataaatttattcatagaaataaataataatatactgtaaattaaaataaattaaaagaaaatatgttatgccctagaatataaaactgatttaattacgtgatcgtaacacaccagtccttgtgaataataagtttatattgttattttaatagttattaatttatttctagatgaaaaaacaactttttacaaataaatgtataagaaaattgttcaatggacagcataaatatattatgttatattttttcaacaaccacaaagtaattaggccattttattttcatgttaaacgttaacatatttttataaatttcagtcattttgattagttataatactaatttttatctgaaatttaattatatttaaattttttacactttttcaataacatattatataaaaacacaacacattttggcttacacaatttcaatgtgtgatttcaatttaactacacctattaaatatttatataaatttcagtcattttgattagttataatactaatttttatctgaaatttaattatatttgaatttttttacactttttcaagaatatattatataaaaacacaacacattttggcttacacaaattcaatgtgtggtttcgatttaactacacctattaaataaaggtatttaattatttatagttgagttgattaacttattttttgtcttaggaaatcgaaatattgtattatactagtataatactacttatattaacattacatagtaacatttttgtaaaaaataaaataaaatactcgtacataataacatttcaaaactaaagataaatcgaaactaactttcatttttaatttacaacttgttcaaaagaaggataatatgacccttgcattattaagtttaagccacacactaaactacacaccaagcgtgaaattaaggatgtctgtgggtcggttcggattgattttcgtcaaatttatgattcaattcaataaaatttaaatttggtttggtttgatttttagaaatttttgtaaaaacccaacctaacccaacccattcatgaatagttcggttcaattcaggccaacgggttatccatttaaatttgatattttttgttttagaattactattttatatcatgattcatccaaatatccaatataattaaataagcctaacactggtttgtcgcacttttttcactttcgaggactacaatttgaatttctaacttttgaggacgaatttatcagtgttctacacattcagagatgaaaatgactatttacactaacataatattatcaaatgtctgaaattagtaaatttgattcatttaataccattaacataatattctaaaatagactaaaacaaattaaaacaaatatcttttaatgacattatctataatagtctgaatcaacaactatttcctacaaattaatttcttactataaaacattgatgaaatcagatttgttataaccagatttgctgaaacaaatgaacaaaatatgatccattaatattataaacatttgcagtttcaacacttggagcctaatattaacagtatttaacaaaaccaaacaactctaattttttttatcatttttgatcgatttaatttgatttcgatcagatctataaatctaaacctgtgacccaaactgtacatgaacagttttgatcagttcgattcgattttgatctaaatgcataaatgacccaacgcaaactatccgaatcgatttagaccaatttagatttgcaagtgatctatacatggtaacactcctaggtaaaccacatgcaccattgattcatgatttatcatcatgacagtgccatttctttcgtaatctccttgaggctcactagggaactaccacaacaccccccatactgtgaaatatctgtcgacatagtgaaccaacaaaatattcaattacgatttgattaattaaatcaatttttttaaagattttatgttgacagatagggatggaaataggctaggctttgacaggcttgagcctaacatgcataaaagtctagcctgacctgaaagcctgtatacaaagcttgatgaaataaaaaataattaaaaataaaaaattaatgtaatactgatgctcatcgacaacacctgcctcgaactgaagcccaaaacgtggtcctacaagtttaactactccatggtaaatgtccaaactaatggagctgacttgtggtacacttgatttgatagggatttgagtgttgctggtagagtcattctatgaagtagacataattcttatgtgcataagcttgtcaaaatcaataaacctattttactcattctcacactcgtcattcatcttcactagtatatatatattatatactttatgtcattcatcatacactatatgattgttaataagaaaaaatatttttagaaaaataaatatattgtttttaagttttaatatatatatatatatatatatatatatatatatatattaaataggctagcctgataggtctaataagttttttttttaaacttgagtctgacctttttatttaaataagcttttcaaaaaagccttagtctgtcatttataataaataagtcaggctaaatcagaccttatataggcaaggtcgaaggtcctctaacccatttccacccctattgacatatttagaaaaaaaaaaactaactcctcatgtttgttttaggaaacctcatgttaaattaaataatatatttttatataaaaatataaattcatttttatatgcataattattttataaaaaatactattaattattcctaagagtttaactttagtgaaaagatgtttgctaatattaccgttaataaaacaaattatgtttagttgtgtcttataattcatttttataagttggtaaaaaaagttattttataaaaatactagtatcaattattcctagcaaactttgtgaaaagatgcttgctaatattaacgttataattttttaaatttaattatgtattataattgaaaatattattttagtcattttagtttgatattaaaataaaaaatacgtattaataatatatttttagcataaaccttaacatttcgtgtaaaaagttcttaacacatttttaatataattttttcattaattttaattcataaaagttattattaaaaatcacattatttaataaatgtttcacaaatttatttaacaatagaaacatattaaatatgcatactatgcataattattttggtagacagatgataacatattttctcttaatttattttaatttatagtatattattatttatttctatgaataaatttattgtcttctcagatgtcgctttcatgcgtattagaaaaagttaaaatattaataaataaaacattgtaacatttactgaataaattccacaatgttgatctaacggctatagatgtatttactctttggtatcctagcctccaccaaaaaccaaaccaaaactggaacaaccatcgggaattagatctagtagaaacgtacctcaaacaaaactgtttctaaaaaagaaaacatgtgaaaaataaaaaaatcaaacagtagaaatagcgggtaatgcagtttgttcatttttttttccttagctatataccatcatgtgttaatatataattcccgaggaaaccaataaagagtgatgcggtgatacggggaaacactgttttgttttccttggcctttgagaaattccaaacagcaattcggaaagggtcccagtccaagttggagggatgggacgctatttttttgtctggtgactttaaatttgtagtttatcgtaatgacatagatattatattagtatgtggatgcattcttttttctatcagactgtggaaaacacgagcagattccattggaagccttgctgatccttgatttcccaatacccattggaatggttgtgttataatttctaataattcggagttaggagggataaattgggccagatagagaaaagaaatgcggtacccccgaggaaaacaaagaaaatatttttaaaaaaaaggaaatgagagtggtcccctacatggaagtgggtcccatggcgcccctagctttggttcctgtgttggtagagccatgtgatgtgggtcccactcccgtgctgcatcaaacatgtccatttcaaaggggtcaccgtcacttaaaaattgcaccaaagctggaagctggacgacgagaatgtgtacagtgttccttctttgtacgccacgattgctcacagctcatctacctaataaacttggcatctctaaagactcagatttttgttttctttcatttttcattttttttcaaaagcaaaaaagttgaagtagaaaatatgggattagccaagcactccaaaaacttgattcattttcaataattaaaatatatgtttaaattaatttaatctagttactcatattatctagcaaaactttaagtacaggggagaaactggttttttttacatctccctaatgttcttttacctttgctttacccttcatcttattatttcaaaactaaattagacaattaacatgttattctattcttgtttcaccctcttaatagattctctcaagataagaatatgcaagtgaaaatgtgaaatttggggtaactaaataccttgacacgtgcggttctcaaatttgtaaacatgaaaaactaacatcggtttttctagaccttcaatttgttattccctctaaaaacttttgtggaatgttcgatttagcttctatatattactattctcttcacggttataatctacttccatgccagccatgtttatgcatcaatatttttcatccaaataatataatattttcaatgttctatcttcatcgtaacatacgagaaacatgaaacatgtgatggcatgtgaaatggtaagattgtagtagcaatttgtttcagaatacataacattaatttattaggaatctgacaattacttcaaatcttcaatgtcattccatatttgtttaaccttccaatcctattcctttttactattattattattattattattattattattattattattcaatcctattcccttaaatcttgattggggataatatcttacatttcaactcctttgtgtttcccaatttgatcatatcaaaactagggcaattgtctcgttctattactaaactatcatatgtcccatattttaaattaggtgattacccaatctctcatcccattcttccatttttttttaatcgttgatctatatagggacaatggttattttagtctctataatttgaatacatatcactatgtaaaattggactgatgcgatgaggttatactttatttatcacgtaatcttttaatgaagtttatctaatgatgaggattaaaagaaaaggagtttaataaatatacaccatcagtaaaaaaaacttatattgtcaaacaattaaaaataagctttagtaagatttttaggatgaaaatgacctatttctgtgttttgtttaagttacaagtatcatcaattagaaataattttattcgagtcaaaaaaattattatggttaacaaaactctccctccaaatatatcacacaactatatattcagacttgaatctaagatttctgattaagctcaaacaatctcatgttagttgatttacatttaaataagaaacaaaagaagaagaaaaaattatcctaattataagaaactgatatgtgaccattttaagtgtattaattgttaactttttttttactcttaataattgtgaaatttattaattatagagactcatatcacatgaaactagacacatttattaagttattaacaaaacaagacaaactcattggtgaaaaatttatcttttgaaatataatcatcacttaaactatttaataatatggctagttttgaaaaaattcaaatttttttatattattaattaaaattaaacaatttaaccacttttatttcttatatacaagatcatatatagtattaaacaaacttaccataaataatattttatgataaaatgatagtgtaaaaaaactttacagtattgttattatatatattattttttctaaaaaaaaacaaaatatccaaattataggaaataaaaatgtcttttaagtgtccattaaaagataaaattgattaagtgatagaattgtatttattagtataatttttgtttaataaaaacaaaattattaagatgaactttgaaagtcagtactaacaacatgtattatattaatattctatatcaaaaaaattatttgttagttttttatccgtaaatagaaaattatatttatagtagattcaaggagtgcgaaaaatacatacagaaagagcacattaatacaccatgctataatatattatgctatttataaaaagaaaatataatgtttacattgatactttatctttcattgtaaaaattatgtcaataacattaatttaatactaaattcttaataaatgataattttttacccatataaaacatttctcttgtgtgttcatatactgtggccacacgctcaacggaagcagttggtgatgtattatttaattacttaatgatgtgaagctaactaggaacatagatgtgttgggagttgaacattaacggataagaaaatgactgccaaaaagctctttccgtgggtgcacaattttcatactcacgacctctgcagcttttttatacaagagttgttgctcaatcatgaattagatgatgacaatcagcgaaaaaagaagaacaagaaagaatttcatgcatgatgacaagagtgggaacctctggatgtctgttcgacagagttagagactaggatgaaaaaaaaaaaaacgcatatatctgcaaataaagcaggtgaattttttttaccaaggttataaacgaagcgagcatgagtattaaagtaactatatcagtgacggagttaaattattaatttatcattgtgtattaacatatttcttttaattttatttatttcattcttatttctaataaaaatttgtaggatcgcccagcaaaatccttaattggatgcctatggtcgtttttgttaagaatcaagaacatcaattattttttaatgaatatacatacttacttttattgtagtttccttgaccatcatgaatttcacattggataaggttatagatttataaacatcttcaacgtatgatatcaatattcttattgtatgtgattttctaaattgttcagatgcttataattttgtgtttacaccaatggtcgtaagcactatttattattgatatttttgtgattaaaataattaatgacctatgttataagcacacttactcgtgtgcattatattcaggtcacttgacatttattgatacaatgttatctagtaaccaaagatttaattatttaaaatagctagcattaatgtaatatatctactaattttgtaataattaatatttatttagaatctaattgattaataagaatttttttataactatattttttttaagattcaaactcgaggcaacacttaaaaaattcaagtctaatgttagtcaaactagttatatgttactcggttaataaaagatttaaaattccatgtattattttcatatatatatatatataaatacatatatcctaattttttatttatttcatcctcattccttggtcctcactctcggtaactttgaaattctgattgaaaaataaaaataaaaaatgaaaaaaaattatcaacacattccatcatacttttcaatacaatccaaccatgattactaataaatgtatattcattaatttattaagatctgtatccttaaagcactaattaaaacgtatctcttcttattaatatagtaaattttatgaaaaaaaatgtaaaaaaaattactaatgactgagtcatgtaaaaatttaatataaaaggaatttattctataacgcacattttttgtgtacttagtttgttgaattttttaataataatcaattcgagcttattcacattattctttttacagcagcttattcacattcttaaaattcgacgagtatctattcatacatcttaaataaaacccacccaaaaagaagaaaaaaatgacaaaataaacatagttgaaattgaaacattgtataggaaagacgttcagactgcccaacaaatacaggcaagattaattagaatatcatttgcaacaaggtacggctacgtcttagtttatgattgattttgaaggtaatatgactgtaaaatatatgttatttttacttgaaatttgaaaacttgaaatatgttaagcaccatcaaatcttccatatccttacgtttctgcttacataataaaaataattttattaatcaataacagcattttatactgattttaagtagtttaaattatttttattaaaaatgcttattatataaaaaaatgataataaaattataattttttagctgacataataaaattattttaagtacttaaaattagtccttatagtattatgcggtaatattaatattattaggctttgatgtaagatgatgtgtctagttagaggttggtcatggctattgagtaagactaccgctcagctataatatttctttatctatccttttctttctgggcccagtagtggttgtggatgtacattttaatgtccattatctgtgcaaacttctagatcaaatgctaacacgaactagtcataaaatcggcgcaacggccgaatattatactatgacaaaattaataattcttaactgtaggttaagtttcatctaagaagacagattaatctcgtcaacaaagttattggggatctaacaacaacgatgaaaaataataaaaaataaaaatgagagggaatatgaaacatccagaaaggaactcaagccaagaggtagggagaggatagctttctgtctctttacgcaccatggaaggtttttttagtgtatgttgtagttgttaatacagaaaaaatatttagttaaatggagtaattagctaaaaattgaggactgacaggtatgttaaaaataattatagttaagttcctgtttagattagtttctccacaaccgtttataagagaagaaaattaaaaataaaataaaataaacttctctcataaactaaaaccaacatctaagttaaagtcttgatcctaaaaaaagaagttaaaatcaactttttgaagaagttaaaatcatttattttctctgaaaaaaatattttaatttttcacaagcaaattttaatttataaaaaatacttttattttttattttcttaaaaaaaatgacaaatttccttgatgtggccatttggaatgtaagatgtctcagttattggctcattgcagaaaattaagtagttaaccaagtatattgatggaaacaattgcataagtgactctacattaggaaaaaatatcaaagggaaagatggtagcttttttttataattattattgttaacaattaaggtttatactttggacctaattaaagaatcaactaaatatataagtgaaatctgagcagttagattgtgttattattgcaattttagttagaatttatctagccttatgcttggttggcctgaatgtccctcataacttgagaatcttcttgtatactccatcaaagtttatgtagacgtaaagtatgacataaaacacaatgcattaacaacatatatacattgtaattaaagggtttcatcttagaggcactctcatacatcatcacgcaagaagaaatattaccttgacccataaggagctttgtaagaaagcctaacagacctaaagagcgacacatatttaaattctacacatttgaacagcaaagtccttacaagtattgcaaagtattccaatggagtttggctcgtaaatgacacgaggttcctaaatctacctcgaatatccctcttgttttgtccgctacgaacagatatccaacaataatgttggacaattgatatatgatcaaactttctctttctctgaggacgtcaatggtagtaaaatacctaagggaaaaagattacaatgctcacaagaggaaacaccacaattggacgtgagatgtgtgtactgtgtgtaaggaaaagagagtcagaatgtatgtaccttactccattggaagtgctcatatttataatcattcacgtggaaatcagttagaagagattacccgcaaacagggctggccctggggcaaggcgagcagggcgtccgcccagagcccaaattcttttgtacaggtagtttaagtaaaatttatttttaaaaaaaaataaaataaaaacaaaatctatgttaagaattcattttatgtgttaggggtcaattttttccatctcttagttttaatattatttgtatttcaaaaaatttgtgtattagaggctcattttttccatcccttagttttattattatttgtatttcaaaaaatttatgtgtcaggtgtaacatcccgggcgctgacgagggcggggagtgatcgccggtgcagtgaggcacggacaaggagcggctcctggcaggctttcagcgggaggggtacatgaatgaatcaaatacacacccgaacgagagggatccagaggctgtgcaggtatgggactgtacagttgaggataacttaaaggatttaataggtactacctataccaacaaggtgcatctacttttcggtaacccataacataagaactccacagttaagcgtgcttgacttggagcaatcttgggatgggtgacctcctgggaagtttctcaggaagtgtgtgagtgaggacaaagcataccgagaatcccaaaaagttggtgatcatggctttggactattattgccacattctcattactagaactatttgagagaatagtctaagtcttgttgaatctcttatgacttggcccattccaaacatccgtaacacctctccttcaattgataagaattgtttttcttttaatctaaatttgtagtatttcaatcaaaatttaaaaatttaaaggtataatggaaaattagttttaattttaaaattaatatcaaattttaacaaaaggtccaaaagtcattctcgattccttctcactcttgaaacaaatttgaaatttctgtatttcaagtagttaacaataatagcaacagttgcattaaccatcgatgatgaaggtgttaacaatctcactcaatagtaaacaaaggtaatacttcttcaatttcattataattatcgttttagattgtgttatatatactaaaaaaattaataaatgaataaaatagaataataattttacaaaattaacgttattattatgtcgttagcaaaaggtctttaatctcttctatgtttggtaaccaaaatagccactgcaatcataatcgtaattcagtccctgagttggaaaaattaaaattatttacacattaataattatttgagaaactatttttatagttactactttataattgaattaaatataaaccaaaaaataaagtaatcaaattttgagaaactatttttataattaccactttatctatttttctttgacattatgcaaaagaaagacaataatatattttgcattttattattttttattttctcaaatactatttacttaattcaattcatcccatgaaactaatctaacaattaaaacttagcccaaaatgacttataaattttggcaaaacatacccatatccatgagcaaaagctacgcaattcattgtttcatcttgataaactatcatgaatactttcatatggttaaaagaaatctacaaaagcacctctttttgttagaataggtgtttaagtaaatcaagaatatcaatgtcaatctaaacgctatagttgttcataatttcaggttctctaaaacctgcaaaagaataagaactataaaaatatcacgtagtaattatttcagaacatatcaaattacctcaaatcaaatcaaaatataaaaataaacacaattttaatccaagttaattgaaattggtgatagatgaacctaatgataaatacgaagaggttaaaaaagaaaaatggaaactaagataaaagaaaagaaaagaagataaaagcaaatgagggggaaaaaagagggggagatgaagaagaaaacaactaaaaagggatcatatgcaacatcaagataacaacgggtctaacccttattcaaatttatagtttttcttcatttcgtcctaagacacactgtccgccaatctacatcccactatatggatcgtctcattacgtgtctaaaccaccttaatctatgttccctcatcttttcactcatcggtactattgttacaattcatcaaatatctttatttcctatcttatccatcttcgtatgattacacatccaccttaatatcttaatttctgctacccctattttatgatcatattgcttatgttttcgtcaacattcagcttcatataacattgtacagttgttctatagaactttctttttagcttaagagaaattttgaagtcacacaataacctagatgcattccgtcattttatctaccatactctgattctatgatttacatcttactcaatctcttcacttttttgcaaaattgatctcagatgtcttaaaacatcttttttgggtaccccttgaccaattagatgtacgatatattgattacatctgttacgtgaaaattcaaacttcatatactcggtctttctttcgcttcaaagtgttttttcataattctagtttcctattaacacaatctttgatctcgttagtgagcacaatatcatctgtaaaaaatatataccacgacacttcttcttaaatatcttttgttagttcatctatcactaaggcaaaaagatacaaactaagagtcaaaccttgatttacacctattgtgataaaaaataacttattttccatcctctttatttgttatttttaaatcaaaatatagaaaatggaaacaaagttaaaatcacccaaaaaaaataaaattaacacataattattactgatgagagtcagattttcccataactagttgcgagactcgtttacatagttgaaaaatattgatagaaaagagaaaagggaacctgttagtcaatctacagagttcacaaaaattgagaaaaaaaataaaataaaataaattgaacttttatcatacactaatatcaatttatcatttcaagtttttaagaggttagtgagagtttctataaaacttaaagtacttaaattaattttaatttatgtgagaaactcaatttatttgtttaagtaaacttggatagcttcacttgatctataatttgaggtgagttaacttggatgagttaagtcaacctgtgttaatatttaaaaaaaaaaaaatatatttcccttttttttgttattttattgttctggttggtaacaatggtttttaattaagttcatcgttagtaaattagtatgttgttggcttgttgtatttatgatatatatatatatatatattgtattttcattttttaaaattgggtaaatattttaaatttataacatgattaaaaaaatataaaaatacagcaaataataagaagaaataaaaatgaccatattaatgatacgttacgaatttactcaataattacatacaaaaaatattgcagatgtataagacatagtatataacaattatatattatgtatgtatattaaaaaatgttatatatatatatattaaaaatataattttttttaatatgcataatatgtaacaaatattatttaaattttagttgcttgcattttaacagaaagtgtaagggaaaagaaagaaaatactgggcttttatatattttctctatttaattacacttgtgttaaggatctcaaattcgaatacactacatgatatttaagtctttggactcttctacttaatggattaatattttgaattagactctccttttatgtttaaattctaaaaattgattttttcattatgagttggatcatgtaaaagattgcttatagactaaattaaggtacaaattgaatactaatagatgagtaaagtcgtcaaaaccaaataactaccaccatattaatattaatgtcgataaaataaaagtcaccataaacatcatctcttaaaggaatgataatgttaaaagtctcatgttaaaacaataaatataaaatatattacttaatatgatacttaagatttgagattttcttacctaataaactatttttttggttggattctccttttatgattaagtcctgacaacttgtaatttgaacttcaggcaatccaagtatttttctacacaactcatgcatgaaaaagacttcccatttttcttttgtttctttcggcagatttttaattaccagggtaatactttttttttatgttatagcgaccccatttccaacttttttaaaattttggagtttggtacgtgtcttatatcggggtggggacatggcgttgaaaagcaatgcaaatgcaagaatatacttatttatataagagagagaaggcactaatgaagctatattggaaaataataatttcgttatcaccattaaatttcacttacgtccctatctgcccatctttttattattggcgctgctgctaaatagcatccgagccaagtatgcttcgtctggcttggctaataatctggctttgaattagtgggctatatgttaatcatgagtactgactaagagaagtgatttatttaatgcatgaacgtttgcacgataaaatgttgggggtaggggaggtaacaatatcttaaatatacagcgttatttaattttatttcaaaaattatgtgtatcaaaaatcattaattaaaagaatactagctttgatacataataatattccaaaataatcattagagacattagtcaccagtctcttcttaaactgaaaggatactttgtaaaaaaaactttcattatttatataaaaaaaatctgtatttaaaagctatatactgaaataattaaaaatgtgttcccgtgtacccttatcaagaaattatagtaatatattttttgacatgttttctaaagttttttcttattatttaacgaaattaatatatatcttatcagataatatgcatattaactaattttcatacaataataaagaatatattataaataacatgttagaagattaacatttccctatttttcttacaaacacaagttttttctgaggtaattaccaaattaatttcttactattgttctagccaaacctttttaaaaataacttatagacgactattcacaacaacaacgtaaaaaaaatcttggcaagtgaaactagactaaaaatttcttgtgagtttaagtcttataaatataaaaatatactttaaaaaaatattttacatcaattaagttaattaagttttgtagataaatattgataaatttttatctatagacttttcattttgcatttataacatgataacaagaaactataatgaatcaatagtatcacatgtttttatttatttattgagtatcacatggtaatagtaacactttacacattccaaaaaaatagtttgttaattactgttattattttcatttaaaaaaaaaaactcttttaatgtttattcctttcattcacttaacacaaattgaatactttatttgagaaaaaaaataattacctgatcactttgatcaacaattagctgtgtcatcttagttgcgtgtttaaatttctgctaaataaataaataaaaactataaatcacatgaaaaatattcaaatgtttcctagagtatgaacttcgtatttggcagcgatgtaatatatgtctggaaaaaaaatagttaagaaacataagagtacaattttaagtgctgaaaatatttttcatattggaataagaattaaatactagattttgtgctttctcaacagatatcgtcccatactttactggattgataattcatacccagtagttgtcatcatctaggctggaataaaaaaattaaaacaaggagtttgaacaaattctaaagtgatcatagagaacaacagattgtagtcatcaaacctgccgacacatagcaatagtgtgcacatgtttggtttggaggaagaatacagaagtgaacataaacaaacttggcaacccaaaaattaaaataatgaaaagcaagccgatacatgaaagacgcacttcctcgatttgtgcaatgtctgcactttgtggttaaacctaaaacgacatttttcgcgcaaaatataatgcatgcaacaaacagctatgtgtgccaagtgtgtcaaaaacaaaagctatctggtcagtaccttccgcgtcaattgttctctttttgttcttgtatatatttttcttgatcttcttttgtttgataagaatgctaaattcaacaagaagacgataaaatgaactgtttgtgagcttgcagtgtggcgcacaagtttttacattattttgagtcccctaaaggaagatcatataacaatattttttatatctagaagagggattggtataacaaaacgcttaagagagacctggtgggacgaaatctcaaaattaagaggttaatttactataggattaaaaaacggtgggatatcaatcgagtgtattgaagataaagttcaggaggatccgtgtaatttatttatgttttaaatttcaacattgctatatgttacaatagtttttggaatcacgtgtttataggttatatataaaaaaaatgtacaaatattatttctcattcattttgtggtccggaataaatagaactatatagtccatgaaaagattttttattattataaccagagatgagcctggcaacattttgtcatggcaagacagcaacgtctcaaaaatttgaacagtttactcgtagtttagtgaaatatagtttggttaaagtttttacatattcctctcgtgattctatttatagttcagcgtctaaaatcaagagctgaggctctgagccaacactgctaactagaccttatttaaagttttaaattattattaaacatctcaaatttagcataaaacttaagcttcttgtgtgaagccatagccaatatagttctaaacagtattggcacaatggcactgatcagtgcgtgatgacgtcttaggtaaaaacagaccgaaggattatgagaaagggccatgccttggcccatccatcgagatattttctttaattatttatttgtgactatgtttataaaatcttttatttattcaccaaaaaaaaatatttataaaatcttcacgttttagtttctgcgtctagaaactgttcgttttaattcttacacatatatttggtaattcgttttagtctctataattttagataaccaacaaaaacaaattttaaaatgtgtgtatgaattaagatgagtaatttttaagtataaggattaaaatataaaaattatataagtataagaattaaatgactaattaaaccaagaattttcacatacaccttgaataatatacttaaaatactataaacaccctttcttgaaaattttgatttaaaacacaaattaaagaaaaatactataatttttaaaacattataactgtaagtttcatgaaactaaagttataatattttttccttaacccttcattagttcatgaggagaaataaaattttgactaatctagaattcaattaggaaataagtaaaatttgattaataattatttttgataagaattaaatttgactactacataagtgattcaatcttaattttaacatattaattacttctacacaattacttggtttaaagttataatatttagtaatacaatttaaatcaaaatttaattgtgagtgtagtactctgatttatttgagattttttcatctggaaggtcataaaggttgctcttttaggtaaggcccataaagaaagtagctctcagctgggtggtagggacaagtgggcccaacatataataacggggcaaaatagggccccattgataggcactaagatctataatgtgatagcttgatagcaagatactttgtcttaattggagactggagtattgcattagaattcatgataaattaaattttaataatgttcattacttatgataacttagattttttgaagtaaaaaaaaaaaagatagtgtagattataaatattttaccgcatacaaatatcataatgaactggagtatacgtaacatttctttggataatgtcatgaatgaactatgaacaaattatataaataaatttcatatatctatttcaaaatgttatatattaatgctttgtttgatttaagaaacaaagaaaaagagtaaaataaaatagtttttagattgtttggtaagagagaaaaaaaaagaaaaaaaaagggatactttttcttatgttattgtgaataaaataaaaagaaaaaacatgtataataaaaaagggatacttttacatttttatttcagaaaagctaccttctccaacttttcttttccaaaatggatggattataaaatagttagacccacttacttttttgggtttctttccttccttgacaaaacgtcatagtggaaagattcattttttttcccggtccctttccgtttttcttccagattaacattaaacagccgtttggtagttaatatattataagataaaataggatatattttatcttatcatgttttgataagttttttattgtatcaataggatataataattttatcttattttctatcttaccttgtaagtctaataatattttttttatttgagatacggaacctgacatgcgttaaaaagttaaaggatatgataaaacttgtcacaatataatatatacaataatatatagtatataatatacatattaatatatatatatatattataaaattatattgcatatttataataattttaatatattttttgatcggtaaatgttagcattagaaaatttattatgtaagtagaaaaatttgaattcataaccttcttacaactccaatttttatttccctcccccaaccatcaaagaaacttacgtacttacataataatttcaacatgtaaatttaaagtatatttttaattaagattaaaaagttaaataattttattcaaatatttgaataataattgaaatcttaaaaatgtgattcaaatatttttttaatcttaagaaaataactacataataaaaaatattttttaaattgaaattttttaaaaattaaaataaattgagagttactttttaaaaagttatattctaatgaaataataattttatcatttgaacataatttatacttcatcatattatctagtctgtattaaataggcaagataattcaataaagttatcttatttattaattgctatgtactattagatataattaaagtttatcttatcttaatcttaatgtatgatgttcttgtgctttcatatcttaatctattttattatatttttacctccaaatgaatcttgtataggtcgttttcacttatatattattaagcttattcatatttttctaatgctataatattctacctatacttatcattctaacactatacacaaccatgttttctgatcatactttgttttgttttcttttttctcaaaaaaaaaaaaagttatatgtgtttttaaagaaggggtcatgtatactccttttggtattagctgttagatatgttggaaaagaaatgaataatattgattgatcatatttaacctggttttccctaaatactaatagatctcaaactaaaccaaatttgccacttaggtcaagaaacctttcgagcacacatcaaaatggacatgtggcagtgttattaaactggcaatttagttgtggttaccgtcatccgatgcaaacataaattattatgataggcattgattattgacatgatataattaaagatgtccttcctttctacatgtgatcagtaatctaattattaatatccattaactcagtagtttttactaataatggaagtgattccacttacatggatgggtcaatatttggttgcgattaattttgaaaaactaatcataattttcaacaaattgacaaatatataaacaattatttttctaaaacaaggataaaaaaattgtttttctaagacaagttgactaactgcagctgaaactaggaagcagtttatttaaaagcacgtgaattaactaacataagattattttaattaaatcagaagtttggaatcgaatcttaactatataattatattaaatattttaaaaaaaattatcacttataattaataactatatttgcctatatgtaggattcagtttctgcagccagaaatttgctggatgcgtgattgggcttaagaatcccatagccaaacttccacacccaaggtgcaccagcccctaggtcgtttttagccgttatgggttaagcaaggacaattaaacgcattcctaaaaatatttctgcatgtttatattttaaacaaaatttaaaaaatatctgataaataacattagtttaatatgtttaattaaatactcctgcatgttattattataacgtgtaatttaactaaactcattatcgttaaaaaagttatttaatttagttgaaaacattaaatttatcttaagttaatattttttcaaaattattcctgtgaacataacaaattaatgagttatgcttttttattatcacactattttaggattgaatttaatgatattttttggaaaaaaataaacaatgcaaaaaaaatatattttagattagaccttatgaaaaagattaaatcgcacttttaacttcaaccttataatattaatagtaactggagtgagtattttttttattctgaaaaataaaatttctcatatgatgatgcctttttttcccctttccataaagaaggtttgacatctatttgcccttttattctctccattaattgaaaactaaaattagttatcagaagtatttaattttaataaattttctttattaattttaaaagatttatattttagaactcgttttatacttagacagacgttagaatggcaattgattaaaaatattacataaattatttagaaatataattttatacttttccttttaaaaaatacactgccgaagtaacatctataagtcccactttacaagttcatcaatcactaacaagtaacaacattctttttttaaaaaaaagtaacaacataccctccatcaacaatcgtaatgggaagatgatgaattgggtcgaaatttatgggattttaaggttattgtgtgacttttgttttatcattttatgtttgggttttatcctatgtggggtttgtatgttcgtcggtgactacaaaatttccataagcggcggcgctgaggaggttgaagttgaactatggcccaggaagatagctactcccatctgtttcttgcaagacatgaatgacaagttgaaaaatagacccaaggataaaactaccaaataataatattagatgtatggctaaaacataattaagcatataaaatattaagacttgttgttatgtaaggtgacgtccattaaagatgcatggatgcttatcttggacaggacttcgaaggtgcatgttaattaaaaagagtctaggtgcaaggaggctgagtctcactgtccagatgaacatggttggtgggaagtatcaagtagaccccagaactatatagagagcgtcttattaagtcacatctaaacgttacatgagagaggtcatgaaagtgaaatgcgaaaaaataaaaaaagcaagaatgacttttcaatccacccaatactttctacatccaatagggattagaaaattggttatttttctttatgttccaagtatttggatacagcatgctattggtagttattgatctctatcacactttacgtcaaaaaattttatagatatttttttttagaccttgacaatttattctaattgcttctaaaatcaatgaacattgaaataaatatgaaactttttaatgtgttttgttctcatttgcacacttcttaagaaactttttagaaaattatttatctcataattactttaacctaaacacgcttatttatgaaatttttaagtaataaattatcgaaaaatagatacatcttatggatataagtatgtattaccgattaatttgttaagtcataatcaattgtacagtttcatacctatgtacacagtctttgaatctttatcaatatgatgtaattcgtccaacatattacacaaatcataatttagtagagaattaaacattaaattctatttttcatatctaattcttaaataagcattatgtcatgaggtcagagcaataatcgtaagtttctaataaaagacatttgtctcttatatgacaaattaaaatttgaatttctagaaatcaaaaactctatacacgtttaatgtcatacaatatctcaagtaaaaatatcttcaaactaaaatatgtgatatattagcttcctcttgtgtaataagaatgtatttaggttttttttcatcatgtcaatttaattttaaaataaataaagtaattagacaaaaatgattaatgtgttaaaattaaaattgaattgtttgtatattatatgaatttgattcttagtaaaaataatttttttgtcaaattttacttattttttgatcgaatttcagattaatgaagatttattttcgtcataaataagagagctaaagactgaaaatttaatttaaaataaaataatatttttaattataatttcaaatcacagctaaaagatctaagcatcgaatcagcggtgagaacatcttttgatttatatactgacatggtgatgatattctcgtcatgcggtagttttggttattcaggttccttgtgaaatttggctctaacttatcggccacgcacggtgactgaaaagattctaatgtcagcagagcacgtcgttttcttatgttggcccacctcttttcttttgatctgtgtctgttcactgtccactgtccacacactcaaaccctacgcccctggatttctctgtattattttttactttcaggtcaggtcaacattgagaaggctggagtagtattggcccattggattggatcccaccaacttaacggacttttcagccaagctcaaacgctagatagacccaacccaacatttctaattgcctattacttggactcaaaaacatgcatgcattttccttatatttgtccctatttcattttcctcgttattatattactgtatttttaagaaataaatgttacttttacaccattcttttcacaactcttatactttaggagagaaaaaaaatctaacaatttaagagaaaaataagaaagaaatgtatgataagaagaatagtgtgataaacaataaaaagaaaaaagaattgtagatttttttaatttaatttgttttaagtaaacattgttctatttttaatgacatttgattttgacagttactgtgaatgaaatgttaatttctaatttttattagagtgaggtgcactttttaaaaaaagtgtaataatttttgttaattgtaaaataagttattaagattataataaattatatgcagtgttagaaattaatttgcatctttaggtaattgcagttcaaattctatactttaattttttagctggtggtatcatgttatgcgcaaactgttaaacaattaatttcgatattataaatatggcatacccaaaaagttaggaccattctccctttagttaatacaacaagatcaagatagtgtagttgggttattaattagtaagcatttactcaaaactaaggcaaccagacagatttttgaccattgaccaaggatctgttatgaattgctatctatcacgtaagccactcttgaacaaattaataatttgtgtcgttctcttggaacatatcctgtgaagataatccattcccgtgaggctttcaagatgaggacactgaaatgtactttacattagcaaaagtatagtttggaagcttcgtattagtttgaaaggcaacattcaagggaaaatgtggtgtagccagctttaaaaagttcagtgattaagctgatatgacaactgaataaccttgtatcattttaaatagactttattcaaagtactctgatggaggaaaaattattaattggtcctggattataatgatttttattaatttttgcatagcatgtaatcaaatgttattattattttataaattaaaaaacttacatatatactatttaagtagaaattaattgagatcaaaggcaagtggtgatctgaactatctaataactaggaaggagctgcatgttcaatatccgccataggattatcatatcataaaggtttaatataagaaaggtcgtttctataaaggttttgccttttctccctgaaataaaaaaggttttgctttaggttcctagagttcttagaggaggcccgcattatgacattcgaagagcccatcaggcccaccctctttatgggtcctcaaaagcatatctttgaacctctaacaaccaaaaatatatacataacggccccattattttgtcatttgttgcaaatatttaaacactgagccatagctgaaatttaaaaaaacatcgaatggtttatttttctcaaagacacaattagctactcataggaaactgtttttttttccaatatggaataccaaatttatataataaaccatttcttgtatttcttatatctattttttattaaaatttattcttcaatatgaaatacaaaatttatatagtaaaaaatattaggtaaaaaaattaaaccgattcttcataattaatagacttacacaaaatataataataataataataatagtaataagacccaatttagatagtgaaaccataaaaaaacagcgtagtcatatcataaatatttacttatacaagttatatatttattttataaacaaaatcttgtgtacttataagttccacttgaagtagattgaattaactttcaaattttaatatgaaatttaatttagtcctctttttaaaaataataattcaatctttattttctatgaatttaataattttattatttacattgaattgaataaatttacggaaacctagtattttcaacatccctattctatacattgacagttttctcttttcttttcttttttatattttgcggtaagcagtgtttcgaatttcgatcgccaaaatgggcttttacgtcaatatgtctccttccttgaccatttcaataaacgagaatatcctgatgtgcaggttcattgcttagcaatctaatctatcatcgtaatgtaattttaaaaaattatataagacactttttcttatcttatttataagacaaagaaacacgcttattaaaaaaatagttaagttaattaaattatgtgaattttaattaaaaaataaactcttttttctaaatcattctttgattgaaatttaatatcaaacataaataagacaaaaataattaaaatatacttatatttaggattaaaatacactgtttttttaaaataaatgagatcggatggagtaaacttcaaaaataatattaaccagtatatttaaaatatgaattaatagttaaaaaatattgtattatattatattatattaaaacacaaaaaatattagtatttatattttagataattaaatgtttttaattaatattattcagataccaattaataagaataaattgatagtaaaatacggataaagaatatttgaaattcttgaaaaaataaaaaactatcgtattaatattctttgtaataataatacatatttttattattgatttcaagccattagagaatttctaatgtgattaagagagttaggtattttcttcctatttttctaaatacactcaaaagatatcccaatctaatgtttttacattttcctcttaatctcataaaaaagtgtaagaaaatcgtctaaaaagtaacaataattataatttttgaaggtttttaatagtccaattgtttaatccaaattgaaagtttttagttggtacaaattatttaattcatttataattaaattagacgtgtaattttactaattatggcaaattaccatctaatagaattatcattcaatactaataaaaaaatattttatttttacacaaattaaattaatataattttttttatgaatactttctaaattttacaataaagtcaaacatattttacccatacataaattaaagtgtgtctatttcatataatactttaaaattaaattaaaaatagacatacaattagcagagttgttttttagacaaaccttgattttttgcgtgggtggtcttttcttttctgttaatcatctcacgtgcgctaccttgacttgctacatattcttcttcatagtcaaaggacaaacgttgatttagctgcctttgtcttcgtgagtttctttgaagaaacattcttcacgtaatactgtccacacacagtatttggtttgtctatgactgaaatgcgtcatttaattctaatgcattatattttttgttacattctaattattatttttaagttataaggttacattcaaatgcattaacttggaacttggaagttaatggtcaattaggaagcatatatctatatctatatctatctatctatctatatatatatatattaaaggaaaccccttaagtaagaaaagttgttaaaacaaaaaaataatgcatctataaaatataaagggaaatcaactataattatataataattatttatgaatgtcttccggttgatttagttttttttttttttttcaatggtgacactgaagttaaaacgtatttatccaaacctttcacgccgattttagtagatttatttagtttattttaatgaaagaaataattcgaatcaattaaaataaattagtttaattttataaattttctgtcaaacgcatattgtattaatccaattaatacaagttttgttgcatcgtttcaacaagtttgatttatattttgaattaaaaaaacagagataaaattcaagttaattggttcaagcaaccactttttaataagtttgttagataaataaaaaattccattaaaaaatatgttttatttttttccttttaataaaaagatgccatacgtacgttataagcaaaaatgaaatcaaatctaagtagatatttaaactgattgattcaataatcatttttttagtcaaaagtcttgttatacagatagagagatagacagatttacaacatatttgtttcttaatttatagcagatttaacgatttatttctgaataatacacaagctatcataaatatatgttacaatcacatcttaatttatagcaaatttgtttcctaatttaataatacaaaaaaatcagaaatgtacatatacataatcatattcctaattcacagcagatttccagtaaaaaaaaaatcacagctgatttattttctggtttaaccaaccacaatgaattattcaagtaacccgtcatcaaaatttaaatcacaaaatcaatatctgagtcaaagatgattaaattttattaatttaatttaattcaatttgaaccaaacatacaaaactaaattaatattttaaaaattaatttacacaaaattaatatgttcaaaattgattttttggaaatttgtagatacccaaaatgaaaattctatttagtctattaattcaatttgaactaaaacctacaaactgtcaaactaaattaatatgttcaaaatcaattaacccaaaattaatatgttcaaaattgttttcttttggaaattagttaaaatcagcagatacccaatatgaaaattctatttagtctatttaacttctcgttatagcctagcctccgttttcaaaacgtgagattttttccttttgcaaaaaccacgttatagaagtcttgacgttggtgaaatggaagttttgtttgtaaaggaattctccctagatacacaatacacatggcattctattttttttttttttcaaaatggaatcaattttataagtttaatgaagaaatgattttgactagtattattcataataatcctatgatgaccacggatgcaatttccttaaattggtttacatcaattttttaatgttaagattgcataaaaaaatcatttaagggaaaaaattaacatccagaaatacgattagattggacgcagtcatagaagttgattcgctgccatcattccttgtattaccaagaaacttcgaggaagtcgtatactcgtgcatttcctatgcattgcaactacaactaatgaatctataaattcattgagacaaggcacaaaaatgaacaaaacaagtaccattagaatatgaagttagaagcagtaggaggagggtgtaagtaccacccaaataacaagcaactaccgggtgtttgtccctcttgcttaagagacaaactattgaagctctatgacaacagcaatccaacttattctctccctcctcctcctcaaccttatgtgtctcgtggccaccgccgccatagctctctcgtaatggattctgcttcttccatggttagcttcaattatgggttggagaagagcaactcaattgcctttgcttcaagaagccaagccatagatagggaagtcaatgggagcaacaggggaagtaagaaaaggggtatttggtccaagctgctcaaattgaccaaaaagaacacccaagagaccttcatgcattccaggaccgtgagggagggaaagaattggcatttttaattagttaatttatatccagtttttcaattgatgtaactatacatgattgtgaatcaaaattgaactcacctctgaattagaggatgggtgatgggatgagcacgatcttctattgttaagatgattattggcttgttccgggaattttaatggttttctttacatttcgatgttcacaaatatttcattcttttctgcagctgtgcaatttaacaattaccatgtgatggcaacccttattcccattgctccacaagttttaaactagtcatttttaatatctactgtgatcagggtgtacatacacgagcaaaacatgagatctgtaaataatgtacaatggagaggtatgctaattgctaagcgggtagtgaaataagattatgaatcaaaacagaacaaatatctgaatgctgtataatggtgcaaatttaagtattctttctatggataatctacatttaatgtgagattgattttgtaacgagtatgagttcctgtatcaaagactatctttctatctatctttaaaatgcatttgaggtataaactaccaaaggaaacaagaaactgtacatgataatatgtttttgcatatgattaattatagaacacttgcaacttctcgcccaaattctggatatcatctagaaggaccagaaatattgccccccctaaaataatccttgtcattgtgaatattttggtccaatgcaggccgtttcagtctttgaaatatatcatcaagggactcagatgaggacacacgagacatcttagcttcctgtgtttgccgtatgggtaaaaatcctttgccccctaagttagccccgaaactccgaaaacctgttttcattgtttgccatgttgaagccaagcctgaagttccagcagcattactagaatgagtattgccgtgatcaagcaaggaaaccctagcagatgctaagtttttctcttctgccttcaatttagatgttaatccactctgctgctgatggcttccctgctcgagcaatatctccttgtctcttcaaatttttaggcagatttccatctatttctttattaactaaagaagaatttcccttcatttcaacaccattcttcacctgaaccatatcagctataaagtgagtgaactgtttgaactttgaccacaacaagaagacttacaaatgtcatatcttgcagccatcaaagtcctgataatgttgcatgaaagatgaaaatagagaaagaagattgcttctattttcttttcagtggggtgttgacataccataatattctcgccagattcaacatcaattcaattaaaattcctcactagtggaacaacttgctcgcttacattgcatccttgctcaagccaatatctttctacaaatttatatgaattgataatcagcataagtaattaacaaatcccacatttgaacaaagttcactaatttagacatcatttgtcatttaatattttgaactaaagttttgacaataacagaattcttagcttgcatacctttcggcaagataattaatcctgatggatcaaacccatccatatcttcagcttcagtttcgaaaacatataacttccagctcccaagagaatcaaataccctatcaaagaaattgcttgcaaccaaaagggagtatataaccataataagtggatagcttctgttaaacttaactccaaagaaagggacagcattatcaatgttccccattcgctgcaatcagtcatgtaaggcaccaaatcagaaaaaagaactaacagggaggaatgaaagcaaaaaatgttgattgacagctgtcaatgattcattagtttggcttatgggaaaaaagtgaacatttatgtataggtatgaaaaaacatgaaaaacatcaggcacttgaaaaataagtacatatatctggtacaataaaaaaaagaagagagcaatacattaaaacatgagaagacaagtagaaaaagaagagagcaataacataacaataacataaataaatgagcaaattttcctttcagttttgtaagttcctttcaaatatttccttgcaatgcttagtatgtaggcaagcatatgagaagacaagcatcaataaaccaattagcataatagcaaaatagcataatagcataatggtgtgtatagtaccatacccactgaggggcaaagagattaggtaaaacaccaagatctctctctccgatggaatcgcagtggcgaatggtgatgactcacttttctggtaaaatgtcgtaaacaatacgaaccgcatcattccctctgagcttcgcgccttatttttgtttgcggactagatatctatctgggcttccagggcccgcatcattcccttcctgtttgcagtaacttacatgtattttgttcttcttttaataatatttaactccaatttatcactttttctttacattattgtttttcttatttaagtaattaaaattttatgatagatttgaaatgaaaaatgatataaaagtatgcatggtaacatgatagatcgaggtcggatttgacaatccgatctcctcatcctatctccgtcaaaagtgaaaatattatagcttaaggtttataaaatagtttagttaaatgtaatttcattttcttgggttttgtaaggttatggaaaattctccaaaaactcgtttcattttttaatatttaatttacttatatatttttaaataaagacttgaatatgttttttattcctataaattctcaattttttttattttggtcctatacgttttttatttatttttaattcctatagattcatgtttttcaattttggtttttataaaaaaaaattgttcatttttaatcttgtaattttgtattgtcaattatagtccttttattttttttcatttttagtcttactgagcttccacttacaaggataactattaatgctgttcaaataaataaaaaaatctttttttttctttcttttgtacagtaccttttttttttctagaattttcaatttatcataatgtattatggagattaaatctgctctataaaataacggttatttaaccacccactccctgggacagtcatatatcattcttaacaatacgcaagacaaattggtacatctcaaaaaaatagttcttttataaaggacaaattaatcaattttagagctatcgttaaacttataagttgtcactcttagaatagatgtctttagtattcatacatttcatactcctaatcaatccttaaacctaagttctagaatgcaacagatagttcaagatgtcagatttcatcattcactttaatggagaaagcaattaatcgagagtgcaaatttattttaaatttcaataaccttcttatcatagttttatagagatagttgtgaaactttactatttatgagacgcacttacgttaaatctaattaataataaaaagatttcattacggtaaaataagtgtattgtaaagcttaactaacaactatttttttgagtttgatataccaataaacaactcaaatcactcatgatttttaaggacgtctcgattatatgttagtttacattttttttctgtcatttctgattgtatcagttctttgattattaattatcctttaaaataatttaaagttcatgctaaaaatattatattactcttttatttttatgaaactcatgaaaatatttatgatcaatcaaatcaatttaatcattttatgaaatatgattttcaaaatatatgattccaataaacaatgatactcgagcatggaaattttctccttgcaccaaacgatccctaaaggtaaactcaaaagtcactctcatttaatagctcaagtttgggcacttaacaaatgtgctattgttccattttgggcactaactatcactaataaatactttgcactacaaaggcaaacaagccatggacaattaatgttagagaggacagcagtaacacaaactgccgaattttgaagcttcccttcactctcataatcattcattaggtatgcttttgtaggcctaccttccccctcttttgattcctcaagtgaacactaagaagattctttgaaccacaatgagcatgtagaaaagttatccccacttcctttaactgccattggattctactttgtgtgcctttttctttgtgtgtgtgtgacatgacaacattgccaaagcgagcttgcggtctatttctccaaccctccaacctatgctccaattctgttttctcttttgtggatgccgtgtcactcgcgaaatttcactaacgcacttgagatttgggaacagattaactaggaacgtaagtttaaatagtgataagggataagttctgaaagaaatgtcaactttctaaattctgctttaaatcagtcatcgtaatcaattagaaagcgcaaatcatgctaagtttagagaagttgcacataaaagtgtaactcttaattaatccacttttactttttgtatagtctatagggttatctagtaaattaccaataaaaaaaactattataccagtaagcaagtaatgaataacgtgactttactattttagtatagcaagttaaaattacgcttgaagtacatataaatgataatattttcctattccaaaatatattttttttatataaatgagacttgattaactttttttatatataaatgagacttaataatcacattcagtgaagtttgaactcaaaatcttatttaaaaaaatcaagtttaattttactttgactaataatacataggtaaatttgattatctatgatacaaatttatagaatttgctagttgactttattgttgtgacatttcctaccaaatataaaacatgagttgatttattaaaacaacatttgtattagaatcattaactgaaggagtttattttagataaaagaaaatattttttttgtggtacacgttaattaaatgtaaaattttattacggtatacacacattatgataatacatactttgtttataaattgtgcatatgtcatcatcaaatgttgtaattgtatcacaaaataagtggattcagttatcttatttttttccttattaaagaataaattcatgttattcttctattgtaatacgctaaaaaaagtacctgattagctattgcaaaaaaaaataattgaaacgaggtctctttctaacaatataaagatgtcaatatttttttttatttatacacaaaagttcacattctagtcattgctaagataaacaattttaccatacataatcctttataattagttaatagtgaattttacattgttaatatattctaattaaattctttcctaaatactatttctcagtaagatgttgattatatttttttaataaaaaataagtttgttgagaagcattcatcaacactaaaaaaaagtatgtgtagaaaaatcatttgatgtatgaacagctttagacaattaagagtgatcagtcacacgatttctacaatgtagttctcctgcacatatgtccaacttcatgcgttcatgttttccttgtgctattgatctttagcaaggttgcatatctgcgaagtgccgaagactctaatgctgaagtttgagtatgacaaagtaactaacacttgtagttagattgcatttctggtttaactaaaaatcaaaaatatatttatgtcttaaaaaaataaatatataaatatatcttttgatttgttttatatttaggtttaattttatttttcgttttaaagttttccaatgtttccaataaggacattttttttatttatttaccaaatgggagcagggtagtcaataaaaaaattaccacgtggcgcgaatcttttttttttaaaaaaaaacattggtcaataaaatttaatcgatactttcggtctctattttagtcgctaatactgtttgcgacagaagttgtgatcgcaaaaggtgatagcgacggaatcagtcacgttcaggggaggcgcgactcgttgctataaatgcgtaaatatttttaaaattataataaattcgtaatttaaaaaaaaaacaattttttaatttttttccccaaaatattcatatgcttctcaactggggtttgaatgaatgaaaagtggatatatttttgaacgctggtttcggcttgtagcatgaccggacatgtcccatgaaaggaacaagatattagtgagtagggaaaggttctacctaataaagcaagagtgaatgactttttttgaaacttaaaaacccacgatggaagtgatgggccaaaattagatgactttttaagtttcatctcattcagtccaaaaaacaacagctcttctattgaaaaagaagaagaagaaagatatggtaaattataatatatgtattttatttgtattaataataaatatgataaaataatactccatgggcccagtgacccaatcaggacaataaacactcatcatgatgcaacaactccagagtttattgtaggcagcaacaactttgataattgttggatggaaattgtagctaaatatgactaccccatatataaccaataaaacaagttgtgtggacgaaagaggtttcgtttaatctatcagacaagcatcatagtaattgaatttaaccactcaatataatggcggaaagagatcaacacattttgcacattaacgatgggtagacagctgggaaaattaagaaatccaatgatcgagatggatgaatttggaaacatagaaaaaggtaaattatttggtcgggcacaatataatggccacactcttcatagatttcaggctcctcatgtgcctttttctatgaaagtcaaccaattgaaaaatgcttccattacatttacacctaagaatctaaaaagtaattaacggatcgaattgtttgaattttttttccaaattgatgatcgaactttactaatactactctactctataagctagctattgttttgtttctcttcaagtaaagcacttacttccattcccacccgttatggggaaaattgcatgttgattagcaacagttggggcaagtggagcttcattatgcatacaacacagggcagatttgttatcaatgtccgaatatgctgtatatataacttcgcaatattttcaccaaacccccttatctaccaattctgttttgttgtattgatgcggtggaatttatattttaacaattttatatatatgaaaaagaagaggaagaaaatcttacaaaaacctccttgtgatagaggatagttgactgtgacaccctatgcctttgttttagcgagttcgaaacctcttggttacctgaaaaaaatattttctattttaaaaataaaattataaaaatatcacgttattttcaccttattttttctttataaatgtacaaaaaatagaaaaataatattttcattttaataattctcattgtaatattttaaaaaataaagtaaaaaagatgatattttacaattagtagttaaaaacttgttttttttcttttcttttcaaattaaacttgcatgcccttgatttctacgaattttgtacaacgtagtaaaccatctgaattctgaacccacaacatccaacttcgggacgtgtggtggctgtcaaaggtattttagctgtttattttgatggtgctatgagatagtgaatgatgtcaaccaagtcacatgatggttgtcgagttctaaacttgtgaatcaccgagcacagtgaatcaggccgacacaaatttggcatattataaccacaattatctagatcgatttctaattaggcatttcaaagtgaggctagaaaaaaaacgagtttactaattactagtttaattagttgtatatatatatatatatatatatatatatatcatcacacatggctacaattaaacatagacctgccccatgtttttccatttctaacacgagcaaagttttctcactcaaatatatggcacattaataaattgactgctttaatttggaccgcaaatatcatgatttaccgaccatctctttatagaccagaaaagtggaaaaagagaaatcattattacctagaatcccaggtcaatgttgaagttcttcccaaattccaagctcagattttcattagtgtggcatgttctcgattattaaaagaatttccaatctgtacacgttgaactaatcaaaacaaccaaggaagactgtgaatggtgtttcctaatgcttgacatcattcagcaattgctagggtgtttccgacttcataacccaattattataactcatatgcctttgcgagcaattagagaatgattaagattattattgtataatatcattgggcatatcatgcacaaatcttcacacaccaacccaattgcggactatgagcaaattagacccaagggttaccagaaacaaaatgttacattaaaatatactacaaactttctgaatgcatgccagttaacatccttaacttttactcattatttggaatttactatggtgatatattcctcagaaacaaactttaccatatctaattctgctgaatcgttgttgtaaatgtacgtacatcacactgttttttcttttaaaaacgtacattacacttgaaaacaatagcgctatagtatatactctaatgtgaagtttctatcagttgtgtaaatacatgcgtgaaagtgacatataactaaattccaaattaatggatatcatgattaatcaattaaggtccaccacttaaaaactgcatttatggtgtaacgaatggacgatggctgaattaaatacgagccaacgcaacatgaagagatagagagagagaaggagcaagcgttcgcaattagttggacatttttcacgaaaaagaaattagttccacgtttggtgccagcagggaacttaaagaaagagtgtctctatctttggtttaccagaacagtttctttattgaaatatacctgtatttcaaagtttgactaattttgcgtataaacacggctagaaaaataataataataataatagaacctaccacatttaaaagtaatactagtattgtttaattgagataataattacgttgatctttgaaaaattctgaaaaagacttcagacaccaatgtttttctgagcatcattattcatccatttgtttaatctacatacaggtaattaattaataaactcgtgataataaaataatttctggcctattagagctgtccccaaagttggaaagagccaaacccatagcaacgtttgttttggctgacgttgttgggatttcatttgtaaggccgtagtttttttcatttctagctccttcgttttgctattgctttcatttctcacgtaacctaaaaagaaaaatgaaaattaattgctgcctctctagtacaaaagccaaaataaattggctagaaagaaagtcccttcatcaaataatccaaaatcttaacaccatcattcgcttctatctcaaacagccaaaaagaaaaccaaacaaagcaaaagcgaaagaaaccgcaatttcaattttctttttttcccctaaagaaacatctcaacaccagtcacacctccgttaaaaaacaacaacaactgcatagtgcgtactctatagcctaataatgagacatgtaccagtcttttttttagttcaatggatacgactatgaggatgaatatggaataattgttaaaattaaataattttaatcattcattacatgagtttttatttggataaatttgctgaactcaaacttaatatgattatcatttatgaaatgattatcactcagttcttatttaaaaagttctccttattcaatatttaatatggtattagaattcaaatttaaaatcacttgttaaattacaaaaattttataccaattgatttgtatacttggtagtaaatataaattatgatcattttataaaagtctaatggtgatacattaattaattaatggtgtaaaataattttatattatcatcttaattataaattattattgatatgattttaagataattttgtaaaagttaataaatttattatatatgacatttgtaattagataattttatactgtactaataatgacattttttctccttttataatatcaattaattaaaaatcattttaatatgatttttaatataacgaattatggaagtcgagaaatttatgatagtttaactctaaaaaaggtcatagaatatgcacatattatttatttctactatatatttaatataattatgatacagtaaaagaaaattttaatataattatattatatacttttcttacacactgtttgacaaacaaaaagtgtaaccgccctctccagtcttcaccgttcctctctttctccgacgcgcacacacaaatttcgtttctattttctgattaccactctctttctcgaattctccaatgaccggcggcgacgagcgtcacgggacagagacctaaaaacatctccctctctctcacaaacactcattctccggcaggcatgtccgaggacgcgaacctggctctgcagacgttccgcgcgctggtggagagcgcggaccggaagttcggccgggtgcgcgacgtgacggcgtacggcggcggtgcgagccagcagcaccacgcgttccagaaggtgttcaaggcgtacacgcggctgtggaagtaccagcaggagaaccgcgcgaagctggtggagtgcggcatgaagcggtgggaaatcggcgagatcgcgagccgaatcggacagctgtacttcgggcagtacatgaggagcagcgagtgcaggttcctcgtcgaggcctacgtcttctacgaggccatactcagcagaaggtacttccagggatccgaacccaacgccaaagatctcggagttcgctccaaggagctgaggttctacgcgcgctttttgctcgtttcagttattctcaaccgcaccgagatggttaagcacctcgtcgaacgctttggggctttggttgaggattgcaggactacctttcgggtaatgcattgtttctctgctcaatttgacttaatttttgtttcagctttccgaaagcaaactgaactaactaatcttcatcttcatcttcatctttgtatttgtgtgttatgtgtgtagttattttattttcttgtttttgtcaatgaagttgttaggagtgaaaagatgtgtgatgtgcttggtgtttcctttcttgtgttcgacgctgaaaagtgataatacttttaacttagagattaagtaagaagttgctctgaatcaactggttcttggtcattgtatgatacttggtttagggtccataggtttcgtctgaggatgattcgaatagcttctcttgttttggctgggctatatgatagaacagaaccgcgaggacttgaggacttgatctgtgtaatgaccccacctagcctcggttgttcttccatgtgatatggttggtagagttcgcggttgttttttttttggatagaatccatgtcactaaattatgttagtttcatcgtttgatggcaatcccactgtagcagatttctgtaattagtaatttaatctttgtttcattgacatctgatttcacgggataaaattgatgggtatctaatggatatttgtttaagcaaactctccgttccttttgttttagaataggttattttcatagccttagcagcaacattctcttttggttacttctgactattgtatgaactatgaactatgaaagtgatcaggagagctcttgaaaaggatatatcaaggttatttgaagttactcagttttaaagtaataaagaaaagcaagtgatgattctttttaaaagaaatagcctcccattttagaaccatattaatgctggatcaactgaatttcaaactgtacgctactatgctatattgactgcaggggccagttttctagaataaattgttggtgtggtgataattttcttttcaaatcttacatgaagttcttttcagcaagtatataataataaagaaataaattcctgttagtgggctaaacaaaacaaatgattcggaagttcctaagttatactgcctatggagagcagttttctagaataacattgttggtgcaaatatgattttctttccaaaccctatctatatatagggtgtgtaactaatgagagcatgagatgtaggcagaatcaatcttgaccatactactaaacattgatagtcaagattgttttacttagatctaatattggtcatctatttatgattttatggtcaaaatcagttctctcataagggcatgctcacacctgatatgctcctacagtcctatgcacacatagttcaatgatcgatttgttgaaagtatgatatgaaattcttgtcagtaagtacatgataataaaaacaaattgcagctagttgacaagacaaaaggttctgaagttcctaaatgtattacacatgttgatttgataagtagatcacagaccaagagaataaaagtgttatgcttgaaataatgttacttaactagttgcatgatgacaacagtcctattgactatatttggtaatttttgtaaaattacttgaactttttgtctctcgcctgagaccttggtcatcttcatctctgcataagactgcattgtttggcttcaggtgttcatcacttataaatttacttcattagattattttgcacgtttgattatctgaagtcaagcttccacttctcaatctgattgttttatataatttcacttttaaactcatactgttcattattaacattgaattttgtgtttttctttaagataaaaaaaaatctcatgaaactttgctataatatactttgttgatgctttgtattccactttcatctggagaaaacattatatctatataacctggttaatttataaatgtgaatcatttcatttcatttcaggaaactaactttaaggaatggaggcaagtggtgacagaaattaaccgtttcacgaaagttgacaagggctttagtttcaggcccatgcgttattgtgccacatttgatactcatcgagcttctcttccttatgtggctcgttttcatgcaaagagggttttgaaatttcaagatgcactgttgacaagctatcatcgaaatgaggttaatactgattcatgttgccaaggttgtttttagatttggattaataaattactttagtacctgaaaggactgaagcttttgaatctttatatattctctcacctacaggtcaagtttgctgagcttacattggacatctatagaatgatacaatgtttagaatgggagcctagtggagtattctaccaaaaacatacagttaaacctaaggagaatggtgacataattgatcattcaggagcttccgggataatagacatgaatcttactgcagatatgtctgatccaactatacctcctaatcctagaaaggctaccctgtaccgtccatctgtgacacatgtgatagcagtgagttttcaaagcctattggaaagtttgcgttacatacttgcttgtctatttactaaaatctataggcagttctgagaactaggcttcttcaatatcaaatagtatttcatggctattttatggcttctcctatcaggactgggatattcttgggtacctttggtgtgcttcattggttcttatgtatactataatatgctttcttgtctgttcgtgcacacatacctgtttttgggtttgttttttccttagtgctgtgtgatctgattcatgaattgatatccaaaatattcacttgtcaaaagtggctgtttacatcctattgatatgcaatctttctcaggctgtttaacacacaatttgttatttcttgtataaacttcatgatgttatgcaggttttggctacaatttgtgaggagcttccaccagactgtgttgtgctagtatatctttcagcctcaggtttacatttgccctgtcttttcaagtatagtctctctctcatgtcctgttatactaggttagttaccttaatgatcactcatgcagggaagggtggtcttaataatgtctctcaagtggagaattttagcagttcatccaaatattcaagacgcaaattcctttcccagacttcccagggacagaattctggaccttccgaaactcaaaataatggcaagagagaactgagctattatgacaattatctgtggtttggtcccaagggaaatagtggttagtctattctctgtcaaatttctgttcagattgttctaggaaatgttacatgcatgttatattttctcttcattttatgggttagttttaattagatgttatataaaaaacaatcatctatgttgtagctgcacttacatgtgctttatttgaatcaccaggttcaaataatctctaccctggcgatcttatccccttcactaggaaacctcttttcctgattattgacagtgataacagccatgcattcaaggcaggtttgtcaaaactcagaacttgtgtataagttgcctgtgaactttgttaggcggagctgttcaggatattccttgaatctaattttactttttaatggcttggtgacatttgcaattagtttattactttgtagtctgagggtttgttataacaatttaaattgaattttaactcactaacctcagaaaaccttgccttgtcgaatttcttccaaaaatttgaatatgaatgtagaactttctcagaggacaaagttgaatgggtggaaagaaagaaccgttgtcaacaattcatgtttacttacaaaaagaatggcaaatacagcatttttctgggttataatgattttgtggttagttttttttaggtgtggggggttaatattgcttgttggcttgttccatgttaaacttatattggaattgataggaattagaaaatgctgtcttttttaggcttgagaattgattgacccattttatttactttgacaggccttgattgattgtgtacgtcataaattattgcaggttttacatggggctgaaaggggtgaagcggctgctctatttctttcacctttaagaccgattttcaagaatccatctgatgtaaattcaaataatggaagccaatttaccttttttttgactgctcctttgtcagcattttgccaaatgattggtctctcccccaacgagtctgatacagtaagcaatgcacgaataatctttaacatttctcagattaacttttaattcttgttggtctaattttgtgttaacctgtaggatgtctacaatgaagcagagaacataatcgctaatgctttcactgagtgggaaataattctttgctcatcaactaccatggatttagtatgggcgcaggttataagtgatccatttctaaggcggcttattctaaggtatttactctctagtttttagccaatgtagtctttttcttatttattttaattggtgattgttttggaaaatcacaaaatagctgtttactgctatttggagttcaagcgctattaaatttaagttattgaatgggcttgctgtatgacatgttggcatcattttatgtacagattcatattctgccgatccgtgatatcttttttctgcccacctgaggaaagtgaacagtacctgccactttgtttaccccatctaccgtcttctgttgcaccaacgtctgaagccgtgcgttctgctgttttgcaacttgccatgcactttgacgttgctgactactttcactttactgaaacgtaagattttgggactttaaaaagtaacgagtaaaatgttaggcttacatgcaggctttggaagctaaggattctcagatcaaaggaatacaacacattatatgagttgacctttcgggcgacaggacaagagtatttattgtgcggcatgggctgtctgatggaaaaagagattgttgcctctgcctgttgtgttgcttaatttgaccccacctgcttcattgatctatatgctgtatttggtggtttgctctgtaatgttaaggttaggtcatgatgggtgcatggtgacttttcatgtgtttggtcgtggcaagataattttgttttggtaacgtggcaagatagttgttagtttaaatatttgttcatacttcatagctttgaaaactgaaaaaaaagaaagtcattgttaattttacctttttggagcagaattggacggtattgaataacattgattgaggaggatgtattctgggaagaactaattccgtcaaaacccaaaagtaaattacttaccctgtatattcaattttagagttttatcatatttatttatagaaacattgcacaacatatcatgcggtaattatgataatacaatctgatagacaacaaatagctaactactgtgaatactatattcttaaaatttcacgtccgataggagtcaatcttgtttaagggaagaatatgcaaaacaaaggaaaaacactttgaaattcaagcaagtacattaattataagagaataattgagtgtaatattagagggatatgagtattagagtatgtattcaaatctgaataatgagtattaaatgagctccttaataacatagttatctaattcaaaatataagataagatgtatctatatactgttatttatagataaataacatataacttgtagagatattaggtgataaagtgattacacttatttgaaatgactcatatagttgatatgttgttaatataaaaatatgaatggtaggcatccgtcttcctatggaaagttgactttcatccttttataacaacactattaatgtagtattgttaacatggaaggtgtccacgtatatatgtatatagtgacattgcaatgatggtcacatgtaactttatcatttttggattatacataactactacaaagactatgttaaaagctaaagaaaaaaaagctaaagaaaagataaagctaaaattgatatttcaaaatacaaaatgtttatttttataattactgtaagattatcacaaaagtcaaatggggttacaagaaactcttcttactatgctgactatagcgaactctaaataatacacacaatgcagctaatagtttcaattttgaataacttaaattattttgtaataatgtttatctttagagtacattaataaatcacattatttttttaatcatatttttcatttttggactgagtaaaatcattataagtagtaaaaaattctttaaatatttaatacaattacatattaactaattaagctggaacgatttgcatttgcattatttattaattcttaatttacatttacattaatattatattcttgaaataataatagttgggatcacgttcattactgtccagtgttgcatgtcaccttcttttatttttttttttttaaaaaaaactgtccaatttaatgtttattggcaaattttaatattatattatgtcaaactatttatatccatcttcaatttataaacgtgggttaaatattattctctaaatactaatataaattagaaaaaagtgcagttatatgtgtaaatttttcttaaaatataaaagtaaaatttacaaaaccacacttaatgattcttaggacttgcaaagatattcttaggacttcatgcaataactaaaaatagactctatcagtattacctgatgcgagtgatgacacatacttttcgacatatcattgatcaggtcaaaggaggcattgaaactagctattctaaacttgcactgaaaaacttatatcaaggttggtttgcaagcacacgaacacatgggtgcataaaccattgatcactcggcctcggaagctatctaatagtaccttacctccgttccttattataaaagacaagttaaatatattttatacatcataatttatttcttataaaaagaacataaataatatacaagaggaattttatttatacaataaaattttattataaagtttataagagaaagagaaatgagaaaaaaaaattgagataaaaatgatgtgaaagaaagggataaaaaataccatgtgtgtaaaaaaatttatacaaaaggaccttctaagaaaaacttataacattagtcattgtattcagacactttaatcatacaaaaggaccttctaataatttgcttaagcaatggaagcaaacaagaactaagacacttcactacatcaggcaatgaatgtgctctactgcctcttcagcagtggcggatctatatagtaaccagggtgggtaggtgcatccctcgtttcaataaactagtatttgtcttaaaatattatactttgcattctataattttatattttgtaccctataattttatatatttgaattttcttatcaattcacatgtaagagtaagtaaatatatcatcttattttaataaaatgtaaaaaatattatattttacaccccataattttatattttaaaccttctaattttatgtatttgaatctccttaccagttcacatgtaagactaagtaaatgcactcttttattttaataaaatacaaatatttatcttaaaactttaaattttgtacctgttatcttcgtgtttgaatcaaattattccatatgataatgataattatcaatttttattttttaaataaattacccccactgatccagggtcctagatccgcctctgctcttcagtatacatttgcatttcctgatacgagttttgggttttgctgttactcccagaataaagaatttgtaagttctgccagaaacaataatagctagcacttaccaaaacaccattactctttctttattcgttccattttttgtcagccaagacacataatacaagtattaacccatacacaagaaacagaattccaacgaaactttcatacaaagaaaaacatccttagaccattaaaaaagagagaaagaaaaaccctttaattacttgacacttaaccatgactaggatctaaatttaattaaatccatcgcatactattctctttcaatgcgacgtccagcgtgtgctcactcatatttgcaaagcacaccctgaaccaccctgttcacaacaatggcgagagagatattaagtaattcacttaatgcaaaatggcattccaaagctccaattctccttcccctagatggcttccaacagtggactcagattcattcagcaaacaatcctacattcactttcaagcactctatcccaacacttgttaacccttcaatgatcatttgacacctcttcctcagcctctctgtgttgttctaaacgtagttctccgtgaacttgttatcagacaatatagaagccaaaaagtgctgtgtgtgaaacttggcatccttctccatcgttgtggtcttattggatcacacagtcacagacgaacgggccccacacactcccacaacacaatgctttattaagttcgagaaaaccatttgcggatgtgtggcatatgttggtatgaaatattatatttgaagggaaaagagataatttcgtccattcactccaatatttgtattagtgaagtgtgaaatgaatagtgtttttcttatattttattacttaaaatattatataatactattacttaggaatgtggcaatttcactcatagacccaaccttttggcgccaacgccactcctttctcctccaatcgcgatgtgtaccacgcgaacctcaacatcgctgccctctcactcgccggaaagtcgacgcctcgcgcaaactgttcgacgaaatgcccataaaacggccttctccaacactccaaagcactcttccactccatgccgctccgcaacgtcgtttcctggaactccatcatcgccgcctgcgtccaatacgacgacctccacgacgcgttccgctacttcgccgccgcgccggagaagaacgccgcgtcgtacaccgccgtgatctcggggctcgcgaggtgcgggcgcatggaggacgcgcagaggctcttcgaagcgatgtcgtgaccgaacgtcgtgtcatacaccgcgatggtggatgggtacgcgagggtggagggagggattgggctcgcaagggcgctgttcgaagcgatgcctcgaaggaacgcggtgtcgtgggttgtgatgatcaatggtttggtggagaatgggttgtgcgaggaagcgtgggaagtgtttgtgagaatgccgcagaagaatgactttgcgaggaccgctatgattactgggttttgtaaagaagggaagatggaagacgcgaagactttgtttcaagagattcgatgcagagatagcttttcttggaatataatcataacgagtacgccgagctttaagatttcaagctttcaacctccacgccaatatgtgttagttagcttataactgaaaagtgtttgtgatttatttttatttttgttgagagaagtgttttttgtttttcaattagatgtgtttttaaaaaaatgttatagaactagagactctatagaaataagcttggtagttaggcttctagttattgtctttggtgtttggttccttgtatatgattctccaaagtctgaattgaaattgaatggcattttttagtttgtgggtatccttacatatgatctagaccttcgggatgacaatgaagattgtgatttatcaaatgggcatttttgaagatcctttgggccatttcccacctatcaaagtcccagccttcattgtttcattcacaggaaaccagtggttttaactcattaaaggtccggagaatagtaaccatcagcatgctgccatgattgagcagattaaatcttggttagctaaagattggcaagttaatctttcccatgtttggcgtgaatgtaatcatgttgctgatagattagcagctaagggtcatgagcttctcttgggtcttcatatttttaactctcctcctccggactttcataatgtttggtggattgattttgtagggattcatttcccacgttttattctctcttagattaggggcttctgcccccccccccctccgtatcaaaaaaaaaaaaaagagagattttcttcagaataacccttttatagagcaaaagtccagcttggtcaaagacatcctaagacttctcactgctgttcttgacaatgatgatgtagctaggtctgctcatttcatgctgctgcatcttccattcaaagtgcatgctagagtagatgctcttgcttttttttatcagccagtagatgctcttgctatgggaaagctttcattatatcttattttaaaaaaggaacgaataacaactagaactagaagcctaactgtctgtgacttattccattggagtttctagttctattaaagtgtataataatcatgtaaatatatgtaagtcttttgaaaaaataaatcggatcctctctgcctgttatgtaatataagtaatattaatatagtaatattcaatagagatactctctttttttatcaattaaggacttgttataattaacttttaagacagattattatttatatccaataagaatttttttttaactctaatataattttattatcttttttttttaagaaaaacgaatggcgaatattccttgcttgctctaaaatttagcttaatttagaaaagttttatccgtttatagcatattttgattaaattgttgagcaaaaaacaatgacttgtggtcctaggaggaggaggttgtttgcttctgctctggtcattacatttttatttatttattattccatcttttcacaattgattcaccgtttgtaggttatgcccaaaatgggagaggggaagaggcactgaatttgtttcacaaatgatcaggaccggtatgcaaccagatgatttgacttttgtttcagttttcattgcctgtgcaagtcttgcatcactggaagaaggaagcaaggcacatgctcttgtaattaaccatggctttgattcagatttgtcaatgtgtaatgccctgattactatgcacagcaaatgtggtggaattgttgattctgagttagtttttggacaaatttcccatcgggaccttttttcatggaacagtcattgctgcatatgcaccgcatggtctctaatgacaaagcacgatctttgaccagatggtgacagtcagtgttcaacctgatggcataacttatctgagtttactatctgtgtgttgtcatgctgggaaggttgatgaaagcatgaatctattcagtttgatggttcataattatggtattccaccaaggtctgaacactatgcttgcttagtggacctgatgagtagagcaggtcagttgcagagagcttgcaaaataatcaatgacatgccattcaaggcatgagaatgttgtttccagtgtttagctctgagaattaatgttggatttggaatatgcaatgtggaataattaagtacacactttgatgaccgatgcttagaaagtattcttgtttgcctgaatcctagtattgctttaagtgatttatttttgtattttgaatatgggttagatttttttaaaaaatgattacctgtctcctatctgttgaagtacctcaacttaatttgaaaacttgaaaacgctaataacaatttttttaaagacattctttattttaaagaataaatataaatcaattcattaataaaaatcaatagttaaaattatgataaaatacttatataaaataaattctcaaatgtcaacagttaatttatttaataactgttataattttaaattaattttatcccctaaacaactaaacataacatgtcattcattataaaaaaaataaaaaataaaaaagttcaatccaattaatactacccattctcacttggcttacagagattaacattaaaaattagttactagtcgttatgacaaatttcattttttccggtaattaggttaggttggactatcttattaagctttcctacagggtatgctaaaatttcaaaattatgtcatcactattcaagtgtgttaactttcaaaaaaaaaaaattggctatcaatcattcactacacactcgacaaattgaggtttctcagataatacatggtatatgatcattacatacaataataaaataaagaattgggagatgatttcgtaattaactcaaaattattggtaaggatgtaatatcaaattatcacgtacactacaccatgtttctttgaatagacttataaatagatgaaaatagaaagggaagagtgaaagacatgggataaaaatatctaatttttaccatttgtttaataaaaaaaataggaagaaggaattttttttctgatacgcaaaatgacattagcatattcttcagtttaattgtagataaatagttatttattttttaaaaatcctaagaatctaaaaataaattgaattaaagttgtatttaattaatcggtatttgataaaactagttaaaatattaactgaaaactagcaaattaactaataattgaaaattgaaagttataaatgtaacatctcgtatgcatccggtgtattaacattattattatatcataatagcgcagcaatatcataaaagaacaagaagcttcaaacaagatgacgtcatcaagcgtgattaataaagtcaactatacattatatacatatgtgggaaattcttacaatatacaaggtataatagtctcaaaactgtacaaatatcccctcagggtattaaatacaggcataatcaaaatttgagccaacatgctcatcactctatgtctaaggttatcaaagaactattcctactcaagcctcttgccttgagatttatcaactactcctggatcatcacatgcaaacatgagctccaacaggggtatgataataatctcagtaaactcagggtccttggaggtctttcctccccttggttcacttccataaatatgacacgattattacatcaaaataacaatatatatatatatatatacacatatacatttctctatgcacatatcacatggtcggagatatcatctatccaaaagatacattctctccagactccattcacacacacacacactacctgaggaagatcttccagtgaagggctctccattcactcaggacttttatccactgcctgaggaagatcatccagtgaaggactctccattcgctcaggtcttagatggatatctatggtacatcctagggaagatcatcctccaagggcactcattccaagggaatccatagaaacttattctactggccagagaatctcacaatcacataacacaatactatcataacatttatcttattatcaatatagaacataacattatcacagtgtttagtttatcatcaaccatagaacactatcatagtgttcatctcatcataatgtacatgctttcaataaaacagtgacacacaagcaaaggaaatcattccaaggaacaatgagcttacctgctctcagctcaatactggctctcccactttcgtggtcaccaccacccacaatgtaaatctcacgtcctacatcaggcatgtaacaaacaatcaatacggtcctcaaccgttagaatgaaaggaaaacaccattcatttccataaaatcccctctgtcctctatcttagggttacaagggtaaaccaccttataagtgatctatagaccctcacctagatccatttggatccaaccaagatcatagagtccctcttagactctgcataggttcaattaatgatctactagttcataaatcaacaattgtccaacatagccaaaacagatataccaacacgttttcatcgtttatttggctttatgaacaacttttgtaaagacacttagattcatatatatcataataccttccattcactcaatcttcttcctacccataccaaactcaaggtcagaaccaaatttcatcataaatcaagtttcaaagttccatatttctcagaacaacctcctaactatacatttctaaagaacctaagtctaattccagccctaacacaaaagggttactattcatcctattacaaatttcacaaattaaacggtgaaacttaagtttcttaccttaacacagtcgaggttctctcagctctggcgcccttgaatcgccctcttttcctcccaaaactcagtttcccacagttccttagagaatggaggttcttggttttctttaagaatctaggttggaatctagctcataagtggttctaatcatgtttcttggtagttaggaggtgtttagatgaagtatggaggagttatgaagctcctatggtcatcaatggccgtttgggttagaggaagaagaagaagaagggttttggccttcaaaatgcgtgaaatggccttttatactggctcagatgtgttctggtgctaaccgcgccaattttggcgctgatcgcgttagatttcagagaaaatacactttctggaacacttctggcgctaatcgctccagttcaagcgttatccgcgccaaaatccagagaaaatgtgttttccagggcactactggcactatcggcgccatatctagcgctaatcgcgccaaaaaccatgaaaaatagccttatactacaatgtcacgctatcagtcccagctacagtgaaaatatttttttttttttacaaactcgagttattataataaaattatctgttaagataactaaacaatataaaagaacataattaaaaagttataaacttttaagtaacaacttataacatttaactaacttataaacttaaaccagcatgtacataaagctagcataaacattctaagagtatgcttggatttttggtagaatattttaaaatatatttgaaaataaaatcagaattatttaaattatctcaaaaattgtttgaaatttttttttctatttactgtttttattttttacagaaatctataaattcaattttttaaaaaaattaacgtacttttataaactaaagtctaattcaaatttaagtttgcaaaaattaaatataattcgagcatgactaaattgaagacggagccgatagaatggcatgtgttattaactgaaatccgggtaaggtcacagaaatccatgaaaaggaaaggtgcagtgtgcagtgtttctctcagaaaccgaagttcaagaaaagtacccacttaacatttccttcttctcatatgctcatcacaaccgttgatgcttgcttttggacgcaccactttttcttggctttcttccatcagtccccaaacaaagaaaaaagcgggccccaccaccttccctctaacaaggacagtgctggtcccaccacacccaccacccgcttcccaaaaatattgcttttgctacactccaccaactcttccttcatttttttaatccgacacttcgttagtttttattaattgaagatgtttttttttttaatcatccaacgaattttttgtgagaaaaaggtaatctaagtcccaaataagaaactcattaaaattcaccaggattagaagtcgaaactgcatcattcatacctttaaagaaataaaggatgacatcatcttcaccatccaacaaattttatattttcattccaactcttcatccaagatttattcaatccacacaaataaacattcaatcaaaatttcatgttataacttacaacttccaatttagtacacatactaaattatatttggacataaaaaatttcaaacattcaattaataacttttttgtccttttttttgtattatactatattatcaatcaaaacaattatttatctttttttcttatttctctcaatttataaataattcaaagttgttcagaaaatacttttatttataaaagagtttggagttatttaatataaattttaaaaagaccatgcatttaatattttatggattcataaacacattgtttgatgaactcaaatatatataaataatgaaacacgtagtttatgttgcacaaaatttaagtctagtattatatgtgatttttaagaattattcgccaattaaagcagtagttttattttacataataagaattaatattaaaacttttcgttcgtacattttttgggggggaacttttataatacaacctgtttgtccagcgatacatatgtatgaacattatcccctgtttgtccagtgatactccaataaagagagaggaaaagggcatagagtggtccggagatgggtggaagaggttgtctaagtatgaactttggctcataattgatgtggcagctcttcactttaaaaatataaatatgttatttaatattataatccttttgctttctctatttctataatttgaacacattatcggtctctaatttttcagccgttatcaaaatttgctttttgtttggtagttttttcttcttcttagttttgttctcttttatgttcacgggatactttcatactttattcaacttgataatttatttcatctcatattttgtttttcatatgtattgcgataattgttattattgttgtttttaagataagtacattgttaaaaaaaaatccatctttctttctccctaagatcttaaaatgagatctatcattaaaaaacaaaatggaagggattttgagagattttcaatcctacgtgttattatgagtattttaaaaagtgatctaagatcccaatttggaatctatcactaaaaatgctctaaatgagatattgataatggttgattttaataatcaagactctatttggttataagaagataaatataatagatggaaataaaagagagacaactagaggaaagagaaatatactaatatagtaaaaataaagtgaaatgtttaattgtttaggttaagtaaaaataaagtaaaaataaaataataaatttgtaaaaatactattgtaccattaaaatttgattattttgtgtgatatctaaaaaatgaaaattatctcaatatataatatgaatgtgttcaaaagagtaattaacatttatctatgtatctattataccattacattggtaataaaacaacatcattttgtattttctttgaaatttttttaaacatgtcaacaattgtaaaatgtgcacaaattcaatagttagatagtaaatttcgcaaaaagaaaatttaggtagtaaaacttgtgaaatcatgaaagttggatgataaaatttagaattgagccatatatacatatattaatcattggatttttttaatttaacttgaaaaaaaaaacactataagtacatatgatcatgtgaaaaatccaaagatctatctattatttttgttttttatcattaaattgacaaactatcaatattttttttatcaaatctacaacttttgtctttcttttttctccttttactatcaaaccaacatgataactccaattatcaatcatttatttgtcaataatattcacaacaattgttcaacaactaattaaaaaacaataaataaatatcaataatctcctcacaaatattaatgttttgaaatttagataaaagttataacatgaatatgaagaaaaacatacaaaataaaagtataccaatattgttaaataatatgataaagttacatttcttagtaatgagaggtattagaagaaaggcctccatgccaataggtacaaagttgaaatattctattttattttataaaaataaaataaagagtaatcatttaatagaaaaataaaaacattttaagatctcaaaatactgtgctttgttcctgaataatcaaaagagcattcgttttaatttgtaaagcatcaaattattcgagaaaaattacttactccaatttaaattatcactcgttttagaaaatagtttttatttctttatttcatatgttatctataaaattaaaaatatcattttaatttttatcatcatcttttaatattactattagaaggaataaaaaaactaattacacggtaatattttaaatatttcaatataaaataaatacattacaatttttttaaaatcatatatgtaaacaaaatttactttgtaaacttttgaatagtgcatatctttaaatggagataggtgacattgtttaaacttattttttaaaacaataattttcttaataaaataagtaattttattttttctgatttgttaatttaaatagtttttatttaaaataaatagtttattttaaaaaaaagtaaatcttatacgtttctttaaataacatttatgttaaattgattttttatgtttaaacaaaatcatccataatgttcactaaaaaaaaaaagtgaacataatgttgtgactcacgaaacaagttaatttagctaggatttgtattttgtttttattttttaataacacatatattttgtaaacaattttatttcagtcaataacattataaatgataatttttttcaaatatttaatataatcacaaactaataatttaaactaaaaattattagttaaattgagaaaaaccccacaccaatctacatactcagatgtgagcttggattttcatgtaagcatttgtttgattaagctgtgttcatttatttatagaaaaggagcctatacgatttttaagacaaaaacccattgtgaaagctattcatttcaagaaaagaaaaagaaatcagttctaactgctaactgctaacttctaacttctaacttcaaagataatcccttttatacaatcaggcactgagagaggatgtttgaaactatatcctccaaaggtaaggtaattaattagacaaatcattaaaactgggcaaggcatggattctgcaggatgtgaatgtgatagactccaaagttggaaacatctgtctcaacaaaaatgaagcctagaccagatacaataaattccagattcatcgaatatacaataaatacgccctccattaagacattaatgtcttgttttaaatatatcgtgcatcacgtgaatatattttttgggacatctatcatatgattatttttaaatataaataaaatataaaactataaattaaagcatttcaaatttttacttggttaatgaaatattaattataaataataaaaataaaatcgtgtttaaattttaaaaacgaggtagttttggataaaggaaatttcatttttaagcaatttaaaatacatgaaagtttaactattacaatgaaaaccctttcatttttaaagcattttatttgaataaaatagtgattcaaatctcttatgtttcgaattctatgtttagataagttaattttaaaatcatttcatttcttatttcaaatcttaagattaaagaacagttaaggggattttattgatctatgcatacaacttaaaagtgatttttaaattacaaatataaaattatcaagtactttatttttttactctttctaacaaagggaaaaaaaattgttaacaaaactctgtcctacgttcttttgaatatactttttttatttgctaaatttagctataaaataaaataaatgcttgctgttttcttaccaaataaaagtaatacacgaggcattttaattaaatttgtaatgaggtgtcagataaggtcttctccaaatttgtctatgcatggctgtgatctgacctgtctctgctcctccacctcgtaagtcgtaacaagtaccctcattcattcgcatattacttctctgtagtgcgcacccacacccactcgccgagagtagcaaactcctatactcgcgcttctgacgcgaaaaatggtcaacaccagttgacctgtgttctcttcatgttcgtggaagggcgagtacgcgtcgctgtccttacccgacgtttggtcctggaaacaatcgactgcatcgtcggatcaaaatctttgtttgtctgctactactttcagccaatgaattcacgccatgtgtcactttttttttttttatcttctgatattttattttgtttactttccccatcttaaaatatgttattttacgcactttagaaaagctaataaatactatcatatatcatagaataataattttataaaactaatcttatcaaataaataaataaataaaataatattaatattgattaaaaataaaataaatataaataacattaaaaatcaaatacaatatttattataaatgtaactagtattttttaatccatttttaaaaagtaattatattaaaaacttggtaaaagagtcttacccttcatgctcggattagtgagatgctttatgtgagggttgttatctgatataaacaaaattgcaggccataatatgcgtaaaattttcacttataatacaaatatggtatttatacatatcaattaataattcaaatacttaaaagatgtaataataataataataataataataataataataataatagtaataataatatagtaaatactaatagtttttattcttttacaatattctctaaccattaaacaaagtaaatttcgaagatttttatgttttcaaaatattaaatatgttggttaattttctataagatattaagatgattatcaagaaaaaatagtgaaaaaggatatgtcatctctcataaattatacctacctaaactaaatacttgtatatatttctgacatacaaagtcctgtgtctgaaggcatagtgacagtccaattgtaatttgcaataagggcatccaaacccagaacctaatcatcttctatttgcaaacttttgcgcattggaatttggaggccataaaaaagatgcgatgctacacgcaaacaagtagttaaagtccaataagaaaagcaagatagaaagattgtctagatcacacacctcaattaatacaacaccctgttgctgatagttattacatagagttcaattcaagcttgcaagcttaaccatggaacggtatgagataattaaagatattgggtcagggaactttggtgtggcaaagctggtcaaggaaaaatggagtggtgaattgtatgctatcaagttcattgagcgaggcttcaaggttccattttcaaactccatgtatcttttgtgttgtcatatctcaatcttgtacatatgtactttggattgtcctttgttaatggggttctattgggttttgcagattgatgaacacgtgcaaagagagattataaatcataggtccttgaagcatcccaatatcattagatttaaagaggtaaggaattggaacatttttggtttcaatgagtatagtctcaaagtgtaattgtttaccttctctgaagaaaatcattcccttcctttagctacttcttaccaactttgtgaaaatatatatgcatccagggacatatacacctaaactctgtcctaaattcaattttgtcccggaatggaataaatattcgagacgggttatgaaagcatggtttctttctatcttcctcataattcagttttattctctacaatatacagttccctgaaggatctcaatattcagggtcatttttttggttttccttaaaaggaatttccagaatcttgtaaagaactgaacaagaaatcttttcaatttgatttcttaaattctttctcttatattttatcgagctcccatgtcaactagtaatatgaccaaaacagtgcatacaggcaacaaaagataggtgctttgaaagaagaagatatacattactcttgtaataggagatgtaatgtttcttcttcgttcaaagctctcttcatgttttatcgtccctcatttatatatattattgtaactatatgactagtccaggtgggatttatagcatgttagctaacagcatcttgacttttatgccgatttgtgacatataattcatcgcaggtgttactcactccaactcatcttgcaatagtcatggaatatgctgccgggggagaactgtttgaaagaatatgcagtgctgggagattcagtgaggacgaggtagattagattagatataaatcatttctaataattgataacgaaaagcttcagtggctttatgatagtgcttttgttcaagatggccattgtattacttaactttttagattccaaaacagtaaaattaagattgcatcaactgtacattatgcatgaaacatattagtgtgtgaaatttcgaatggcaagttgatggcctgttggctgctttctaataatttggacatcgtatctagactctcttttttttttttttttttttagttttattttatatatagtatttctatatttcacattctagatacttgtaacagaaaatttcacactaatttctccttttccatgcataggcgagatatttctttcagcaactgatttctggagtcagctattgccattcaatggtaccatattcttgtccaatctgaatccaaatggtttatttttcaatgaatgatttaaattaagtcctactactttaaatagctgaattgaaggtgtaattttgctgcaggaaatttgccatagagatcttaagctggagaacacacttctagatggaagctcagcaccacgacttaaaatctgtgacttcggttactcaaaggcaagtacttattgctacttcttaatttcatttaacataatgtttcttaattactcaacggtgttcctatctttcttcagtcatctgttttgcactcccagccaaaatctactgtaggaacccctgcctatattgcaccagaggttttgtcaagaagagaatatgatggcaaggtaactttatatctaaattttccctttccaatcatgtagccgtggcttcactcatttggagctaatgtttggccactgataagttcttatccttgagaatgattaggtcgcggatgtttggtcttgtggggtgaccctatatgtgatgttggttggagcatatccttttgaagacccagaagacccaagaaacttcagaaaaacacttcaggttagttggaccaataataatacgagttcccttttagttttccaagagtaatatgactaattaattattaattagtttatttttggataattttggcagcgaattcttagtgtccactattctattccagactatgtacgtatcagtaaagagtgtaggtaccttttgtctcgaatatttgtggccaacccggaaaaggtacaaattatttatgtttgttgcagaacataataacatttttttatttattatatgatgttaactttgtgttacattatttgaagcagagaattaccataccggagattaaaatgcacccttggttcctaaagaatttgccactagaatttacggaagagggtgaaggggtgttgcaaaatgatgatgtgaatgacgactcatctgagactcaaagcattgaagaaatactgtccataattcaagaggctaggaaacctggtgagggtccaaaagttggtgagcaatttgttgggggcagcatggaccttgatgatattgatgcggatgctgacattgatgacattgagacaagcggtgattttgtctgtgcactgtgaatgggtattgatgatgcttgcaatcttgcactttgcacactatttctcccttaaaagcagtttaagataagatgttgcttaacgagatagatagatagatagatagggaagaatcaaacaaaacctctctaccatggtttttgatttgcctttgattagaagttagcttgtcttgttatctgcctatgtgggaataagggaatgttactgccttactggtttcttggttggtttaatgcttagccaaaaaatcaagctagactgtatgcatatgtaataattaataatatagtagtttgggtttatttctgttgcacgatccttcccttctctctctattatataaataaaataatttgcgatgtatcgttttcatgtaattattataaacgttagatgacaaattcacatttgaataataagtgatctatcattgtcattgtatcggcatcgtctaagagcactagacaactaatgtaatatcagcgatgctgatgcattatgctgtcatgctccttaaaaattaaaatactaaccttttgttgattctttttttaaaccgaggatatatgaatgttcaaatttaaacttaacctttaaaaaagacttggatgactagattatgatacaataacatataataattatactttattactattatttggtgcacacttatatatgatttgtctattgtattacgtgttatctgtatcgtgctaatgtattatatattttattgtcattcactgtcattattttactatttgtcactgttatcactcctccccctcttctttattgtcgcaaccattgatattactcttatctcatgatcattattatcactattataaccattattattcttattattgttgctgcaactattattattttaactcccaacacatttcttttatatgcaagtattaggaatcgaacacctgaccatgtatttaataagctaaattatttgtcagtcatcacattatgttggtacttaattcaatgataacaatttaaacattaatgggtagttatctataagttcatatattggtaattgttatgataataacaatttaaatattagggcttggattctaaatttgagttcgaataaaatatgagctatttagttcgatgtgataaagcatatgtattattgagcttaaatttaattgggtttgattggattgtttactactttttccaattttgttaaaaaaaaactcagagcttttcatgttaagaatttttgcaatattaatattttcagtctcttttcaaaaaaaaaaaatctggatgaaaaatttactaagaattaagatcagtcaatttttttagggattaaaagtggaaatcgactgaaaacgaggggaaatataattaaatcaattgtattttttcttttaaaaaaaatactcaattgtatattaggctaactacaatatattaaaacccatgggaactacgagtaaaaaaaaatcatattatttcgcaaatactctatattggaacgaactttaaggaaataaaaaagaagtttggatgggcaggtccagggatatttgggtcaggtgttgaggctgaaaagcccaatcaattactaaaccacacgatttgccaaaaccctaccaaaagcctaacggcgtaactgcccggcaaagcagaatcagaagcaatccgcgacgacaacaatgggtggtggcgggagaggaggcagatcccgcactcagagaaaacacttccgccagagcagagagaacgtgtggaagcgttccaaatcggatcccgatccttcttcaactgaaaacaatcccgcgtggactcccttcgccactgagaacgccgattttgatttctactacaaagagcagggaatagtggacccgcaatactgggaccaattcgttgcacttctcagaactccattgcccgcaaccttcagaatcaactctaggtcaaactaacaatcccaacctctctattctattctataactattctattcttctcttctctcattcgcatgtcgttttgtttcgcgattgcagtagccagttctccgacgaccttcgttctcaattggagaatgacttcgtgcattctcttcgcgacgaggtatgttacctgctactgtttcttttttctttttttgtattttttatgatagtgtttatttttggttgtgaactgaactgttgtttgcaggttgttgaaggaggtgagacggaggctattcggccgttgctgtggtaccctgggaacttcgcttggcattcaaatttttctaggatgcagctcaggaagaaccaaacgcttgagaggtcaatagaattcatgaatatgctactcccaaataatgaattgaaatacatgaacatgctacttccaaataatgaattgaaatgttatgccaattggtgcctctgattatgttaaatcttgcattgaaggttccatgaattcttaaagctagaaaatgagattggaaatattacaagacaggaagctgtcagtatggtgggtcacttcatatactctttcaatcttcatgatcatacaaagtgattttcttttattttagaattttgaaaatattgaatgctttagtacctgtaggttactaattgttctcctttcaagaattcaactaatgtcactctaatggttgtttgaaacataggttcctcccctcttcttggatgtgcattcagatcattttgtgcttgatagtaagcaacttctagtgtataaagtactttttattgttttaccagcccttattttatattgcttaatttggaattcaaacttcagcaattctgactattttatttttctttccttttttcagtgtgtgctgcaccaggttcaaaaacgttccaattgcttgagattatacaccaatcatctaaagcaggatcactacctgatggaatggtttgtgccgttttaattacgaaaatgttgatctgtttctttgccctttattccgtgttgttagttagcagcattttgattttcttgactaaagagttatctaatttcaacctgtaatgattgggccagctacgtatgcaacagtttttatcaatgtcttttttataattaggttatagcaaatgatcttgatgtccaaagatgtaatcttctcatccaccaaacaaaaagaatgtgcacagccaacctaattgttacaaatcacgaagctcagcacttcccaggatgccgtttaaacaggaattatgaaaggatggagttagatcacaatattagccaactgttatttgatcgtgttctgtgtgatgtcccatgcagtggagatggtacccttcgtaaggcacctgatctctggaggaaatggtagtttttattcctttatctagctccactttttatttttcttttcttttcaatctccaaattattttaatacctattttacctttttgcaggaacacagggatgggacatggccttcacagcctacaagttttaattgctatacgaggtgcttttttattgctttctgtttgtaatttaggtcctgccaacattagtcttgtgttctgtttccttgtatggtgccatcatcacagtcttttttttttttcagctagaaaattagtaatagccaacaggggttgtctcacattgaccttttgttcaagacatttgctttagacaatatatcatttcactaatcactagaaatccttgctgaagtcggtggtctgtccttgccttggatcaaggataacctcctctcaacctaaatttctttgtagccattgaaaaagaagattgattgtaagatgactttaagtctatgatatgcttgttagtgttttgttaactagcagatgattataaattgaactcaactagacttgtctaacatggacaattaggtttagttacaagatgttcatggtgacttggctgctctatactgtgtgcacggacagatccaggagtatatcagggggggtgtcgagctgcttgccccctcttggatccgtctttgattgtgtgtgtgtgtgttttttttaaattgacaaggatcattaagtgaaactatttgttcttccagattaagtttgttatgtaatttattgttctgtgcttctctccgattctttgaaagataacacacttgcattatgttgagcctgaaggaccagaccagtaatttttcaagaatttataaacacaaaacagtgattgtatttcagaaaaaatctggttttaaacttttaatgaccagatttgctgtcaggcactcagcacacaagggttttcccttcaagaagtattctcctttgatacacagcaagcaacaaaactacactctgaataatccaccccacttctagaacacacataaaacaaagaataataactgtccaacccacaattaacaaataactgccaaataaaccacacaaataacttccacgtaacctacacataacagttcagcacagaaatagtgagaattactgctaaaacctatttcttatttctcctgacatatacttacaaaggcttatgaccttccatcaatttctttaatgcactattattgactgaaatttattggaaaccacaaaattgtgtcttactccttatttaattagccttccacatgattttgtaatttccaattaatttaaaccaataataatgtgtaagaatgaaagtgttactaccactcctcatttctcaatgtatcattatcgtgcttattttgtgtgttctgaagatgacagacattcttacaccaaggaatagtttcatattatgtactttaaattgattttctcttttgctcattctaaaactttaataaacagatatactgcggttaaaaaactactgctgttttttgtctttagctaattaataagtagaaatgaactagggcttatgatatttttctaagattattttgtcaatatttactgaatatttctattctcaggtttatctctacttaaaattggtggaagaatggtgtattcaacatgctcaatgaatcctattgagaatgaagctgtggttgctgaggtaatcttatcttgaaagctctatactttgttgcagacgtaccttttttgagatttccccttaaaagtgctttgatatattaatattgagaatgaaaaatgggtaaaggcttgcaaattctatttgcttccacaacagcaggatatgacttaggcagttttgttccaccttttctttttgtttcttttcctctctactccaaaagcatcccattcctcattcactggtttggctgtttgcagcgtagcaattctatttctctgtctttcacttcctgataaaaataaatgaatgctttttctcccatgttacttgaattatttctctcaatctcactcccgacatttttaaaaaaatatttttggtggtaatttatgactaataatctgtgaatgaagtttatgagtatttatttaccactgatgtttttgcgtgcaggatttggcgcttttttcaaaagtgattatttgtagattttagcttatggaaacagtaacttttttagtcaattttttaactaaaaagcacttttcttttaaaaaaagacaaatgagaatgtaaagagaagctctgctcaattcttttttttatgccctcttttatgtcatgctgcaggttttgcgaaggtgtggagggtctgtcaaacttgttgatgtctctagtgagcttccacaacttattcgtcagccaggtctcaagagatggaaggtttgtgtttgctgtgatcaacttaccatttatttgttaagaagtcagaattttgaagaaaatatatgtaattaatgaccaaatatgttccctacctttacatcccaaatttttaatgtgtatctcatgtttgaggattatcttggagacaattccctcttacattatgtgatttgacaatgttaagggtggctggctttcttgtgaaaatgtttgtttcatcagttgtgttattccttgctatttgaattttgatggacttgaaatgctgttttgctgatttttttttttttttttgggggggggggggggggggggggaatgtgactggtagtgaattctttctaataaaatttttgctatttgatatgttggatgtccgtcaagttataccaacattcatgtccatggtatagaatcaagttttaaactttctaaaaagaaaattcttaagattatccatcttgaccatgcattcttatagaagctgttggttctgctttggattttgtttgtggcttcaaatgtggaaggggttaactctgttttgtagctgcatgcatttaatttttttttataagtgtttgattttggagatgcaggtatatgacaagggcacttggttggtctcttttaaagatgttcctaagtatcgtagaagtgtaattctttccagtatgtttccttctggcagaagccatcatgatcttgttgatagtagttgtagtgttgacccagagggtgttactaatggtattaacggaaatgctggagatggtgttcaagcagtagagaatcctgtgatgtcagagtctgctgcggaagtttgtgatgtccctctagagcattgcatgaggatactgcctcatgatcagaacactggagccttcttcattgctgtactgcaaaaagtttctcctctgccaggtagtttttcttatgactacatttgtttctctctctctctgattctgttaacagataattgggaaattttggagaacttgggaaaaaaattccaagtttccatttctgccttttttatgttcatttagtcacagacctttctttgttgccataataggttttctagttatttttctttattgcagcaattccagaacaaaccaaaaaaaagattaacgagcaatatgtagaaccagcaaaccagagtcttaatgatgcactagtaccacagattacttcaccggaaagtgcacatgaagaagtcttgaatgcagtgtctgaggaaaatgtagatgacaatgaacccaataccgaagatttggaagttggccctgttacatgtgaagagaacaattccaaggaaactcgagagcctgataatgtacaaaacacagcaaagagggttccaggcaaaagaaagctacaaattcaaggcaaatggaggggtgttgaccctgttgtttttttcaaagatgaaacaattattaatagtataaaggatttctatggaattgatgagcgttttccattcaatggtcaccttgttacaagaaacagtgatacaaatcatgtgaaaagaatttattatatctccaagtcagtcaaggatgttcttgagttgaacttcaaagttgggcagcaacttaaaataacatcaattggcatgaagatgtttgtaagtataatttatcctcaacttaagagatattgtttttgttagtattatattttatgtgattgatttatttattctccatgatactaattgtaaaaataatttatgtttatgttaataatttcctcattagaagcactccaaaaaacataggtagttagataatcctacagtcgtaggagattgatctaggcaagggaaacaaatttagttagaatttgattagtaaaagtgaagtgtataatttgtttgacattttgattgtaaagaagtcagtagactatactattgtttatggctactattggagttagagaatagtaattctgagtcgtttcataaattgtttcagtacctaggcatttatttctatttttgttttgttgacagtttttaaattcatgttgattttaataggatatggattacagtcatttgctcatttaactacgacatatgatggtcaggattaattatgtaatataataaataaataattcgtgtaagactgttttacataccaaatttctttttggaatattctaggatattacaagtgacatgcattctgctagttattggcaccatctactccgtttagtaatatttattggtcagtccttgactgcctgtgataaatgagctttgattaattcttatgactgagtgaaatatactttcatcttacaggaaagacaaacagcgcgagaaggtagctctgcaccatgtgctttccggatatcatctgaaggattgccccttattctcccatacataaccaaacagattttgcatgcatctcccgcagaattcaagcatcttctgcagaacaaagaagtaaaatttgaagattttactgatgccgagtttggtcaaaaggcagcaaacctattgccaggctgttgtgtggtaattctgtgtataggtatgtatcactgtcaccacgccattgagaaatttaatacccattggcatcaacatatttgtttataggaccttctttttctgcaggaaaaacagttgctgcagagtctctccaagtggatgagtcaactatagccattggatgctggaagggtagggcgagattgtcagtgatggttactgcaatggactgccaagaactacatgaaaggcttttaatacgttttgacactgaaaagggctcctctgggcatttggacaattcctgtaatgatgtggaagaagtacagcctgtgcaagagttgaacaggaaaaatgatgatgatgatgtgaaagctactgagttaaaattgactgcttaacagatattctttactctgttgtaagttgtaacagatatttgttctatttgtcatttatagaaatggtgattttgtccttcacctatgcaacgatagtgaaaaaattgcttgtttttgttaaccccgtcattatttttatagacagacgctggtccatatttatagttttggtttcttaaattgcttctgagaaactctgttgctgtatggtttagactttagaggttcaacatgagaaaattttataaagtcgttcctcgcgcatccaggttattattgacatgtaactggtagatttcagtcgaacttagatgctgtttattttactacgggaattaactctacaattataagcgtgtttggattatcggtccgaaagtatgttgggaccaacctccttttttaggaaacaatgatattcttacttttgtggtgaaatggtctcaggcttcatgctgtcgcaatttaaccgaagaaacaaacatgcattatatctaggtagcttcctagctacaatgcgtttttgtttttagtttgagatgcttagattgttcattacggtagttaacaactctagttcaatgtttgacgtacttttccgttggacatacagtattggctctgataggtctagacattctaggttgctggtagttgaaatcaattcgtattggatacattcaaattcaatgcatgtttgttactgcatctaatacgtgggtcagtggctcaaatcacgtcaaatatcaaaataaacttagaagctatatagatgtggattgaagtggacgtgatgggaaaacaaacatgctattcaaattgagaaattaaggatgtatttgattgtaaagaaagaaaagaagaaaatgaaagagaatatgtaagagaaaatgagagaaatagataagaaatgggctaaaatagagtagaaatagaagtgatttgattgaagagaaaaagaactaaataaaagaaaaatatttgaattaaagtgatttggtagataaaaattcatattaaataaaatatattatattatgtggtaggaaaatatttgtttatttaacacattgaatgcattataacaagttgatgatgtacgatttcatctcaaatttgatctcattgcaactaaaccaccaccatccttgtatttcttcccacttctcatcattttcatggtcttctcacacatttaaccataaatcttaagtatttttagcaaagagacaagaaaatgcaagcagaagtgggtcgaaaataagaaaagaaaagatatatatatatatatatatatatatatatatagtgaaaatggagtaggaaagaagataagaaaagagaaataaaagaggttgtttggttggcgggaaagagataattgattaggtgttcaggagagggtgattgattaagtgtctatttagatggacattatcaaaattgattttgaatggaatgatgtgatttatgtttggatgttttattataaaatcaagttaggaataaaattcagtacaaatttttgaatctaacgcaaaaactactcaaagttgcttcaacccaaaattaattatggaacaaaatcaattttgaatttttcttcaacatgaaacaaacatatgaaaaagtatccaaaatcaattttaaactcaatctatttttcaactccaaccaaacacacactaagtgagtgtgagtgtaattaatttgattatgtgttaagaggaagcgtaaagtcaatattcaattatgttccaacacataatcaattatgttgttgatggctatagtcaaaactctctttcaataagcaacataatctttttttttttttttaatataattgactatttcttgccatcaacgtttttttgtctatttatgcattttttttgtgaagacctacacctttttatttctttgctccttcatttccacgaagccaaatgagtcatgcttctcaacattccttcatttcttcacttttcctttcctttctccttctcttcaacactactaaacaagccataaaagtagaattcacttttagatttgtctttgatgtaaaatggatggatttttttattttaatctctttaaaaaatgttgttttccatcttcataaatttaatttttcaaatgatttaatagaactatattatcatttaaatataaattgtgatatataacaaaaatgttaacttttataataattattttaaaaatcatttaaaacatttttaatttattgactataaatttgtacattgatgatgtatgaaaattttcaaaataatctcttattatttaatgataaagtattaactttccaaacatatcatattaacaaaatctttaagatggcatctgatatgacatatttagttgtatgttattatcaataaatagttacaaaaatatttaaaaaacttccaaaatttacaaggacttaaagaataaaattaaaatttatcatatttacctaaattaacaaatctaatttaaattaaagtttaatgattatatattgacattgtcaaataattttacacttttattatcataagttactattaatataatttttaaaatagttaatatcaaaattaataaatttataatatataataaattgtgattaaataacgatttaaagtgtttatgcgtaatatccatatcttaagattgttaatttaacaattagcaccttattaagccattgcctttgtcttaatcctctaacaagttccactgttgatgacgttggttctggatttatgaagaaaccttgtacgtaagattgcaggggcttaccagatgaccccattggaaaaatatagcaatgttcaaactataagcacgaatgatgatattttcacgttcgataagttccaagtccacccaattcacctacaaaatgtatattgaaccaagcaattgttcaaaaaaagaaaaaaaaaagcaatttgtatctaccttcatttttagtttttaactcggcaaccaaatcaaattaaatttaaatgtacaaaaagcaatgcgccaaacctttaaaatttggtaataagaacacaaccatgaaatacactaaattgaaacaaattgtaaataaagtcaagatgattgacaacacatattcctcttagcagggatttcctgtgcagggcctggaacgataatcttctggccagacaaagatgctgagttcccatttccctgattttcctcagcagttaggttcttcttattgacaatgttgtatatttctgtcaagacagttatgaaggctgtttcaacattagttgcttctagtgctgaggtctctaagaaaaacaacccttctttctcagcaaattcttttgcatcctcagtgggtacgtcacgctggttctcaagatcacatttgtttcctgtaagaatgatgactatgttcttgtcagcatggttgcgcagttcttctaaccaacgtggtatgtgatcaaaggtttggcgtttagtgatgtcataaaccaacattgcccccacagcccccctgtagtatgcactcgtaactgctctgtatctgtatcataaaccattgaaaatgaaatattaggttaaactgaaatttggcatttaatgtacttgtaagtcaaccattcgaaccaccaagacatgataagaaataatcgtaattaatcatgtgaagaagcactaactagatataaattgcatgcaagaaaaaatagttctattctacactgttgataattactaacaagtgagaaaaagcaaagcatgtccaaactaattatgttagcaagtacaatttaactaaatgatgccccgtgctaaagctacttgatcaaaattgacaagttgtaaaacacttattattaaagtttttgaaggatcaacagcaacaataataataaaagctgttcaaaataataataataatcataataataataataataataataataataataataataataaagtctctggaagattgagatgataaattgtgaaaataaggccgataaaaaaaataaaagatagatggtgaaaataatattttgagatacccaaagcactcttcaagtctgaaccatttgcatagattgcccatgcagccaatttcatggatagtccgtcgcagcgtgttctgacttctgtctgcatgctctaaatctcaagatagacaacggttttaaactgaggcttgttgtacttcatattggaaaatcagttattttaaaatctcactaaatggagaatggtgactgctagttgaaaatgggaaacttaatgagattctgagtcttcctcacaaatttgcgcaactaatttctctatactatgtaaaacgtcacatcatatcacattaaacaacttatgcaataattcatgcattaccatctgtcggaatcccatcccaaaataataccaaaatttacacatgcatgcgatgttccaaattcagttttcattttccttttgtttaaaaatttattatttgtcatatagcttgagaatgtagagtattatgtgtcgagcaagaaaaaccaaatgcagagatgcatcagcttgaaagtcaacaactttgtataacgatttatcagaaggcatcagcatcaattccttgacatagatttatcataaaagattagacaatagcagtaacgatcgaccaaataagaaaagacaataacagcaaccagcaatgcaaatgcaagcttaaatctaacgggagcttggagttttaataataactgcatcattcacaccaaaaaaggcaggaaaacagtggcattgtggccagaaattcgttccataccgttgcgaacttcaaaaaactgagagggggaattaacagcatcccggcaatttcggtaactgagaatctgagaccacagtcacaactcaaagtcatctgtacaaataactacttctaattcaaacccagaaaatggtctacaatcattactgtagccacaaggtcaaggttttgccggtcttaattagcagctgcaattgcagccatattaacaatatttgtcaacaatttttcacaatatccaggattgtaacaaaactggaggcaccacaatttaaaaccttattcaaggttttacaaagttatttgcaaacacaactacagtccaaaatcaaggtttttggtctttactactacaattgtggccatataagccagatttcttaacaatatttcgcaatataaaatattaccatgaaactgcatgtaaactacaaaacggcttgccgtatgttttccactctagcaatactaaatggtacgaaaatttgtagaaagaaaaagaaaattttacgaaacagatgttttaatataattggctcaattgtaaaataaataattttttttttcaaaattaacgaaaatcacggtgataagcaacatatagtgttcgtggaacacgaattggtagcaataagaaacttcctttccacttaatgaatattattggatcgaattttccttgtttcgtggtaaagtcccgggactcatccttgtccatgttctataatctataccgtctctttttcctttacgtgcttcagtcacatatcaattaccaatacacaacgcgatgatcacaatagatcagctcagtaaccttagttaaaacacaaatccacgcgatcctccgccgcgacgatcagatcacgcgcgaaacgacgtcggtgacgcaaattaacagattcaaaccgaaactaacaatattaagaaactatggaaaacgataaaagttagttggaaaagaagttatagagtaccgttcttggccggcagtgtcccagatctgagccttaacggtcttgtgatcgataaccaaagtcctcgtctgaaattcaacaccgatggtggacttcgagtccaagctgaactcgttcctcgcaaaccgagctagtatctgcgacttccccaccgccgagtcccctatcagcaccaccttgaacacgtagtctatcctctggttcgcgtccccataccctcctcctgtacccgcacctgccatttcccactacactttttctgttcagtcacaataatatatcttcaactcacttacttgcacatacacatatatatagtgtctcgcttttggtgtttctttcgctttaaggttaaaacttaaaaccaattaaatgccacactctttttattttttttgttattgccttttttattaaaggaacacttagttgtttatttattatttattgtatatctctctcttaacacttaagtgatagagtgaaagagattgattactgatttcttaaaaatttgaatttttatgaaaattatgtttgggaatttggtgtctcttcctaattttcaacaaaaattaatttctgtttttaactgtgaatattaagtatgaatattaagattgaaaaaaaaaactcttatggtacactacgtgtgtgattactaggggtgggacacgtgtcacgtgacacatgcacgaatgaggtgggaatgaagaagcgcgtctccccaccaatgaatgagaagtggcaggtttgcataaagagttgttgggtgcttgtacacagagaaactgattgcggtgtttgatcattgatgattaatgaaatatgagaggaagaacggttgaggacagctctttggtttttactttcgagcgatcgcagcgtctacggttgcggatttctcgggtgagttgtctgattagtactgttgacacaaatacagatatttcgggtcatggccagacattaatgttgcaaataactatttaaaatattcacaacattattttttttagatcaactaattttatttttaaataaatattattattaatattagttgacacaagtgatattgatatctacctcttaaccaaatgatgtaggattcgaatcttaaaattaaatataaatatgaaataattcatatttaaagaaaatattcattttttattaataaatatttcatattaaaatcatagttaataaaataaaaatattgttaaattcaatattttattaagatataatttcaggagaggaaaataaggcttgaggagaaataaaattagaaacagttaggttaaatacacaaaaattttacatttaatttgtcctcaaactctaaagttgaagtcttacattttatcaattatatttaagttatattttttaaaattagtttaaaagttaattaaaagttaaaaagttagttgatacttgagagtgagtaattaaaaattgaaaaactaacttgttaaataataaatattttttaaaactaattgttgaagtaaatgaaaaatgtaaaataacaaaaaaaataataaatttgtgatttatttaagaatgatgactataaaaaataaactagttgaataacaaaccaaagctgaaagctagctaaatattcagttaacaaattattggttttgtagttttcagctaatttcatgtttggcaaaactcatagaatagatagttggaagctcaaaaaactaatttattaaattataaatacttagtaaaattaattattaaaatagctaaaaagtgtaaaatgataaaatataaataaaatcatgatttatttaaaagaataattagaaaattgaataaatatatttaggataaaaatgaaagaaaaatataaaaagttataaattataagttagtattttaaaaaacgctacttcaaaaatatttcaaaaaatattaaaaactactaataaattattaaaaatgtttatttatcgaatagtcaaacaagttttgtagttaataaaaaaaagtaactaattgaaatattttatcaaatataatctaagttcaatgaaatttcaaattatttgattttttaaacttaaattgaccaattatcaaattagactaaaataattaacatttaaattgtgctaaaaaattgtatccgaagtcccacattttattgggcgagattaaatctaagttgatcctaaattcgatgtgagtcatagtttacaacaagttagactagaaagtttagattaaatttaggtttctaaaataaggaacaagctatattgacgtttttgtgaattaaactaaatgggttaaagttcatgttcaaaaattaaaattaaaattatacagttcatcaaatgggtttagatcgatccagataaatacttaatacgtgtttcaagttataataattcaaaggccgtgttcaatttgattttatgaaataagattgaagtatggcaaaaaccttatttgtataaaattttggctagctaaacccaaattgagctaaaacgacataaaagatgaatctgttccaggttctttattattattaattatttgtatcaattatggatgtttttttttttaatgcgtatgaatgaaagacatatattaaaaaatttataagactttctagattcacttggttaattacggatgattaatactagtaaattaaaataacataacaaaattaaagaattgtaaaaatcaagttaactaaattatctttcaaatataaaagttagaattgattagatccaaatccccgctaaaagacttttagtaaaaaattctatattatttatacttatttataaactttattacaaagtattgaagttcatttttgtcttttttatttttttttgaatttggacataaattataaggagggacgagtcaattcaacaaaattaaaataataaacatttaaagaaattaattaaactgaaaatatttttaaatcaataatttaaaaataataaatccaaaattctctatacatataacatttttgtttattatgaagtttcttatattgtctcaagttcattttattcaccttatgaatttggacctaaattataaatccgacagttaattgagaattacatttagaaaataaatatttacaaataaagtaaattataaaactgacaataaatatttattttctaatatacatcttttagttttatctgtaaattagttttcaataattaaaattaacttttatatcacaaactaattttttcgttatatacttaaaatataatttatatactaaaagaatatttattataaaattaaattataatgtaataatatattattcattataaaataaatatataaaacaaatttgataaaaaaattatgtaaaaacaaatattgaccgcaaatgctaaaaatgatcctgtagtaaaagtaaaactctaacatgtttggttagatgaaaagaaaacagctaggaaaatttcaaaattttgaataagaaagaaaatgaaaagaaaaaaaattaaactttttgtatttacaaaataatttattttctttctccaaacaaaaaagaaatattttaattgtattttttttattctttattttttttctctcagtttctctcaacgaaccctaaagtctaaactccaccgaattggaacaacacagtgtgattccccaaataaatacagaacaagaaccctaatttacattgcaattgtgttggtaggaagtgtagggcagattgcgtagaatcggaagatggaagaggaagagcacgaggtgtacggaggagagatccctgacgagggagagatggaaggagacattgacatgtccgccgccgacgatgacgccgccgtcaaggagctcgacgagatgaagcgccgattgaaggaaatggaagaggaagccgcagcgcttcgcgagatgcaagccaaggtcgagaaggagattggcagcgttcaaggtttttcattatcctcattttaattcgtcaactttatcttatactctttcgatcaatcgctattcagaagcttaatcatattttatggcaactgataaaacctaagctcaccaggtctcgaataacagccacgttaaactcatcttttgtgattattgataaaacctaaaacacggcagagcttgaataaaaatctcttaaactcttgtttctgcgggaaattgtggacaatagcagttctcctgctatgtgctatactgctgtagcatttttgggtttggcccgcatatcactatttgaaattgataattatgattagttcctagtttctaaccaaggtactttatttgaaatatttttttttatatttacattccttgactatggttaaaatcttggcaaaacatgatataaaataaaatgtcttttgctgagatatgcttttgtgaagtcttgattttaccaaatcacgtgactactatctaaatagagttgcatcattattatttttcaacttctagattgaatctgttttgcagatcctgctaattcagctgcttctcaggcaaacaaggaggatgcagattctcgatctgtttttgttggcaatgtataatcctatcctatcctgtttttttttatttttttttatcatcattagtttttcaatttgaatcttgatttggttattatgaactatatttagtatttatttagaagtcttattttgctcatattgcatgaatgtgaattgcagaccttctggtttgattggttgaactaataaactgatctgccaaatagtttggtcctatcttttaaccgataacttacaaattggctattaaaccacctaactgaggatgaattggtctgaaatttattgcccttgtttatcaccagggataacagacttgtccaaagttaggttatctattcaattaatatctcaatcatctgttaattttgcctggttttgaagcattctgtaattctattagttgtgtcaatagaaactttagttgaatggatcttgaactgaattctagatgcttcttttcattgtattattttactatgatatatttgatactgctttttgttttgttttggaatgaatactgttaaacttcagagacaaggtttgacttttgtctgactatgatcgcagggtcattcttattactcaggttctataattagcgctgggaatctgggatgcttacattgtattttgtgtgtgggacaatgtaattggtgtttcttagggttgtattagagagaaaaaagaaagtatattgtgcttatgaaacttattaagatatcacatgaaggaaaacagacaaaaaaattgaggagaaaaaaactaagtttatgaaaagaaaaaaggcaagaaaagaaaaacattatacagaagaaaaaatagatcaaattgagaaaaaaaatgagaaatagaagaggaagagaaagaaaaaataaagaatatgttgaggaaactgagtagcatttcatggatggctcaaactggtacggctggagtagaatgtgttaaagatgcatcaactgcactcctggaggagacagcttgtggttcttttggaagaacattctgtgagtgttgggcatgcaatcctagtcatagagccctattgttgactgcagtgaggtgtgtggtgcctttgttgtgtcatttggccaatgtgccaatgggtatgcagctgctgcttgcctactggccttttatctcgtaattgtttttcatctgtgaattaaactacctgatatttgaggctttttctttctcatttcaagttgttacacaaacattaagttgcaagtgaatgattattttgcattctgttttccctttactcctcttctatcacttcttacaaaatttgattagtgcaatttatacagaaagggttagaattctgacttaatatgtttaaggtttagggtttagtggggacaaaaaaatagtctaatgggtattgagttacaactaataataataataagttacacttagttaccaagcttcccaactggatttatacagaagtttttacaaagtacataatttcatgacaaaaaaatctaaaatatctaagtttctatacattacaactaccttctacacatatcaatgtattttctctattatctcttataaatttctaccttcattttaataaacaattgtctaatgggggcatcactatttttcttgtgtgggcaattttttttttattaaagatgttaagtaaaaaaaattgcttgtgggggcaattgcccccataatgctgtgagtgcatctgccactgcttgtagaccagaaaaggttgatgcgattgtcaatttgctatgaggaggatgaatctaaggagtagaaggcaagagttttatctagagtttgagaagagcctgtaaaatgactatgaacatcaattaaaattacatctataggagggtgcattgcttggttaggttttgtgtttgggattccatcttgtttggagttggtggttcatggagttagaaatgttgaaattcttctcatgattgagttgggaaaatgcacatttctgttgatgttgtagttagaaaaataattgttcatcaatgttcgagatataaggtggcctggcatactttttttaaaaaatagaatgagtcagtttgaaagtgtttatggagtaagaattggtggacttcttctgttgtttggggagttgggaaaatgcatatttctgatgatgagttgcactaatgtttgagatctaagcgtggtctgccatcctttaaaaaataaaataaactgagtcagtttgatttttagggtagaatggttatgttctgatgttttcagaggtctgtcctgaatttatatgcttttattgtgttcctttcttagagacaagtaataatgtaaaaatatttcgctaaaaagagaagtaataatctaaaagatagaattgaaggataagaggaactatgctctggagtttctcatatgaattgtcctgagcaatttattgaattccccattatattaatggagaattctatacagagtggttgtaagtaaagatatttatttaacattataaattttactaacaatattattgttcatatgcaatctgtaattttggaatctaatttcttatgataactgaatcaggtttaagccccttttggattaacatgatattattggcatcaaaactccttgaaattgatttgtgttttacaggttgattatgcatgcacaccagaagaagttcagcaacactttcagtcctgtggtactgtaaacagggtcactatcctgactgacaagtttggccagcctaaaggttttgcttatgtggaatttgttgaagctgaggctgttcaagaggctctcctgttaaatgaatctgaattgcatggccgtcaattgaaggtacattgattcaattgtgttgctatttgaattactgttttggttgctattgttgtttcaatcagccaagaaatcattcttttaaattagttgtatttaatcatttggaaactttccaggttttgcctaagaggaccaatgttcctggaatgaaacaatatcgtcctaggcgctttaatccttacatggcatatggcttcaggaggccatatactcctccttacttttactccccttatggatacgggtatgttgtgtgactcatttaatttgcatgttatgccctctgttgttttgattgatgttttgaattttcgttcattttccattaaatatcctgcaggaaggttcctaggtttagaaggccaaatcgttatatgccgtaccactagaagtttcatgcggaatgtgtcatattgggaagatggagcatcctggagcataagttttttgatttgggcattgacactatcttcattcagtattatatactctgattgagaatattactgtgaatttgtcttaggatgctcgagtttacatttttcttgcgtagttcttggaagatggtttacaattgccattgaatattatgttagtgacttttcagtctatggtttataccaaccaaagatgtaccctttggtaaactcatcaggcctcctcctctgtccggtggtaccaaaatttgatcaaattagagattgaaatatgaatggcgttttactggacattttgggtttatgatttatggcatataggtcgtaagacaatttctatcttgcgccccccttcctttatagtagggtgtgttcatataactggttttataaaatttaaccataattactggtcctatgctagggaacagtaacgtggagtgtgtttaaaagagtgagagtttgactctagcattcctcttaaatacaaacgcctctatccaataaagaaagaggagaccgaggaagcatttttaaagtgtttttaagctctaattctatgctggctaattgagttttgtgatttatcattctgtctatgtccaaatatttaagaaaagtaacagaggaaatgatttgtttccattcaggcgagactgagaagaaaagaaagatttgagttgacttttttggttaaaaattaaaataaagcacggtaaattttgtaagttttgttacatgtgtggtgctaaaaatgagttgagtaaagcttaaaaatcatcacaattttataactggctatctcaatatcccatacttaaggggctgttatagcttataaaatacttatgtataagaccgaaatgttgcagcatcaaggggttgtatgcaatttatgttgatttcaaactatattaaagtcaaaaagtctcaaatctaacaattaaagaaaaaattaaacgaaactatttaatatacatgataagtatgaaaatttaatattaaaatgattccattttttctacagtattatcttgctaagtatgaaatattcatgttttcattcctaattcttatatatatatatatatatatatatataatattaaaaaaaaagtttaaatatgaaaaccaattaaagaaaacacttgaagaagcaaaagggtataaaagatcacatttcccaaatgctcttgaaagaaagaaaaatgtggacaacatgatgaaatcctagttcagctactcagtgccagtggtgatatggagccctgcattgcatatagtcgacccctcgaagctatcgtcaccaaagtgctgctcagaaacctaccatgatatgatatctcttctataaccatactcatactccaatcaatgttgcttcttctactccatactcactaacgcaattcgccacttgcaacaaacaatgctactcacttgttaccaccaccccttccctcattcggtttcttcaacctcaacccactcactctgcaccacaaatagaaacggcaacctctctctctctctttccatcgtaacctcgcgtcctctccacctcacaacgcaaaaccttaacctcaccgctcaacgcttcaattccctcactgtccgcgccgactcatttcacctccgatccgaacatgtcgccgtcgccggcgtttccaatttcgactctctcctttcgctgctcgagttctcgtgcttgctctcttccgccgtagcgtacgctgccgccgccgtagtcgcgggttccaagaacgagctcctcgcggggatcggtaccagagctgctccgttcggcggtgcgttgcttgtggtcggggttctagtcggcgcatggattcggaggcggcagtggaggcgcgcgtgtgtggagactgggaagggcgggttggaagtgaacttgctggagaggattgagaagttggaggaggacttgaggagttccgcgacggttgttagggttttgtcgagacagctcgagaaattgggggttaggtttagggttacaaggaaggccttgaaggatcccatagctgaggtaactacctctcattttgctacactagttttgtgattctgctttcgcacgtgttcgtgtgtggaatgtggttggtgactgagtttgttgggatttcattcgccgagcatagtgaggaccatatatgcaatgcatcattggcaacttctaatggttaaaaaattataaagtaatgagaactgcgcttctgaaagtgtggggtagtatggtgtgagtttgtttgatgatactgataattaggttgagtgtatggttttagtgtaatatgaagtgagtttgcttgatgatactagtactcaggtcaagtagtagtgagagcaagcctaaggctgatagtaaaatagctttgttattttaacaataagttgctgacaaactctgaagattatgatcctagccaaatttggcagctcttcaaattatataattcataacaaaaagacataaataacctatattttctgcccaaagtccttataagaaaaatagattcgtggaaccatcactggattcagttccatagctgtagtcaaggatcagctttcttaaaaacttaagctgttaggtagaagcccgtgaatggtttttatatcttgctcacttgcttagcctagagccctttgagcttgtagtatgtgctatgcacaggcttctgttatcatgcattgaaatttgaaatttaactttgtttagagtgaggttggcaaggattggactgcaatcctaattacttggttgcacatcagggattagagaagattgatgggcatcctgttgaagcaaattacactagcttttgtattaattttatggattggatgtgaaaatctgtcaatatgtgcgctgcggaagtgcaaccagacacacatttggatatagataccttagaatcactttaaattctaaaacttctcccaaaagcttaagctgttaggtggaagccctataaatgggtttatatctaccaggaatcattttaaatactagaactttcatctccttcattagattttggtctttcttgaacatcattttatgtctcatccaaatcaagctccatctctttggtatccttttgctccttactaagctgtgttagccatttggctcagatttcaggtatttttacttgcttatttaacaccagctgcccttgctagttgccattactcatgtatcagttcttcattgtcatccccatagaagtctccatcttcaacattttcatcaaatacatggttcaatacccatctttggtgacattttcatcaatattgaaatcatgtttggacacctgattgctttttgtttgtttacaaatttggtttgtttacaaaaccctaagctgctaatagtcagtgatcacattttttttagaagctaatcagtggacgcttaaaaccaattatttgtctttggtacttctaaatgaaatatattgttaaatattctatattaacttcatccatattttttttaatatttattttttgtgtctttctgtacacacacacacacttaaattctgcattgccattttatatcatgttggatacaatacacatgacatacccatatggccatacctgtgccgcaggtattgattaaactcatgtctatggtgtagcatgtactgaatttcatgttatttcaattgctagtacaaggaaatttccaatgtttattttttgtttgtaaaaattaagaatatgtacactaaatgtttattagcctacccttggtaacataatggttgaagtttaatatattgaaaaatctgactggaaaagatatctaattatttgttcatttctttaagactgcagctttggcccagaagaattctgaggctgctagagcattagcagtgcaatcagacattttggagaaggaacttggtgaaattcaacaggttttactagcaatgcaggtaatcctcccctcccatgttatttaaactctgcctgacagtgcaggcacaatttacaaatcaaatgtgcatgtaattgtataatataatttagtttaaaaatgtttttggtctctatagtgtaggctatctcttgaagggtaagtggtgtatcgctgatagcaggcaggaactaaaacataaaagggaccaaaaaccgaacttataaaacataggggccaaaaggtccaaaaccaaatttgagtagactatagggacacaaaatgtatttaaacctataatttacattcacctctctattttttagaagtatgtgggtgtatgtaagcaaactattggcttgtttgttttaaagttgggtagaattatgggcgttaacatattcaacataattgggatatgtattcaaattactctgtcacaatcaagtgattggacataagtggttaatgtgttgaagttaaggttgaatcgtttaggtagtatctaagtttgattcttgacggaaacaattcttggtcgaactttacttaccgtcccagctgaactccagattaatcagggtccctttctcttgatgaaatcagagggttaagaccaaaagttactcacaaattttgctcttggaacatgtgcattgtgggaaattgattcttgagtgtaaaacaagtgggtgtattttagcaatccccatccctctcctcctccccacccatgctaaaacacatcaacatcaacaacacttttaactcaagttaattgggggtcggtggtagatggacccaatgatagatcggaaaaaaaacaaagaaagagaaaggaagataggaagaaaaaggggaaataagacaaaagaaaggaaaaatgagctaaaataaaagaatggttaaaggaggagagaaatgaagaggaaaataactaaaaaaaaagaaaacgactggaacatagacataataatgagttcaaccctccaccaagcttaaagtttttctccactccgtcgttagacacatcgtctgccaatctatatttcactctatttggtcttgtttaactgcttttccccaggtgagtttcggttgacctctgcctctctttgtgtcgagctcttggtaacaaactcttgctctcacaggaacatccagtggtcgtctcataacgtacctaaatcatctcaatctatgctcccttttcttttcacacaccagaactactgttacctttcgtcgaatatcctaaatctttcattgtgttcagatatatcttttttaattttttggtaatgtaaaaagttatatattgaccatggatctagtttgaccgtatatggctcagtaaaaattttcttgactgctttactttccaaggtatcctcatttttttatagttgagtttgaattgtattggttgtgtctgagcgttcatgtaggaacaacagcgaaaacaacttgatctgattcttgcaattgggaaggctagtaagctatgggaaagcaagcacgaaaccagtgaacgacatgacacattagaaatgtctaattcagccgaggatgaggtaaaacaggaggtgcaccaaatatgaagattgggttaaagtaaggggaaattcctgaaatttcaaagtggcaaatcgtggagcaatatttttttttttttttttgtcgtgtacactgaatcatcaaattgttacagaaaatcaaaattaccagaattttatcagcacataaataatgattactcgtttttccagagtacctcaaatttgttgtggatacaggtgagaagagattacacgagagtcaagacaaactaatgtgggggcatttgttgaactctgtccagttatagggtaaaagttcaggaacgtatctgttgggttgtgcatgtactttgaattcaagtttataagctgttctccatcaaacatgcttatgttggtagttataaaggctcggtatcacatttttctttctcccctgcatgtttctgtatcatattaaaatgaaccttcaaaattcattgataaatattgaaaatgttgattggttaaggccgtgagtaaaggattcatatcctttcaaggtaattacccaaagtaaaatctattcgaggatcctacacattgaactctactgttgacagtggaagaaaaaaaccccttaaaattatggatcttaataagattttatggtagaaagacctttttatcccttgcgatatgtttctataatcatcatttcaacgaatggtttctgcccagcctttcgggtccttctgctgcttaaccgattggtcctattcgaaaagttatacataaactctggattaaaagaaaccagttatttctctgctatgttcaaattggcagccctcatgaagaatttgtgaaactcaactgtgatggggctttgaatttgcaaactaagaaggctgttgcaggttgcttcctaagagatcacctttgccattttatagtaggcctcacgtcatctttgggatcatgtaccgtcataaaggcggaactttggggtattcacaagggaaagggactacagctcacactatctagattctagactctagaggtttcaagaggattttagtgggagtgattctctggtttacatttaatggaacattagcaaaacgttttttccaacacactcttatatgtagtgcatcttttggagaaataattattttttgttaacttttagaaataatttcaaccaatgtggttacttgacttggtgaaatggaattcatataaaatatatgtactgcaaagttaaataaaaagtagatcgatcttgcctagaatatcctcactaaaccagcctcccggctaaagttaaagctcttatgcaccttccttcaaagaacaaatagaatttggtatagatgttctaaaattcattctagacaagctcagcttttcaaagttatttacggggacatggtgtagcacaatcccgtccgtgcttctttgttgatgtatgctctcactgtaatatcactaaatttaattaaggtattttgggtgttatttgtgtaattaaacggatttacgaaagtaaaggctgtttggtctttatcggaggtacgggtgtagttagtaattgttagacgcacccccgggttcatgttcaaaagaagcagaatacgttttctgccatttgctcttttcttcttttctggtttctcctcaatctcaagctctcttcttgttatttccacttgattagtgaccgaaatcacaaagcaagcaagaaagaaagccatttttccttgttctttgttgcttttgagctttggtgttggtgatttgacgagaagagtgggttttgaatctacccattttcgttcggcgccgctgaaccgcgattggaagccatagagtgctggtctaccatccattttggtctattgaactctaaggtttgaaatttcctcctatttctccttgattcttgaggttagggttagggtttggagtgagattgatgaatgttgagttttaggagggtgggacagttttgaagtatgtttttgagtgggtagaagttgattttaagttgatatggtgttccatgcataaatcatgcatgcatgttcatgacagtcaagaacacctatttgggcagttctggtgttttgtccataacaggagttatcggtgtccaaatgatctaaaaccagtgccatttgaaagctaaaagagttaggtctattctggaattttcgtgctatttttggagactcctagaaattgtggtgcagagttattataggctgttatactctgtttttagcagatttttctgttgcagaggtccattttgcagaaatcttaaatctgtctaggatgatccaaatcgagtgctttcagtggcaataaaaagatgggtatgtgaacttcatgcctgtaaaatatcagctcatttggacgagtaacctggtgtgggctgttgttgaaagatggctgtttgaattagtgtgtttctgtcagaactattttagtgcgtgacagttctggtttttggtttgctgtagaggttgtggttcatgaattttgatgaaaccagttttgtttaaaatatgagaggtaaattttgatgcctctaaattctcgtgattttaggagcttcccacatggatttgtgatttttccaagtgggtgtaaaatctgcagaattttatgcagcagtttatgtttttccgtatgttttgctagaaatatatgctttgtacggataaaatgatgtttgatatgtgcttgtgtgcctttctatagggcgtgacaccgagggtgtcagtggcgtagcccacagtgttgggactgaattgcaaaacacgactttgccaggtaaattcttggtctcttggggatgtttcctacttgttgtgttccaccacactccgagggagtgatggttgcattcatgatgcattcgttgatggttattgcattctcataatgatatgtatgcttgtatctatgcttgtatgtgtatgaatacctgtgattagatcttctgcccagttagatggatatggacctctctaggagaatagcgcacctcctaatttggtttgctcatggttgatgatgatccctgggtgatgatgatcccttaaaaccaagagataggtggtcccgtcgtggttgaagcctattctcggaggtaccatatacgtgcgtccatgcgtaaggggtagctccagatgggatggcacgggtgtgagttccgatctcacactgaggttagtgttgatgatgatccaccgtacatagagtaagatgacttgcttgtattgttatgagggccgggaggccagtatgtttgtgatgccttgatgacgcgtgtcatgaaagtgagccagggtggaggaaatgccttcaaggaacctgagcttactgagatgtatatctcaccccgtgtggggtttatgttgtttcaagtgactcttatggtagagaggaacggtctcagggcgggaggccccagtagagacatttcttgcatggatgtgggctgcaggatgagagccgagtggctcgttttggcttgatgcttgttttgtacctttatagagggaagatgtgtgtgtgtgcacacatgtattcttttgttttgtacatactatgtataccctcgtgtgaggaaagatctttgagatcaaggcgatgtatgcctattcttttgtatggacactgtgagtatcaaatgatgtttatgtacataactagtttatgttatgtaatgatgttcctcctatttatatatgttgagatatttatgattatctgcctatggttatgttcttgtgattctggatcagcaagagctagtgaggctgtgatgtttaaattttatgagtttcatacataatgtaatcaagaaatatggtttcgtatatgcttccgcaagttttaattaaagtttaatgcgtcattctgatataataaatgttaatacactgggtgctcacggggtgttacactcacgtttcacatgactgatttaattttgggttaatctccattaggttttacatttttattctccttttaggtagatttttaactccaaatatttaatttaatgcaactgcatgttcataacttaaattaaaaactatttgattgaaaataactttacaccaacagtggttaattgtatataatgtcgaaacttagttaatcattattagattataaagccttatttaaaattttaaataaattataaaacttataaaaataaaggttaataatgagttttaatgcttacaaataatatggtctcgactaacaaaagttaatttaattggtaaagatagaattcatatcccacaaaaacacaagttcaaattctgaagatgatgtgagggttttattggtagataatcatatttgaatacctttgtaatcgtttggtgaaacttgagatatactacgatcttggtgagctcttcagattcaattcatctaactttataatagaaaaaaagaaagataatatgatgtcggtgaccatttattaatcttttaaaatttaaaaacttagaaacttgtctaaaccaacgacgacgttaacattagttttccttttgtaagaggggatgttaaacttgtctaaaccattttttttttcgggtgctacgctaaactggcttggattgcctacaatacaaggctacaatgcacattgcatatattagcttcctggtttgtggtcacaattgtcgaaactatcaacgccgctaaatccgggattgcatgtgaatgtgtgtgaacccccacccatagagtttgttttcaaaataataataaaatgcatattcagtattcagagcaagcaaggatttggatttggaaggtacattaaaatagatgtaagagaagcaagctgagtgtccttgtctttcgcgcgaccttttttctctgctaatggtaaaaataattgaatcatcgattaaaaagcaatgaagcaaagaaaagattgctgagcacatcatttgtgactggtggagtttttagaagaatgggtaaaggctgtacaaaatggaaagattttcatttttgcagacacatctttttcgtccactcagtggcaaaaatgatgcgtagctaggtctggtcactcacacagtcacaatccctctcagtgcaatgtcaatactctaatggcagctttgactaattgaaagctgtagagtcactgcaaggaatcccgaaacctcgaaaaggaaactgaaacgagaatagtttcacatgccctgaaactcatttggtgtgaaatgctttcttgatgtgtgctagatcaattttagaaagttcataaacagcttatgttaaaatgtgtgtttgaatgtatgggaattttcaacaataacctatgtactaaaagtgatggtgttacacaaaagcatcaaagcaagaaaaaaatgcaattgttgttatcattatttcattaatttttcaaattgattcttattgtgtaaatctttttaacaaagttttacacttccatatatttttaaatgaatccccacacgccactaaataataatatactttagatttcaacagtttaatacggaattaaggcattttggtctcaattatttttgcagcagaaaaaatgtcgacaccattttcctaattgtgattacaaataattatgtatatcttaggcatataattccgttttggattaagaagttaaatgaaatgagttttgatttaactgtagattttttatttattttctaactaattatctttcattattggatcatcttattttgagataaagtgatatctttaactataattttatatttaagttatagattaaactttgaaccttaattaaaaaatttaaatatgaaaccatttgatccaataactttttttttaaggagtaacaggtacctttcaaatgaacttaacaagagtattaactatgggaccacttctgcagaagttctatttgaaagaaaataggcaataaatacccgtacttaatcattcaatttcattgtcctctgtacaatatacaaacttgaggggtcagtaacagtaattcatactttacatgcaaaaaatccaaagtcctccatttgattgattcgttagtttaaaagactagtgattccattatgcaatgttctacgttgtacaatataagaaaaaaagatattataattttatatatgtaaaaaattatttttaaatttaaatttataatcaataaatcattaaaatataactttatcattatattcatcctcaaataattcctgagtttacaccacatttttctatagcattaacaaagacaaagcacacaaattacttgcactagccgccataatcaggtgtaagtaaagtaatcaaagtcaatcacagtcaaatagataaatcactaaactgaaaactgagacaaaaattagttagcataataaatgccagtttgaactatccctcttgtctgtgatatttttaagcacacagaaaggacaaggccatttgttatccacgcagtttctaataaccaggctcaaagtctcaagccctcaaactacttatagaacactgtccaagggggccccttgatactgatgtggattctcccaatttgcttaaccctctcgagtcgttcctttcactttttctgctacagtctgcattctgcactgcactctttctctctctctacttgcttgctattgctgccaacacatcttccaatttatgtacctctcttttcctcattcttcaggctatacgccatgagaagaaaagcactactctacactggaaaataatagagtaaaaagccttcttccttttgagttttgatcttttctctctctctctgtctctctttctctctcttggttgggttcttcttcacatcacaacctgataaagtttcttcagaggattggcattcggatctcagttaactcgcattaaattttaccacccaagctagttttctcttttagatggggaatgacttcaaggggtggtgacatgatcatatgcattcatggcttcacttaattcatatcattactacacaatcgcctccttgctcattatacttcttctccataatttgctctctctatctctagtttctgcctccaatcaccctcagtctgcaatttctccaagggtaagctttagtctaagccatgtttgtttatattataactgcttcaagtgtgtatgtgtatgtgtacatggtctaataatggagggtatgtacaaaattaatgtggtttgtttgttatgtgcaggaactgttatttgaggagaaaaacaggctaggttcaattcctcccagctgtcacaacaagtgcaatgattgccatccatgcatggcagttcaagtgccaactttgccaagccatgactctaatcctccagatcttaccaaaactgctgcgatggcaagttttcttaacccttcttctccccaaggcaacaggtactccaattacaagccattggggtggaaatgccattgtggtgaccacttcttcaacccctagaaatttgtaaaatgaccctcttattttttgttggttaaattttaatatttgtggcttagtggtcagctagggtaacagatttgcgtacgtcagcatggatcctatacattagagcttgatacacttgtacagagtttgttacagacctcatgaatttcaactttattctgttgcatcttaattttgagaaagttacctgttcctgcttttgtgtctgttaggatcatattatttgagttattcttcattttgatgctcaatggtccttcacggttttatccttaaaagatgttttttaagcacaaaatggtccttcacggttttattcttagaaggtgtcttttaagcacaaaatcatgacagaccattaagcaccaaaccagataatatacctcggatgagatgcacgaggattagaggtcggagcaatgtcaaacaagaacagatagcaagaggggttgtgttatgtcttgtccattgcaaatgtcttttcttttccctgatttctttttggtttttggaacctattatagtgcgaatctgtctcataagtcataaccttttcgcctaacttggaattttcattgcctgcgagatggtacatgttcacaccgttgtttttatgtgtctcgtggtcctatgagtgatcccgccccccaccttgtctgtttactcattcttaagtgttattagagcaaaagatttctctgtattgaattttttttttttaaatattgtcaaactatttttaaatataaattaatttttttgttaattatgttagtgatataaaatatttatctattttattgatgattaatcttttttagaaaatttaagtgatcatatttagtggtcaacttttcttctcttaatcacattttttttaatttgattttaaatattttatttaaaaagactaaatttaactatccacaccaacgatttattgatatataaattaatttatctaagttcattcttaattagaagtaactttacaattagtgaactaacaaaaaaattaaccaaatatgaatactttatttataaaataaaatatattgaactcattttaatattatatatgtttaaattataggttttttggagttaccatcttatttatacaaaataatacaaaatattcacatcttctgtggatgatcaatctttgtctctcctttcaatttctttttcatttgcaaatttcgaattagaaatcttgcctaacagcagttgcggatcttcacttggcggaggagtcatgggccccaaagttttttcttattatatgtatttactgttttaacacatgattccctctttgtaattaaaagattaaataattatttttgttattgaatatgtaaaatattgataaattcgcttctaagaaaatttaaattttagtctttaaaaatttaaaaatatgacaaatttatctatttgttaacttttgtatgatattgttaatgaaagagtttaagattaagtttgttagtatcttatatatttaggattaaaaatgattatttatccaaaatataatttttttatttttttcttaatctttacaaacataatactacaataaatacttaaaaaaatagaaaaataagtataagttaaaacaaatataataataagcataatatttattaataagcataatttgtctattattttgaagtttttgaagcgacgggtacattatttcaaatatgagactcaaataaaaatgcataatcattaagttaatttttacaaaaaatgagatctaatttgattttgtcattatctaatcttgtcataataacaatttcagagcaacaaatagattatatttattatttatttgttctaatttatgtgtgattttctatttttttaagtgtttattgtaatattatttttttaatgattaaaaaagggaggaagatgaatattaaataatattttggataaaaagtcatttttgtccctgattatatgtagagcattgacaaattcgtttttgaatgtatcacgtatactatttcatttcattaaccataacgaacggaaattaatagttaaataaagttgttacactttttctattttgagactaaaatttgaatatacacatttcaggaatgaatttataggtgttttacacaacaaaaacaaaaatgactattcattctaattaaaattatatatgaatgttatatataagattaaggcgctgatataaattagttcaagacaacatcatgatatattaaatatactagtgaaaaatatgaagtaattgcaaaagtgacactactagtacagaattttactgagaaggtacggaagttttcaaagtttcatagattcaagtttcaatcactatgaagaaacgagaatgggtgtggatgctatgttactgtaaagaaatgagaggagaatgcttcttgaattgttaggctacagttattaccttgaaaaagaaactgaaagaaaagagtgcagctgttgcacttaaaaaataagcaaaaatgtggtctttgtaattattgaaaaatttagtattgaaaaatttagtaggaagtaaatgaaaatacattaggttaataatttaaaaatatattatgctagttatattataaaggttaattttattctctttatttccttctttctcctttcattctttttttcttttagtttattttttttgtcttatttttcctttttctttccttctcaattaatctttttctgttatttataatctattattaggttcatctatcactaatctcaattaacttgatttaaagatgctattaatgttaatgttaatgttgattatgcttactatagagtttaattattatttattatcaaaatacaatatattttgtttagttttataaatttatgtttgaatttgcttgaatatattgttttacttaattcttaaaaaaaatattgttttacaaagtgtaattttggattttgagtagttaaacatcatttaattatgttggtcccttaaaataattcgttaagagagtcaacgaaagttagattcagcaaaaagattagtcattcataatatagtgaactaagatttgatgaaaaagatatatgaagaagtcttaccaggaaggaaatttggaagtcatattgattttgggttgataatctgaattagttcgaattttcaattgtttctcaataaatcaatgataaagtggtcaactgttaactgattaatcgtaggttcaaatcctatttagagatttgattgattcgaaaatattaaattcaggcttgaatagaaatgactttgaagggatatccgtagaaaaaaaagaaaaagagagggacaaggtagagaattaaaaatccgtttctgtacacatgatcagccactacaaattatgagtattactattgagtaacgggtacgatgggtccaaggtgtattttttattactcagtagttatttttcaagcaatttggttttcagaggctaattaattgaatgaaaatatcatgtctcatccaagtccaattcgctgtagtagaggacactttacatgatacaatttatatcaaatttctcatatcatattatcaagtttttaaattaaatgataaaaaacgtgttttataataaaaaaatgttaattaaaaacgttttattaaattgaaaaatttatttttaagttaaaaaattaaccgacaatgatataaatgttacccatacaaagaaaagttttatcatgtgagtttttaagctaccaacctaccaacctattaatagtcgggactgaatccaccgacactttgggtatctattaatattgtggcatttaatgtaccaatccatttcaacttggttgtgagagaaaaaaatagaaagaataaaagtgatagataaaaaaatagatgttgtttggttatttggttaaataaaaatagagtaaaaaaattaatagattcatttttatctattattattatttattttatttttattattcatattatattagactaaaatataattttcgttccttattttttaaaattcataattttaaatttttcaattttttaattgagacatatttttcatttttttaattgagacattttttctttatatttaaaaaatttacaattttaatttctaggatcaaatttaaattttgattgtgtactttttaaattattttttaataaattaagcaattcaataatgaaataatttaaaaaaaaaacatttgtcaagtgactaataaacagacatgtattaatcaacattaatagaatacatatatcaatatttgaaattgtttataaggattaaaataataaattttaaattaaaaaataattgataaaatatttcaattaaaaaatgtgagaactaaaattgtaaatttaaaaaaataggaagatacaaattatatattttccttatatttattgttagttataattattttaaaaaatattattgttgttgttattatacaataattaaatgggcataacctattatgctttttacataatcggttaactaatgtggaggcatgggaaaggcatgtatgtaggcttgcagcaaggagagaaggagagagaaggattttagtatttctgctgctttcttcccatgtgagaaggggaattttgcattgtgggacttaattagccattaatacttaaggaaattataaaaaacacgtttattcataaaatttaaagactaaattatatgatatgaaaattcaagaactaaagataagattcaaaggaagtatagaaattatatatatatatatatgtatatattataccaaacagatcattaatgtttttttttatcaaatgcctctctttgaatgaaataactctgtcagggggtgcttcttgcccagaaaattcagaaagaaaaaaaaaaactcatagaagtaactcataataaagttaattattttaatagatattttatatattaaatttattacatattttgatattaactcaatgttcacacactaaattttaggcaaaccaaatatttgtaccaagtcttcacagggcagctaacggtacagacgcaaccaatggctattaagtaacaaaagaagccagcgttagattggaaccacctcagccaaatacacaggccaatatgcatgcttctgtccaggctgggcaaggtacacaattcgagtgcattttacgaagaaattctagcagctgcaataatgctatacagtttctgctacgaaactaaggagggtggagccatgtgttgggagttgcatcagaattgtcttttgaaagggtcagtcttgagactgattacaaatctctgtatgatcccagacgaaggagctactttcggttcaagattgtcaaatggttttaaaatgtttattggtagttccacgccagttaaataattttaacacaaaatttactctactggactagaaagtcccacatcgatgttgtaattgtcctctataaaggtttagaaacaatttctttctagtttctaggacggtttcctgtgttttaggccaactgggatatctgcaagttagtatctattttaggcattctgaattttgattaaactgaaatttagcagacatgttctttttgggggtacttgaactatgtttgcagcttggtcccaaaattattacaaatgtggagttggtgcaagtcactactcaagttggtgcttagaaacactcatatgtcacgtccgctatatttccgtaacgcaatttagatacagctttctattagaaaaaacgcaaccttcggttaacattttccttacggaaattcttggcagaaccacaactaataccaaaatgaaaatacaatttactatgcttattgacattccctcagatagtctataccaagttgtaaaaaatgcaatactcttcaaaatactagaaactggtttgatggggtgtgccatgcctgtgcagtattgcaacgcttgggcgacaaatgagagccccaataccaagctactgtagcagaccctcccctcaaaaaataaatttattatcgtgtgaacttatgaccacatatcatatattaaactgataagaacagatactacacttgatcttagccaaaaggccgagaaaggtatgctttgtacaatggaataatgcattttttatagtttagtcttcagcgcttgttatttctcttgagcgatgtggtattttgttacactgtcagtcttcttgtttttgtagtccttataggacagtatttgtttggtcgaccagcaaccatccaagtctaacaaatactacggataatggatgccatcaaccacaattaatgaagttgagatagcttggttcaagcttgttgcttaatgcataatactggtcattttgatagatgagtttgaatgaaaagggacaacatcatcacaacatattgagtcttgagactgtgcatagtagacaggaacaaagccacttcggcaaagaccagaaatttatctctcaattgtgacagggtctgtaaaataaattatagttgctttgaatcttcaaagttttctagagaaaaatctttggaccgtctgaatccagatttactaactaataaatggaacctcatgtacgactacattttgaaagaattgtgctggacaataatattctctaaaaatccattaacttcattgagcatgcagctataatactcatacttatagtgctatcttgttggatgtttgtcaatttttatcgaattggggtgttggtattcattttatcttttggaaagcgaattataatgctgagctggaatttggaaggtgctgagctgagtcatgtttgcaaaaattttgaacattgcaaaataaaatcacagaataagataaacattcaaggatagagaatctcttctttttttttttttttttgctgtttgttagaaggattacgttatactataaaataataagagatgcttcagtgtatgaatgaatcaatcagttcacttatttaatctcatacactgaggatcaaaatgtagagggccagggaagagaaggaaaccgccgagagaagtatcttgtcattcttcatttgaggatagataaatttgtgaaattgacaagatggtagttagggcacaaggaactctattccatcttgtatctgagccaatcaagttactgtatgctcagaaacttctggtaacaccacgccaaacatcaaaacaaggtgctcattcttcactggtttccaaatattcaatgtttagacatgaatttcatgaatgtttttttccttaaaattcaaaagatttcttcgttcacaccccagcacctatgagtacgggtaattttggcatgagtcttagtgaaaagggatagcatcacaacatattaagacttgggtttaaattgagttacactagttcttttaacctcaaatttggaagttaaacttggtctggtgatacaaaattgtaggagaaaatcatggtttaaaagcccactccaactggtatttttgccacttagttccttgggatctctattaggccacaattagcaactagcttacccaatttaagcatttgagcattctgagtttaattaaactgaatttttgttgtctttttggggtacttgaactgtgtttgcacttagcaggttggtcccaaaaatatgacaaacgtgaagttggtgcaagctagttctcgagatgaggatgcttgggctatccttttaagactaaggtttcaatagaagaaccatttttttgcccaagcaaatcagagtatgaactattgaacttagttccatatatttactaacataatctatgactcatcaacggagctttatgctagtatagaaatggtcatatgctctgtatatttacagattatgacttacctgagaactcattaggagagaaaactttaacaagcaaaactaggtgagatcacataaagattcaataatcatggtttactttgaaactttgctccaccaaactatggttgagaccccagaaattatatcacttctaccttttaaggaacgaaataatctatattatcattttgcatatcatcctcacatttatggggtcgtcgacacacctggtaaaagttttagtgaggattatttgcctgttttgattcaacttggattcatttacttggtgcctcttcatgttctagggctctgctctgcgtctgcggttgtaactatggattcggcttcaaagctgcgctcagaagagaataacattagtctcaaggatatgtttaaaagatccattgacatatcaataatgaaaggcacatttataacttctttgtatatgctcttttggttatcttgtctcttgattgcattcccatggacagtaaataactgttatattttcttcaggggttttggtttctacatattatttgcggtaatttgctatgtagcacttgcaaagctattgatggtatatttggaatggagtgctatctggaatatgagttttgtgatatcagttgtggatggtatatatcgtattggggctttgcgagtttcgtattacctcagcagtggtaatcagaagagaggactacttttgatgcttgttttctttgctttgggactttgtttaaggttgtcatgtgtctcccttggatgctataaaggagggtacgggatatttgttcaaattgggctcctcactgtgttaaatacactgaaatgggtgtcgtgcatgatttacttttctgattgcaaggagaggaaaatggagaagaaagttgatgaggaatcaggaaaagatcttgcaaaatgattcatggaagaatggaacttggagatattttgctggaaaatactgatgaatttgtttttatgtagagttagtgatgataatttgaataatgtacaagatgtgtaaaatgggaaatctttatacttccatgtgccataaacaatgtacgactatttatctgaattattgatcaggaaaatattgagaacaattactttcgtcaaataaaaacatgaaaattctatttctatttttgagtagagatgaaggaactggtggcctagttaagcaataaaaacagaatgagctaggaatgtttggctagaaaatttgtttggagactggtaaagaatggggcactttgttttgatattaagcatcgtgttaccatatgtttctgagcgtagagtagcttaattggctcagatacaagaaagtgtggaattccacgtgctgccataactaccatcttgttaatattacaatttatttctcttctcaactaaagaatggcaaaattcttcttttggaatgaggttttttgcatcacttacaagttacaactcattttgctggcaaaagatctacagagtaatgtcataaaagtttgactctttccatggttcattgggaatcactcggtacacaagacatcccatcctgccttctcacatgctccagacctcatgaaaattttgtcaattgttttagaatcaatcactctagcaaaaagattgcaaatagttataaacaaaactcgaaacttaacctcaactgatttacttcttattaatatgtgtagtgagattaacagaagcaatcaattatataacagaatggttccagtttacaaccaaaacttttacttcctcccttctacttactcatatgttggcactagtaaatgggaaacaggactaacctttaatgtgacccatacaaattttatttaatagaagaaattttttgagaaagtggctgttagatatataggctatccttttgatgcataagtaagaaaggagattggaagatatgactttatatagaatatctaaatctcttattactataccgatcttagtcggtttaaacaattgaacaataatacaaatatgcattatatttataaaaaaaacaagttttgctaaaaaaaagtaaaatatatttctcagttttttatgattttatttataaacttaacgtatacatttttaaattttgttttaatatgtacataatttcagatcatctctgatttaactcaaatttaaaacattaatccaccctttccactgttttttttctttaaaaaaaacaaaattagctgtgtatgaaagagtgattagtggcagagaaatggcaacaaaaattggtaaaagaaaagagattagaaggtgtgaagaaataggtaggagaatgagaatgcacagccacacaaaccagaatagaaagagtgatgactcactaaagtgatggatgtggtgaagaacggctagcggtgtgggacttcacatggcttcttctacactcgccctcactctcagcctctccgccaccacctcctactcctatcttcccaacaccaaacaccggttttcatgtcccagaataaagttattctccttcaagcaccgctccttctccgtctcagcttctgcttccacttcaaattcgcttcaggctctcatattcgactgcgacggcgtgatcctcgagtctgagcacctgcatcgccaagcctacaacgatgccttcgttcacttcaacgttcgctgcccctcttcttcttctccgggcccactcaactgggacgttcaattctacgacgaactccagaacctcattggtggaggcaaacccaaaatgcgatggttctctgttttgttcttttgtttatctttatgttctgctgttggagtttacttacttatcgtgtgattgtgttcgtttaaggtactttaaggaacacgggtggcctacgtccacgttgttcgagacgcctcccattaatgatgaggatcgggccaagttgattaacactcttcaggtatttatgtctttcttacctttttcctttgtctgtctttagcactcagagtaagttagtgtatatatattgcattagcttccgtacatttttttaatccataaatgttaattgttagtttttattagttgggatttgaacgcatgatctcttccgcccccttctccctttaccactaagccaatcttagaacccacattgcttcattacgtggttattagtttaggtgcttcgtaattcagttattaagtttctcataatatgaatgtcactcagtcttctgaacttggctctagcccttgttactttttagaatttaattagaatggattaacaatatagaagctttttagactgacatccaatcataagcttttgaacatggaattttaccccatcctagtgtggaaaaatggagttaacgagttcgttgccattatttctttttttcttttctttttggctattccatttgcatatagaagattcccaaagtatgagaactagagatgtttatttccttccttcgttaatgaaaaagagaactagcaaaaccatgctcatgagaattgcttcttattccttttcaactattttgagagggcaaatcaaatttatgcatgcatgaatgtcatattttgatgtttaaccattgaagaccctttcaattgtcatttcatttggaatatgatgtcattgcattttcctggtattgatcatgtaggattggaagactgagagatacaaagaaataatcaagtcaggaactgtgagtggactcctatactgtgaaattggtatctgaattgttggtatgctactgttaaatactcatacattttggcacaggtaaaacccagacctggagttctgagattgatggatgaggccagagatgcagtaagataatgatatatatgttctagcactgcactgatctctagtttcagtttcattacctaatgtattacttgctttgcttctgatgggatgtcttcaatctgagctgtttcggttattgttataactcatattttatgttagttagggattatcttttaagtttgtcattttttgccaaattgttgttgcaggggaaaaagctagctgtttgctccgcagcgactaaaagttcagttattctctgtcttgaaaaccttataggaattgtaagcccattgtcactattgggagtagaaattatttattaatttgcactcaacccagttattttctctgttgtaggagcgctttcaaggccttgattgcttccttgctggtatatatccttttattggtcatataacattcgagacatatgtttcctgctcaagtattgtgaaacaaaacttacaccatgctgcagcgccctctgaagcatcaaaactcaaaattaattttcatctatgtttattttttcatcctataagaaaattggataacacattctcataacattagttctattatacatgtgtagaaaaggttttccacttttcctagttgttaacatccaccactcagcttgcaaattttattgatatttttatgtggcagtactttgggtatttgagtttaaatctgtctgtccatttatttttgttttttatcgataaatgttagttgttagttttgttagtgggagggatttgaacccacaacctcccccctcccttctcgcttcaaccaccaagtcaatcttataactcctcatctgttcatttacttaaacttccaggtgatgatgtgaaggaaaagaagcctgacccatcaatatacgtgacagcttccaaggttttattatgacaatatgatcaaaaactttgaaacatgaagttttaaatttattttatgcactaaccgagtgagcataatttacatgagcattgcagaagctaggtatatcagagaaagactgcttggttgtagaggatagtgttattggattgcaggtagattttctcgtgttttcaattttctatattttgagatataaccaatctaattatatggtatatgctgtttaagaagagaagaaaacggactagatgagcttgggttagaaagtctaagggcaaggagttgtctttgtgtattattagacataacaatatcaatagatgagcctagacatatggaatttcaattacagaatcttcattttgttccttaattcaccaaattgcatttaatcttgttatttaactaacaaaaatgctgaaactatcatctgatctaaattaacctctataggcagcaacacaagcagggatgtcatgcgtggttacctacacaccttccacagcagaacaggtgaggcagttaagttaactttcaaacaaattcaacaagaatctgcagattaatttgatattgaacatggaggggaattactatccacttaaactggctgcacgatgatgtacctgtattatattttggatctaatgtaggatttcaaagaagccatagcaatctaccctgacttgagtaacgtaaggtataaggcatagctaacaactgaaggtattagattttcttcatttagactcagctactaaaattttgtgaaccatcatgcagattgaaagatttggaattactacttcaagatgtagtagctgctaaatagaagatttccttgtgccttggaaatgttgctattttagctgccctgcagtggtttctatcaggaaaatggattgaaatatttgatgtttacgacaaggttaagatctctctttaaaaaaaaaaacattttttccatatattaattgacagcggatgatgtatacgtgcaaatcaaaatgtgacaacaattctttgcaagatatattaaagaccataatctattgtttgtgtttttctcattaaattgtaatgcttgccagatatttcctttgacaattcatcatgttcaatgcaagaaaattgtgatattttagttaggataagtttgctttcgccataaaaataagaaaggaaggaaaaatcagcaaagaacttaatatgaatgttcaccctcaaatttaatgggttccgaatgtaagtgtctttcggactctcaagtctcaatcgtctaataacaaaacacaagaatgacatcaacggttcttctgattctattcatgtctccttttgtgatatacgttcgtatttttttaggtagttagggattaatttgtcatcgttaatggaaggactgatatgctgaatgctagtagcattgcaatggaaaggttgtttgaagtttgaggagtctacatgtttgcaaaggaaaaaaaaaagttattttattcagaatatgtatttaaaacagtcgtaatagtttattatatttccttgttttctaaataataaatcaattctcccaaaattttaaacatataaacagtttgaaaaaagtgagatgagagaggctcgagaactaacctcaagataactcagtagctatgaaacctaagctagccaactgtaccaccacccctttttatagaagtgagcttaattatagttaacctttagtaattttcacaattaaccgtataagtgccacatatcaaaattatactatgatatataatatatatatatatatatattttttttttttaaagtgtcatgtaattttgtttatcggacaattgcaattgtgcacagtttcatttttttagtattttcaacacagagacagttgtatttcattttgatgcattctttaaaaaaaaatatcgatcactaaaatagattagactcttatggcatccttatttaagattgtatttttgttcttttcatttttcttctctttgtgtaaaaaaaaaaaaaaactcttcattataattgtcagttttaaatttttgaaaattataaaaaaaaatcattttttttcaatttttagcttcaatttttgtggttttaaaattgatgatagaggtaatgatggaagcaaaacaaaagaggaggagaacttaataacactaatgatagatttgtgacaataatatgataatatgacatgataactgtaatggtaacaataatcataatattaacagataatgatggtgattagaatgatgatggttattgtgtagtgctaatgacggtggtaattatgactagaatgattgtgacttattaaagattattgatgataattgtctttaatcacaacactagaacttcttcatctaaaatctagatagttaattattaggtttttataatttaaaattctaaatagggtaagaaaataaacatcacatagtaatcaaagaataatgcaaacttttctaaattttgtttcttacaaacatatttttacttttgaatttaatggtcatgtaataataatctaaatgtcattcaatcacaattctcatcttattcatgataagtttattaatttttataataaatactttataaaaaatattaacaataattttttttattaaatgaaagttttactttcaatatataagaccattagattctttatttgataggggaaaaaactaaacattttagttttaggataagagaaaataacaaggagaaaacagttatagttggaaggacttctaatatgtgcgctgaagtatttaccccaacaaaatagtattatttactgtaattttcatttttaaacatactctcccaatgaacaacacaacatctaggctaattactaactaaacacattagtaataagatgaggtggtggcgcagttggctagcgcgtaggtctcacagcttttgagttatacagggaataatgaccaaagtgccacatttaaaaaaaaaatttcagaatgccgtggatgttataaaatttgccaatatgtcacaccacctaattccttagtcacataaacgaagtctacggttgacgtggcgttcaattattggaagatttatttcgctacatagagtagcgaattatgtatgacacgtgacaaaaaattcaaaattgcgtataaacttcgaacgaccataacttttgactgtaacgttcgattgagatgaaatcgatggtcaaacacttgaaatttataggagaagccctgggcaaatttcgagtgtttggccaccaatttcgagcatttgaccaccgattttgcctcaatcggacgttcaagtcaaaagttataaccgttcgaaatttatacgcaattttgaattttttaccacgtgtcatatataattcgttactctgtgtagcgaaatttgttcttccaataattcaacgccacatcagctcatgaacttcgcttatgtggccagcgaattaggtgacatgacattttaataaattttatgacattcatggcattttgagatttcttttttaaatgtagcactttggccactatttccaacttccacacatgcatccctgcaattatagcaatgaaggattacgtgtgtcggggtgtacaactaaaactttcaccataaaaattatattaaacactgaaatttcatcaaaacaaattggtaattattattttaatatttattttttttctacaaaataacaataataattttcaataacctattttttttctaaaaccatactttttcctacaaagtagcaaaatcacaacattaaatttgtactaaatttaatttttgtacaactatattttttctacaaacttaaaaagtgccaacattaattttgtattctttttttctaaaactatttcccccctaacaaactaacatgacaacaatatttttctataacatattttttctaaagctatatttatttttctacaaagtagaaacatcacaacattaaatttaatttttatacaactatattttttctacaaagtaaaaaattgccaacaataattttctattaattttttttctacaaactaaaaaaatgccaacaataattttctattgaatttgtacatattttttctacaactatattttttttgcaaagtagaaaaatcacaacattaaatttgtattaaatttaatttttatacaactatattttattttctacaaataaaaaaacgccaacaataatttttctacaaagtaacaaaatggaaacaaatattttctattatattttaaaatacaaactaagaaaatgtcaatatatattttctattatcttcttttttttcattttttttgcaaactcaaaatatgtaaaaaaatatcttctactatcattttctaaaaacaattaaaaactgcatcatactaaaacatggaaacaaatatttcctacatcattttttattctgcaaactaaaaaataacaaaatatttcctattatgttctcctactgacatacgaactaaaaaattaataacacaaaataacacaaacaaatgaagaagacttaaaaaaatagtaaaataaataaaaccaaatcatctttatacaaaataaataagaggacttacctgaccaccaaaacttatgttcaaaacattattcctaaagcatcttttacgctatatatcatcactcctttaaagattcaaattctactctgcattcccttcctatgtgaaatacagtacattatccttccttaacaattgaaaatatattacattttattatacacacatacatatatatatatacacacaattttaattattattattatttaaaaataactcatcaaatttattttattaatttaaatattttattcaattgcatatattttattattataataacaatttaactcctaattctacctttaattattatgctagaaaatattatatttttcataaacttcattatatatttaaaaataaattttaaaattttattttcataaaatgtattctaaaataataaaattacaaataatatatatgcatatatatacatgtattagtaaaataaaattaaataaaagtaataagatagctttcaattgagtttattaatatagtattttttataaatatttaaatacatcggtagcgtcctatatagtataaattagtatatttattgagtataatatataattaatttaataatattactatatattatttttgttacatataatatatttattgaatttaataaatataatattaatatatgtatattaaaatataaattttaaaaataaatttatttgtattaaaaatatattatgaaataaaatataattatcataatatttagttatgaattatatatatatatatatatattactctattttaaaataattagaaaccatttctaaaactgattttggattaaaaatactttttaataccgattttaggccaaattcaacgttatcctcacataatccgtgaaaggcaattaccaatgttatcctcgtagtttttaaatagacagttaatccgggcttgggcccaggcccatatgtccgaggaaaaaagcaaaaaaacgtgggtgatgtctttatataagcatcacacagagtcgtattcgatcaacagttagtttctcggttctaaaacgatttcaggtttcgtcaatgggttctgtataattcgatgaaactcgaatcgttgaatacagggagagaggtaatagaaaccagtgttatcttcttgatttgaaatcgatgaatgtagagttcaatttggcataacttgcgatatgaagcagtctcaattgtcggaatttgatttcttgtgatctttcagggccctcatcactgcaatgtctctctctaggttttcaaatttttaatgcgtttctttctcttttcttgttaaattctttttattatttgacgaaaccggtgtctttcgtcgtgcaaacgcattctgtctcaaagctatgattagtgttttgagggaaagccttcgtttgctacagaattagggtttataagccctataaaggtgaccatgttgcagatttttacctattgggttatacatttttggggtttctttaaaccgcgatttttggattttggaatttctgttgaagatttttacctatttggttatacaccgcgattttttttggattttggaatttttgttgcagttttttttacctatttggggagacatttagctcatttggaaacatatcttggcggcattaaatatatgacggggttacctgatattgtaataatcgtcgatcaacaagaagaatatacggctcttcgctattggggtttctttaaaccgcgatttttggattttggaatttctgttgcagatttttacctattgggtcatacatttttttgtttattcaagaaagcccaatcttgttgcccatgtccctgaaaatggaaaagttcagttgctgctatgagatgaattctttattcatcatttgcaaatttgggtatttaaaccctataagattgaccctgaccctgtaatcggaaaattgtggttgcctctatgagatgaattctctattcatcatctacaaaattttggtatataagattgatcttgatcctgtaatcggaaagtgtggttgtctctatgagatgaattctctattcatcatctgcataatttcggtatataagattgatcctgactctgtaatcggaaagtgcggttgcctatatgagatgaattctttattcatcatttgcaaaatttgggtttttaaactctataaaaatgaccctgaccctgtaatcggaaaattatggttgcgtctatgagatattctctattcatcatttgcaaaattttggtatataagattgatcctgaccttgtaatcggaaagtgtggttgcctctatgagatgaattctctattcatcatctgcaaaattttggtatataagattgatcctgaccctgtaatcggaaaagtgtggttgcctatatgagatgaattctttattcatcatttgcaaaatttgggtttttaaactctataagaatgaccctgaccctgtatttggaaaattatagttgcctctatgagatattctctattcgtcatctgcaaaatttaatcggaaagtgtggttgcctctatcagatgaattctctattcatcatctgcaaaattttggtatataagattgatcctgaccctgtaattggaaaagtgtggttgcctctatgagatgaaatctttattcatggtttgcataatttcggtatgtaagaatgatcctgaccctgtaatcggaaagtttggttgtctctatgaaatgaattctttattcatcatctgccaacttttggtatctaaaaatgaccctctgactttgaaatcagaaagtgtggtagcatctatgagatgattatttattcattgtctgcaaaattttgatatctaagaatgaccctctgactctgaaatcggaaagtgcggtagcctctatgagtgtggtaccctctatgagaagaattccttaatggaaaagtgtggtagcctctgactcatgaccaatagggtatataaaccctataaggttgaccctgaccatgaaaacaaagaagtacgttttgcccctatgtggtggattctttacccatcatatgcaaaattagggtttataaaccctataagattgaccctgagaatgaaacgtgtggttgccactatgaggtgaattctttattcttcatctgaaaaattaaggtacctagaagattcaccctgaccctgaccctaaaaacaaaaaagtgtggttgcttctatgagatggattctataatgaagaccttgaccttgaaattggaaaagtgcagttttccctaggtgatggattctttattcatcatttaaagagatgttaatttttagccataatgaccctaataaatcaagttgtatgtttaaaatctttgttgaatgattttaaatcaagctgcacgtttaaatgtatatgaacctataaggatgaccctgactcgaattggaaaagtactgttgcttctatgagatggcttctttattcatttgaaaattcatggtatacaacaaccctataaggatgaccccggccattaaaacggaaaagtgcagctgtccctatgagaaggattctctattcttcatttaaagagatgttaatcttgagctttaatgaccctacaacaagttgaatgtatctttggtccaagattttaaatctggacggaatgattttgtaaccctaatgaaagctacaatagtattcatgatggaaaacctggatgctggatggtaggccatgaacaaattttaaatatgaattaaaaatcattttgtaaaaattcagtaggcgtggtgcaccgtagatgggattattgaagtgcagcctggaatttgtaatcatggtgtaaaatttgggtttgattttttttattcatggtgtaaatgatggtatatgcgcagacttctgcatttttttaccacaagtattctgttaaccaaaattaaaatgttacaatggcaactgagaaataactaataagttgaactgcataatgaaaaccaagtcaaatcttgttatgctgttgccaaagtcactgcataatgaaataacaatgaattgtaaattacaccgttttgggtagaaatataaagttctcgagtgttttgtttggacatggttggttacaagtggttttaacagttttacctggtaccccaagtttgtgttaactgagaatttggtgcatcttcgtgaaagtattttcattgtatttgttatgatggactctcgaaataattattacttgaataactagaagtggcaaaggtacgagacatagtgcacatttgataaacttggttcattggaacttcaaaataaattgtatccaggacctttcacttttattatactggttcttggaagtgtatattcttcgagtttgatataaactccttccttgaaatgccagaactgtgggatatctgataacctggtttatgtgaaatgctagattatgttgcttcttctaataaaaaattgtcctcaaacttgtattcttcgtgtatgaatgttgcatgttcatgctgctgcttgctgctgtcctaattttgcacttcagtcgggcatttgaagttctggggtgctttagtagtactattatgatttgtccattaaaaaatgtctgtcataccaaattctaatggcactaccattttcaacaagccttcctttttctttatgcttttattaggaaatctattgatccaggcttttccaacatgaatacctattcctactcttttttttgcatttagaaaaattaagtttgggaagaaaactcccttacactccttagccaattgtggtttttatttagtctccatggttggatggttgcaattttatgttttttgcaatgcattctatgtttcaagtgatcctttctctagccatactttgtcctttaatcaaaggtactttcttggcaagttttaacactgcatgttaagaatttcttggcaaggtcttggtggaagggagaagccaaggatagatggaagtggtttgtataatgttcgatctgcttatatatatatatatatatatatatatatatatatatatatatatatatgagatctgtcagcgttgtgaatcttgaaggggggtggaagttcttgtggcataagctagtacctttaaatgtgattattcttatttggactgtggtgcaggatcgtattccagtaaaaataatctgtatcacagagggattttgagggttgaggaatgtttttgtgtggggtgtagggaagaggggaaaaccattgagcatttattctataactgctctttcttttctcaggtgtggtcgattgtttgtgctggctaagagttatatctataaatcataatcaggtatggatgcatttttttaattttgatggcttactcagcgtttgggaatcaggaaacatgaaggtcaagtaatttggttttctgtgatgtggggaatttggaagactagaaatgatgtcttggtgttggttgaaggctaggaagaaacgttatatttatcctctggttaactggttgtctgatccgttatcatgccttggatcaaacaaggtgtggttagtcgggcagagatttggctatgaagtctggtgtggtgttgatgtgaccaattgtgcagtagttttgaccaatttatttactactttgtatttggggtgatgggcaagggatccgggtggatatataggtattttgggaggtggcctctggaaaaaattcaaaggtgcataaattgtttgtgcgttaatgactcagaaaaaattgtttccttaagctggttgcagagaagttatatgctttttgttggattgggtgaaggaatgtttttttaatggtgaaataatggtcttccttaatgtggagcatcactgcagaatgtggagaccaggttatcagttcttggaagagaatattatgtggctttgaagtctttaggctttcccccctttgttgctttgttttgagtactattctcatttgcatttgcatcataaaactgtactattgtggaaatcatttattgcataccttgtgctttaaactggtattgaataatattctttatataatttagtcattaatggcaaatagtgaaacatggtggaaggccaaaatttcccatataaacacgccattgcgctgccatgtcaggcttcccttcataaatttcctgaggtggttggcaaaaaatctgccacgccattctgccatgcactgccatggccagtatttaacattgacattcacagcagcatcatgttgaacagtaaaaaagaccattcatctttaattgttgtgacatttaaacatgattttcttgtgatagtttcctttccttgcttcctggcttgttttattgttctctgtttaacttcaatatacttatttactttataagtagcactgccattgaatctttcatagtggctatatttaaaagccaactgcttctttcttatatggaaaatcttatcttcaaatttattatgtttactggaagttatttttcattcttaagggaggattttcgtaaagaatttcaagagcagaattcagatgtaaagtcaaggcgtgatgtatgtgtagaatccattctattagtatttcttctaatttattttatacttttaattgctcaagaagaaggattgttgcacaactaattatttacaaattataaatttcttatgagccaatacaaacttaagcatcaatttttaaaatttgcctgttgttttaagagttagtgagaagtttttatacttctcttttgtgaaactagcagctctattattatcatttgcaaagtaatataattttttgttttgttttattccgccctttgttcattcagattggtagtgcatctggaaagaagtggatatcaatgactaatgaggttagttttcttttgtagcctttccttttttattattgactttgaattgcgttattatgattgtgatgcctgaaaactgagtaaattaaatgtgaggaagaagaacatttttgttatatttgaagcagttggaattaattgtaactacttttttattaagaggctgagatactaataatggtaactgatatatttactgatatagaggtgctcatccatttatttcccattttcttcccttttttattttgttttttaaatttgaaatatcataaatactcaagtatataaaaaatatctgtaagtatttttcaaacagatatccaacgaatattaaacggataacaaatactaaatttctctaacagagacaagtaaaaaataactcctattcatgtctgatcctaccattaccatttgtatttccgcgtctttcaagttacttcctttcattttctctgtatctttcattctcccatttcctgtttcacatttcatttttttaatttttttttgtcgattaggagcaaaatttcttcatcttttgtaaaagggttattataatgtggggcaatcatgtcccatcgtgcattctcagatgcttcattgggaggtactttcggctcgttaatattaatgtattctgttaaggcaatgacaaactctttcctcgagactaaattaatatattgtattctttttgaattttcctagctcgtccctaatattcctcactgatttctacagcacgcccataaagcccgtttctttcatgttataaaagaataaaaattgttttatccttctattttttaaaatttatgattttagattacttattttttaattgaattattttgtcttttacatttgaaaattttgtgattttaatcttcttattttttaattaaaacatttcatttatcatttttaaaaaattcaaacttattaactgtatacttttttaataaactaaacatgttaatgattaaataatttaaaaaaatatttatcatgtgaacaacatttacataatataaatatcaacatttaaaattgataaaaaaaattaaattttttaaaaagggtgagaatattttaattaaaaaataagaaactaaaatcataaacctttttaaaataaaaaaggaaatgtctgaatttttaaaaaaaaaaactaaaaacacaaattaaaaaaaaatgaaaacatagattacatttgaacctttataaaaaggtatgaagtatgaagaaattgcaattgtgtgactctatctaactcaattgttgctttctcaaacatcccaagaatcacagcttggtgactaccatggctaatccatcatcctcgtcctcctcttcctttgccgatcaacgatggtcttatgatgttttcctcagttttcggggcgaagacacacgttttggttttacgggaaacctttaccatgctctatgccaaaagggagtcaacaccttcatggatgatcaagagctgaggatgggagaagaaatcacgccagctctaatgaaggcaattcaagaatccaggattgctatagtgattttttcagaaaaatatgcatcatcaacattttgtttacaagaacttgagaagatcatggagtgcttcaaacacggggggaggttggtttggcctgttttctataaagtggatccatgtgatgtgcgccatcagaaaggaagctatgcagaagcactagccaagcatgaaacaagaatcagtgacaaggacaagcttaaaaaatggaggttagttttgcaagaagctgcatgtctctctggttggcatttcaaacaagggtaagtagatcaccaatcatctcctttatatatatttttatcattataatattcttttaattattttcatcttaatttatattgtttttatccctaatattatgtgatactcatacgacacatgatacctctaatttttttttaaatttctaaaataaatattatttgtctactttaaaatgaatgttgggaatcaaaagtaataatttcatatattgaaggataaaaatcaaagagaaaagctatacttgatgatgctaaaatagtcattttacacataataatgttgaaactcactcattttattagaattaaaaagactaaatatcacctttaattttttattttttaattttttttatgcatttcaaaacttttatcttggtcttttcgaatggctttttttaattatttctttcattttttattatgatcgttagtgttctgtgaatgtgtaaacgctaagatctgaacaaagggaaagcgtcaagatttgaaccttctctgttcgcttctttctctatcaatcccacattccccttcatcttccgaacacctctgcctccaccctccaccggcaggggcggacgtgttgagtagggggaccttggccccagctgacttatttttttaagcattgtaaaattaatagaacttattttttaaaacattgtaaaattaatagaagtcataggttgctttctccttcagtatgacatgtcttgctcgtgtttaatcgtagacttgtgttagagtaaaattgttttccaaatttgttcttctctccttcatatggaggaccccttaaattcttctgagtatatatcacacaacgataaatcaaaaggctaattcatatattttataaacatattaattaatatattctactttatatattgctataaaattagataacttctcatgtgatgggtatgtttctcttcttgatttattgattataagattattgttgagaatcttggttaattgttgttgcaccactcagacaaaagtgtttttttaagtttgaaaaaaaaatagagttaaaatataaagagtctttggtaacaatcttttaaaatgcttccttttttattgtttgaaataaaatcaatttaaattttatgtgtaaaactgtcattatttttgtaaaagtagaataaaatcattatttgaagtttatatgcactatcaattttacattataattttttatggaggcgtattttatgtcaaaatgatcgtaattgagagaagtaattaaaataatataaaattacattaaattaactaattaaataattaaaaaggtagacaattttgaaatttttggatgattgaatcttaaatcgtaattttgagatacttagaggtgttttttggaaaaaaaaatatttgaccaaatctcctttggaaatttgcctaggacttctcctctcaatttcgagcgtttggccagtcaaaagttatggtcgttcaaagtttatacataattttgaattttttgtcacgcatcatatgtaattcgttattatgtgtagtgaaattggtcttccaataattgaatgccacgtcagtccatgggctttgcttacgtggtcaacgaattagttggcatgacattttggcaaattttatgacgtctgtgacattctaagatttttttttttttaatgtggctttgaccactgttccattatcctgaggttgagagttctaggctctctcaccccaatctttttcagtctataatagacttcgtttttgttctttaccctgatcttgttcatggttctcatgagagttgggtctggtcattctgcctcgttttaacaatatggtcgtgggaaaattcgaaggttgtcttcatactttttaatgtattaaaatcataataaaattgggtgaaacatttaatcttttgttcgggtagtgtcagcaaatctattagcctactgttaattatcagatggaaaatggagaaagggacccaaattaaaaatcctaaaaagtatgataaccgaatttgtgcaattaaaataataaaaaccaaaattacatagtgcaactaagaatattgataaattcttttaaaattcagtacttagaagaagaaaaaatgttgaaagtgaaattgacattgctcttcctgtacaggtataaaaggcaaaaggtgtagttctttaaccgtttagattgtgttcggatactcgtttcaccgacgttgaacgtggaaattacacattttattacaaaaacgctgaagcaaccagtagtaaccatttatgatacgattgcaacttacactgatggagtagtaactatttatgatacgattgcaacgttcccccaacaaagaagaaagaggaagggggaaaaaaaaaacgttgccactacggtcaataagacatccctcaatatctgcaactgtcctcaacttccaactgtgcatgtgtggtaacaaggaatatataatctttcgatatatgggattaaataattattatttgctttgttctcagagcatctattgttttggaaataaagatagcattgaacctaaagcatagttcaatatcaccccaccgcaaaataaattacaaaaagagtataagttccaacgaaaaaaaagatctctaagttcttctgctcttcatctcctgtttccaaggacaaataaacaacctccaccaacacaatttaatccctcccagagtacaatagctgttaagctgtcctcagtaaatgtgtaatcaagaatgatgcatctgagaaagaagaatatttgaagtagaaatatttggatagatacacagcttccaacaaaatattatctcctacccgtggcagtcttgcctttgcttaaatcagcaagttcctcaataagctttctctcatcattgctcagtcttttagggatttcaacttgcacacgaaccaattgatcacccctcatattgtctttattcaggaagggaacacctttcttagccataacaagtgttgtgttcggttgtgtcccggcaggaattttcaaatcgactgttccgtctacagtaggaaccttaattgtagtccccaggattgcatcaatatacgaaaccttgcaggtgtataaaatgttggtgtcatcacgtttaaggacaggatctgggataacctcaataactacaaagaggtcaccaggggaaccacctctccttccagcattcccctcattccggaccctcagacgactaccagagtccacaccagctgggaccttcaggcttatccgttttgatttcctcacccgaccatcaccagaacatgtattgcaaggtgttgaaatttctccagtcccattgcatgacgagcatgtcattgactgctggaagatgcctaatggagttcttgttgatgagacaacccggccttgacctccacaagtgctacatctggatggtgtagtccctggtttagcccctgaaccattgcaagttccacagctctctaatcggcttatctctatctctttttctatgccaaaaactgcttctttgaagttcaaaacaagactgtaatactcatcttcaccatcaattgctccattccaagaacctctggaacctgcaccgcgattcatgccctcaaacagtgattcaaacagatcaaatggattgctgaaatcctggcatgacagaaagaaatcattcattgagaaacaagaaaaacaaaataaaattatgcatcaccatcagaggtacttacccccatccccattccagaacctttaagcccagcctctccaaatctgtcatatatggatcgtttctcatcatctgataacacctgcaatggaatttatccgcagaagacaagttattgttaaacatatgcataagggcaaactgagtttaataatctgcagttttacctcatatgcgttactaatttccttaaatttttgttcagctccaggttctctgcaacacaagaaaatgcagacaatagtttaacaataagcaacagttataaaacgattcagattacaccagaaaattatgcaactaacaaaattgtgtttaagacagcttatttttcttaatttcagctgtttttatattttaaaaaaatgtttgaaaatgaagctcaattggaattgcattttttgtaacttaagtcctccctccacccccttgaatttgaacaaacattgtcattttgcttgccagtaaattactatatatgcaaatcacagtaacaaaataagcatcattgtttagtatataatatattacgaaacaataataaacaaagaaaccaattcacagagaaagcattatcaaccaatgttcaaaatatgatgtgaatgaaactcacaagacaagcaacaagcgccataatctgagatagccaaaccatgttggctacagcagtaatgttttttttttttacaaccgggggggtgtggggggtggcgacaagtgaaaggaatgaatcaggaaaaagacaaagtccaatatgtgaaatcaggaaaagaatttaactcacttgttgacatctggatgataattccgggcaagcttccgatatgctgaaatatcaaaagtaaagagctttaatattgctatgacacacacactaggtcactaatcacaataaaagaatatgcacaatcaagcaaataatatgcagattctgatggatgacaatttctcaatcacaattgttcaagtttagctattagatggaaaagagaaaactgagacatagttcactgatacaattgtgatgtgttatataaacaacagcaaaaaccttgaagtcaactatttgatgtgttaataaacatttagagataatgctttatatatatatgcaccttcacacctagagtaaaattattttaatttctcaaaggtcaaaggaagcagaaagagttacaagaaagtaggtaatcattaataatcaacagactaaagttactgagataattattttgcttatatagagatggaggtattatcatgtaacagataaggaaacaaatagaaaataccgctcttaatttcagatttactagcatttcttgaaaccccaaggacagaataataatcctgcattttgacaaataaaggatattcagtgcaatatattgaataattcacatgggctttatacagttgaaataagagacaacaaggcatcctttcacaaagtaaaatcatatatttaaaacacacacacaaaaggaactcatcactgctgaagagtgcattttaaacttacagcatttgctctaacaatcaaccttgatcccttgcgatgattaaaaatttggggcgcacccacactgagcagtgtagaatctcgagaaaaaaagcttgaacttgttgcagccataaagcttaccctgccggtaacaatgcaaaaaaggtgagttaaaagaaattacaaaatccagcacagtgaactaggctgaaaattttgagtatagctgctgtgtaggatgctaaagaatattaacatttgttggaaatagtagattcatgtatcacatgataaactgccatttaatactcatggtattaatgtctacgaagtcacactcaataaatatcacagtagtcaatatcatgctatagcagcgcgaagtagcagaatgaagtggtccttggttgcaacaggattcaaatagcagtactatcacgatatatgcttcaaaaacacttttttttaccctgaaacaacattgtttagcttttggggggataaattgtgatttctctcccattttctatgcattttttgcttcaatggtaggatttgaaacccttcttccttgaccattccacataaaaaaattcctgttttaaccactgttccttcacactttacaggactattttttccgggtgttccattctttcttcttccttaaactttctatttcacattctattaatttttatctaacttgttatttgttttcctattaatttcaccatcatctttcattttttgatgtcattactatgttcttcttgctcctagattgatggtgattgtttgtgtaaactgctactcttattatttatcatgcatttctttaattttgggtttttctttcgtttttgagtacttatatgtatagtataaactatttagtttgtattataatatttaaaataacagccatccccggttttcaaagctagccactatgtgctgctatttgagattgataactatgattgatattaacctagggaaaagtctccaccaagtctattaaaatcctatacgtatggatattttgcataaactatgtaataagaaagcatttcccttcactaaattctctctatattatttttttctcactttctctttcttcctccccctctaaatcgaacaatactcaaagacagataggatggaaagcattctctagattttgagaaattcagaccatatccaaaccataaaattactgtcaatgacaattaaagtaacaaaatcacaaattacacctaacttatgattacatatcactgctgattgatatgatagagaaaacaatgtcaaaacttaaaaagtaatatattcctttcccacagtgcaatacaagtgcatcaacatgaatcatgaaaaggatttttaggggtgcaaacctgtgaaccacagacgtattgctgttacattcaatgagtgcctcataaattgctattaatggcggcacacctatactactaacattctacaaaacaaatattcaatcatagaactcacttgtggctggatggtgcaacctttcctgtgatactggaccctagtaatagctgaggatgaattccccattgtgcagcagatgtactaccaaaaggtgttattgccatctaatatgtaaccttctctgatgaacttctgctagctggaaaaaaaatgtatactgaaatttaatatgctagcatggtaagagaccatcacatcctgggagacttgcacaccatgcggatttgaagacctatgactttattgctacctgtatgtttcatgaattttgagtaatttgtttaattttccagcatttattgtttatactttatagttttaaatatccggtcatcatgccatacactataccgctatagcatttattatggggttgacagacacacgccactatccaggattgacaactatggaacacctattcaaatcctatttcttataatgatctcgaacatggaaatcattttctaaatcaaatgaaacctatttcctaaatattcaaacactgaaaaaatcaattaccaccaaatgcaaaccgatatctaaataaaatcaattaccagataaagttaaacactgaatctaacctctagagtataccaaaaaaaaaaaaaacgtatgagttcggcaagttcaaagaaggaacaagatattaaaaaaaaaaaaaaaaagaatatcaaaccagcaaaaacaaaacactatcgaattgccaagtgaacctaggaatgaattgcaaactattcaactgttcaaatttcatacactagaaaccaataaaacaccgaaaatcacatgccataagaaataaaataaaattccaaacacaagaactacaacaataatgtgcattaaaataaagagtagaaacgataacactgaaatctagcctacgcaacgagaaagtgagtgaaagaatcaaaatatgtaagcgcaacagacaattagcaatgaagagttaatattttggttggagtgaaattggaatagagagagaggaagctggtggtagtcgtggttccctttttattaacctgagtgtgaacacagagagagcgcagtgaaacacaacacagaacactgagttgaagaggatgaggctattgctttgccttgcctcgctccttcgttcgttctctttgatggtggacaccctaatattgcttttctcccttcgcttgttcctcgccgtctgatttattgtggttattaaaattaaaatccatgtaccagccttgcccctaaaggcctaactcatttccttccttgctccattctaattttcctaactataaagactgaaatttaataagcttaacatatttcttttcaattacttttaagttttatcattttatttaattttacaaacttatttaatttcctaaaaagttaatgtaagatccttaaagcaaaaatatcttatcattcatttagatgagaaattacctatatttaaaataaaaaaaaattgtaccgctaattattacataaaccgaccttagctcagttggtagagcggaggactgtagttgataacagatatccttaggtcgctggttcgaatccggcaggtcggagtttttattctaagttacttaatcaataccattaaggcactactaagcattttccaacaatttttccactttcttttaacctttttcatttgttgtgatgcactataacccactaacctgtacgtgattcataaattattttttgcatttaataatttcttcatacagacaatgagtgtaagaagttaagcataaaaaatgaatagaaattaccaatctaatcttatttttttcataaattaccctttggttattaaaatgttattttttttcccgttaaaatcaagtttatttattcatattttatctaatctttaagtcattatatattcacaatggtcttagttattaaaagaaaaaaaattaattacactggctattactcaacttggttcaagtatattttttttaacaactaaattgggttaaattttatatgaacaatctaagagtttgaccgtgattatttgagtggcaatataagtaaaattactttataatatcagcacacaacttattttctcatattctaaatgaattataaataactacatgtcttagtaaaatttactctcttttcaataatttttaaatatattaaatattattaatcaaacaattgaatgtgttaatattaattgaatatacataatcatttatcatacaaattaaacatttgtactatatttacttatttttttaaaacattttattcattaaatttatttttgtgtatactcataatacactaaaaaaaaagtgttatttgagagaaaagttaatgttgaataattcgactaataataaaaatttgatccttaaaaaaataaattcttaatcacagttttcttaaattacaatccaactccaatttcgaattagtgagtatctttttgattgatgaaattttttttatctttattacatgtgcatgtgaagccgagtgtgtagcaagctgggaaattcattaattatttaatccagcactccattcccgaaagagaaagagagcaaggctcaaagcatggcgccaacacctcctcttcctactctcctcctcacccttctctccctattctcctcttctgcatcagccccacccacaaccacagcatgccgcgacacctgcggctcaaccaaggttaagtaccccttcggcacgggccacggttgcggctcccctctgttcagcccctacgtaacctgcggctccaacggcaccggcgagcaactcttcctgaaaagccacaccggctcctacccggtgagctccatctcctacagcacctccaccctcaccctcagcccaccttccatgtccacctgcacctccatgcacccttcatccaccaacttcggcatagactggacctcccccttccaaatcgcctcctccaccttcctcctcctctcctgccaaccccccaccacttccctatcctcacctatctgtgacccttccttcgactacctctgcgcatcactctacacgtgtcctgccgtcgtcgccctcggcctgcctctcttccccccagcaacacctgctgcgtctactcccccgccaacctcgacggcaaaggggagctcgacttgaaagccatgaagtgtggcgcctatgcttctgttgtgtcgctcggggataaccctacggaccccactcactgggtctatggagtggccttgaagtactcttttggtggggctttggataataactatggcactaccaagtgcagtggttgtgagagtagcggcggggtgtgcggctttgcgccgcctgggaatgggtttgtgtgtgtttgtaaaggaggctataacaccagcttggattgctccactactttcaaccagaaccaggactacgtttgggactcttcctctgcgaatcacatcttcttcacctgtacgtcaatttttccttccttttatttacttttgcaaacaatgtcaaaatgttgtctcgctttcttcgtgttcttcatcattcttctcacctttcatatattcctacacgcatacgcaaggaaaatgactgtcactctgagatgggtatagttaatagtcagtgattttcttatataagtatgaaattgtaaggtttaacgagtatttattcctgttattttggtatgaaaatcatcttcttcctacgtacgtacgtacctcttcacacacatacatattaataataataatagtaactaatagtacttgttttgtttggttcaagttcttattgaagataaacaaccatttaatcattttgtaagttcttgaaatcattcgttataatatatattcagtgaagattattcttttctacacttaaatattctcatttgggtgggcggaaacaaagaagaaaaaacgtattaggaaatgtgttttatttgtttatttatttacttatttattttattaattaaaactaaatggtggtgtaagactagtatgacgaaagtaatgaataaaattattcatgtataggcagaaggaataggatgcgaaagtacaacgctttataataatcttctctctagcaaagaaaaaaatatagttatgcatgcctgtatcattaaccatctgttctgtgtgaatgtttagcagcttggcatgtttggagtcctattttggctggttttattttctgcttagtttgatcaggactcaggggagccattcaattgaggcaatcatcaactttttttaattagcaaaagttgctttagaaaagtggatttactcaaaaggaagaataaaggcattccgcatccattcctatatcgtagtctttgtggattcgttttcctctattaaaatagtttatgatcaaagaagcaggggagaataaccctaccttcatccgtagtgtttgtggattttcagtaactagaagaactcaattactttggagtaaaatatgttctactgtgtgtgtgtatatatatatatatatatatatatatcttttgcgacttcatttcattctttactatttttcgctttggtgaacttaccagactcaagcccgaaaaaaggacggaaaaaaatggagaatgtcagagtggttggattgaatgggtaagaatttgcataaagaaaggcaaaggcccaaaggggttctttctttaatctttattaaccctccactttattcgttgtttcttctcccttctcctattaatggttacgtttcctttccttttctctcccttctaaactgccaaataggacagtgactaaattagtcattggcagccagcactgtaatatcaatataatttacttatttatttttccaaaataaaatggaacactaaagcagggagacacaaatagacaaatatatatatatatatatgcacacctgaaaagcatagacatagaagagttgaaatacccacaccagctcatgatatttcatatgcaattcctgtatccttggcaacaaattcctctgaatcagattctatccgtagccgagtttcctgatatatgagtttacagttttcagatgctcatccacatactttaaattggcaacagatacactcttcttttactctataaagaaccagtttcacgattatcccttctcgtcctatccgagaagaaaaataccgcatgcctgataacagcgtataaacaaatatatacacaagcatattcaaaaacaatgccgaaaaataaatctctcccatttctctgctaatccacttagctgccgttactctggtttttttgcacagttggagttggagtagtgggatcaatgaggaaggattttaaattcttgtacatctccttgggcttctctacattgagagcatgccctgcatccttaataaccactagttgcgcgttctctcccaaatgtctaaacatcgggggggaaatgagattttaagttagtaaaacataataaaaatatatgctttatgctttcatgttatactgatatctgaattgccattattccatttggtatctttcccaaaacttcaagacataagcttgctgaaggcattagagatgctttgaagataaaattaataatgcgctaaaattatttgaaattacctttgtagcctatgagctaattccattgggaagaccaggtccttttctccccagattattaacgtaggctgcatcatcgaaaagttgtgccatttgagaagttcagtgaaggattgcaaacatggtgaaattaacacattaatgttaagtcagaagagaataacaaacctgggttatcttaggaagattagatagttttctatccttatgcaatgtttcaattagttctttcctctcttggcggttttcagtacacatcacctgcaagtaaaaccagtttcagtaatgaaatttggtaaattggcaatccgtgcttgtgtattcacgtcaagggatagccaatcacaagtttgaatcctctcttatttttgagtaatcatgtatagttggaattaaagagagaaagacaatttttaacaaatactactaaagagtttcatatcatgcttattagatttgtgtctttttctcaataaaaggactatagaagagagaatccaaatccagcaatcagacaacatacaagcagacacaacttaattttcaagtaaaaggacaactgagaagtagataggaaaatgatgcatggacctccaaatgccattttcagtgtatagacacgacgtaacaaaaagagaataaaatatcagttaatggggtatttgcactgttaggtgtccaaccattattgctgaatagataatctccagtacaaatgtcaaaaatcaaatggaaaatacacttgaaccatccagtgcacagagaattgcccaaaaaaccagttgaaccttccaagcatcaataatgacattgatgacaaaatttagtctgaaaacagcaattgagtgtgtaagggtccgttgcaaaattaacttttaggcaaaaataattttgccaatcgattaggaatacaccacaacatatttaactgcaaatcaaacatgcatatttaactgcaaaccaaacaaaacatgcaatatatatcgcggtgaaacgtttagatcacacgcactagccctgccagttcccaatgttccgattcctactattgttcttttaacttttttccgtttcttcgttgacaatagttttaccctattcagcaccatggtggtaaaatccaagaagacacataaacataaacataaacatatataatcaaccatcatacaattgaatcaggaagaagccgaccaaaaaaatatcaggaaggaaaacagaaattgcgctttttaagcaaaatcacacgaattgtatgaatccaaaacatcaacacatatgagaaacaaaaataaataaaaaaattgaaggcttgaagcatcaaattaacatactcacgttaatgtaatcattgaggaagcaagtgggcatggttttgacgggcttggcaaacgcgagctgcacgagctgtctcaacttttccggcgtctgcggcagcaaaatatccgcagcctcatccacagtcttcacctggaacatcccttcatccaagtctttctcttccaagcacaccccagcgcagcatagcaccaccttctccacgcgctccgggaactgcgccgcgagactgtacgccacgaagccgccgtagcttatacccacaacgctggttctctggagcccatgggcctggaggagggccgcgacgcactgggcctggaaggcctcggagcggtcggggcgggtcgtgtgggagtctccgaagaagaggaggtccgggacgtagacgttgaagcggcgcgtgaggggcgagaggaagtcgttccactgccacattgcgttggccccgaagccgtggatgaggaggaggttgggcttagagtccttgtgggccttgggggcccagcagtgcatgatcgtgccgtcgccgaggtctgttgtcacggatttgaggcccgcgttggagaaggagaagcggaagcagcggtcgcgcgtggcagtgaagctgatgcaccccgccgccatgttgttaaggttaagaggattgggggttgtgtgtgatcaatcgatgattggttgatgatggagtgaagtaaaggagagtcttctgcagactatgagagattctagaggacacagtcacaggacaagtgactatgtaatagagacaagagtcttcagataagatgctttcttactctactcagagaggtaagaattatttttatataattaattactatttttattaaatcaatcaattaaatcattagatcttaaattcatcttgattttacaactatggtcattttattattatcataaataaatcttttttatcatcacattttaacttataacactaacatatatactattcaaatttataacagattaaaattaaaatttaaaaatttattatatattatatatttctacttctattatctattattataaattagatagtaactatggtaaacttggaggaaattttttcggattatataaaaaattatattataacaattttattaatttcttatattattttgaaagtaaaaaaaagattgttttttcttaaaacaatacttacccagcattaataaatttaataattattaaatataattgaaaaataaaaaaatagttttaaaataaactatacttgcatctcctaacatttaacaaatttatatttgatatttcatttttaacatttattttatgtttccaatttatgtaataaaataagagattatgaaaaaaaatttgtgcacctggtagcataaattacatatataaatcacaagagaatatccatagatggccacaatatttactagaatataaaatagcaaaaaaaatatatctattttatcttcctttattaaaaatggatcaaatattcattataatataaaaagacatcactctaactactcactctaactactacgggtgagaaaaggaacccccactgtgtggtatgttgatttgttagagcatctccaatgaaaaatgtttatatgtttatggttcctttacttaaaaaaatcgtttcttgaagaaactttgcactagagattgtcttggtggcataacgatttcttgaagaaaaaaaaagtacatcgtatataagcaccatgttcttaacaaaaaaattactattatccaacatcaaccacccatctaaaaaaagaggaaaaataatgggaaaaagaacaagggcaacaatgttagatcaatgaaccatcttacagtggtggttgcgtgagggaggtctgcaggtgatggtggttgagcaaggaaggggctgtgatggtgctggtgtgttatggtgtgaggggtgattgaaaaacagggaagggggagcgtgaaatggtaagagagaaagaagcaaagaaaatgaaaaaagaagaaaatggaataaagaatgaaaaggaagtttcttggtagccttcttgtaaaaatttggttaaagagcaaatgaaaaaagcattaaggacaaaaataaaacagcaaagggaacattaaaaaaactagtctttattttgatgatcattgtgaacaaaaatcaccgttatagatttcttattataaatttggctcaatgagattaaattttgcacacaatatttatactcctaatttttttcttgttcctatcaagcctcgattttttttattctctctaaaattgatcgcaaccagtataatttgcaatattactctagtcatttgcaaaatcaaacactctctaccagtgaaaattcccaaaatccatcgcaatatgttgtgttgtgaatccaccacctcctcctaccagtgaaaattttcaaaattcatcacaatgtgttttgtattcaccccctcccccacacacaaatgtggtatatgcatccttcatccaatgtaaagccacctacaagtggtagttctcaaaatccataattttgtagtcaaccatcaatccctccaatccaaacacgtgttatatgcattatttatccaatattgagtccccaagcaatgaaattcaatcaccaatcggtgtagacaatattttactagatgagagagcacaaaattctagtgggaaatatactcatacaacattctcagtgacaaaagatgtgattcttgttcaattgtgactcaatgtgttaaatgattcaataataggtgttgactaaacatcaaagtaatattgggcaaagataaaaaaaatgtgtacaacaatgatgatatgtgtcaaagcggacaattttgtgaaagaagtttgattcaattgaaatctcgatggaataagattcacccagttcaaaagtttaacgagtgttacaaataagcagataaatataggagaagtgaaagttcagagaaagatgttataactaatactcatatgatttactcacatgatactgataaaaatttgaggttgagcatgcttggttgttgttgaaagatcaatcaaatttttatcaaattattaaaaaagaataaaggttgccgctggtgaaaattactcgtcatcttctaacctagagacattcattgaagtcgaagaatatgatacgtcatcgccaatgtcttgcccaattagacaaaaaacagcaaaaaggaagagaaaaggaatagaaccttctaacactttcgatttatctgacatagaaagtgaaacgaaggacaaaaatgtgagcacatcaaaacttattaagttaaaggagacacaagaaaggcgtatggagtatgaaattctcatgaaggatacatccaacatgtccgaacagcaacacttagaccacgaaaagtatcgtgaccatattagaaaaaactagaatattaaatgtataattcttatgtacggatgttatgctaatgttgtgtgtgatatttaatcttagcagtgtaggtcgttgttgtatcttaaattcataattctatgttgtaaaactaatcattggaactagccgttatgaaattagttgttataaaactagtcgttatgagtcaagctatgtaaatgtccaatgtttcatcattctcacatattctcatacaaattacaaaatatttatctttgatttcaaacaattcagttaccatataatggatccaaacatcgatttagatgaagttttggatcgaatgatagttgaggaattgaaagacaacatcgataaagaaatcattaggctaataattgagttttggatcaatgtttttacgtaatactttttatttccttcgttatgttttttatttcaatgtcattatgtttaattatctattattatgtaaaaatgtattttttattgttaagcattttttttcaatgttatgtaattttcattatttttaattgatatttaatattttcttcaattattcatatttattatttgtattcataaaaattaaaaaaatgaattaattattttattgaaataatataaatatgtgaatcttttaaaatttcttgttattttttgcattgaagcaaaattttataggaattttttatacgtgatatgattattatgagaccacaagaaagtattgtgagaactaaaaaaaaatgattaaaagactttaaaaaaacccatataatcactctctattaaagatactgttaaggctaatgttggacggtacctacatgttcataggtcgtttgcctaacagagcaaaagatgaagtgttgacttgagatgttgggcatgcaatacctacctcttcatagatcgcttgcctgagcagtgagaagtgagcaataaatgaagtgttgaggtaagacatactgtgaataccaatatttatttgggtgcaatttcatttttgaaaaatgagagaaaaatataatcaaggaaaatatagggaagacttagtcaaaggaaaaagagtgacaaatgttagaaacaattacttagtgagcaaaaggaggttatcaaggataaaatcttggatttggaaaacagaaaattcttaacaaagtgattatgttgttgtcaacaatcacatatatgcaaaaaataggaagaatatctgatggcttggacatcaagttgtgttggcctataaaaagccttcacaatcactcaagaaggggtcagaggaaaaaagggggaaaaaaaaagatcatagggagaaaaaaaaaacttctcacacatctatttttcatacagggattgaaggctcacacttcaacaattatttcaaaattcagaagtttttttctttcacttttctttcttttacatattaaaaaagtgtgtattttatcaaccatgtaatctaccttttgtgtatatctatatatgttgttcggttatttctttatcaagagaattgtattttttttcactgagagtaatgctcttctgtttatactaatttcaatttcctttcacttttaattttcttattattatttgttccatgaatcaattggtaattgtgtgcgctgatggtgctctctatgtagaaagataattttgtgtaggatttttaaaaaaaaaaaacatgagaaagtgattctgatttttaattgggaaagaggaatgataataaaaaaggttgaaaatatatgggtgcctttgtgtgtgttgtgtgcatgactcacggtgttatttgttttttatgcaatgttaatgtacataatatggaaaaagcttagtttttttttttttttttttttttataaaaaaagattatgaattgcacaggcacgtgaacagtgtttttcacgtgaacacatgttttcctagtatcttctgatttttcactttgttaataaaaatagtaaattggaggatttttttttggtagatatagtatagttattaaaagaagggatttctttctatgttattttgtggtttcaaataaaaataataattttaactcatgtaatggttaatgacattaagtgagtagcaattttatctttctttaatgttatttaaatcataaaatttaataaaacaattatttgttatttaaaacatgggcattgtaggatgttaatatcttccctacatataaacagaatctatctttgatttcaaataccactcttaaaaaaggtttttttaataattttttcctcaaaattattccttgcattgtatgtgattccaattgccacacgtacaattaaataaatatattgtgattcccatcctagaattacaaaactcaagattggatgatttcttttcaacacacactccaataaaaaatacatgtatattaggtgaggattatttctcacttataaattatatgtttaaatcttgaaccccctcctcctctcccatgccaaatatgaaccatctcaaacttaaagtttttatacccttaatcttggatttctactaataatagataaacaaataaataagttaatgtcacatgcagtaacactggtcaagtcaatgttattttttttttttgcaaaatactaaatatttttaaagtattactattactattatatacaaaaatccacaaatatcgagtaaagaattgaaaacaggctaaactataaaacactgtaagaaaaaaaaataccttctatgaattgaaatattttacattgtcaactaaataaaaatataatttttaaaaacttttaagatattattataaagattcaataaacttattttatatatataaaaatttatgattaaataaaaatttaaaaagtgcataaactaatttatcttattatgattactatcattatttataattattaaaattattatattattgttattattattctttaaggctcaattaaaattttctttaatagtatacaattttctgtctttttattattcttattattactcttaaaaacattcttattattactaatacttaaaaaatttccctgtttaatttttttacttctcacacactgacgttatttcgttaaattttaattcctcctttaagttcttatttgtatacgttttcatttaattatatatacaacagcccatgaatgtgcccaagttctgttttggggttttgattaaggcttcggataattacaaattaatctgggctcgagtggtcttaatcatacaaaattaggttttgccgcacatggtttattttaggcattttctatatccacttgcattttttctaagtacactcccctttgcctttttcaaaaatcacactctcttttcaaagtttcaaagactaaactgatgttaaaaaaacatactagattttttttatataaacttcaagaacgaaaatggtagtactactattttattcgttaattaaatgtagactagtagcctaataagcatagaattccaaccctgccaaattttgtctgtttgtctgccattcaccaccccacggacgttgattcattgttttgctagtgtaatgcaggtctcagagtgatttgagttgaaggccattgctgttatgaagtcaattcattcacccttccatcttagtcatgcattgtcagtctccttatcatttgaaaaaaaatcatatcttggaataccctttgtcatgctatattttggttctcaaaatcttgtcagcaatcatgtgatatagcatactcttgtcaattgcaaaaattattaagtatttagatcatgagatgtctatatgtttataattttaactaatgatatatatatatatatatatatatatattatattttttaccgatcaattttaattattaatttatcaatttttttgttaatgagaataattcaaacttatcatctgtttttttttcttcaattatcaaatcaacttaaagtatttaatcttttaatttataaaaaatggactaattatatttaagttacatgttatataaagaatataatagtctcagacaacataataataatatttttctatcaattaggcattagagacaaagcagctctcacctacatacatttccgtggctagttaatcaccaaatgtcaaatagaaagacacacacagtttcgattagatgaaccttaaacgagaagacagaacttgtaacaaagcatggccgcaggacccttcttttgtaaaaaatttcaagtagtaattgattattgttcacggacaacgtataaaaagaattcgattttataaaggcatgattccctcacatgaaaacatcatttatctgggagtgtattttggattatacgcaaaccaacatgattaattttaattttataaataattacatttagagcaacgataattggtatgaaagacattctacgaaacccgtcatgaattgcttgatatgatttctgtccaattgtttgtttataattaacgtttgttaattgaagaaaccaacacgatcatgtgccacgtagtctgtaataaaacctgtacagctatgtagcactacgattacatttaaatctaattgcaaatttatattataatttttttgaaagacaatttatagtataatttaagatattgatctaacgatttatagcatctttgggttatttttggaaagcacccaaagcaaaagatacaaatagattcttatttaaaagaatatttagcgattaatacgttgagaatgttaatccaaacatgctataataactgtgatttcttggatccaaattgcaaactagcaatgtaaaggtggttaatttctctcaacattaaagtaactaatctgtaaaattatttcgccaagtggttgtgcaattggccttaaaacaaaatactattctttgaaagaaaaaattgtgagggactgtgttgtgtgtgcacgcacgtgtttttggcggaatattaatgtttttctttatattcacctttgtcaattattcaattatcacgtggtttggtcactttgctgggcaaattattaaaaataatgttttttaataagtattttgaaatttgagttatttcaaaatttgggataattaatcacgtctaaattggtgtgtttttaatactttaacaaaaatattgttattttttaaaaattgaattagggatagatttttaaaataaaaatcaatattatgtaaagaagtgttagaaatcgaattagcgaatgactgaaacaagttcaaattgaatgtgtttaattgtctcaaatttcagaatagttttaaaatagctcaaaatttcaaaatatttattaaaaaaatattatttttaataatttgcccactttgctgaaaataacaattggaacacagcgcatgcaggattgtgcttgtgcatctccctacattgagtggaagaattctcctttggattttcagcacctgatacttttgttaggcagtagtatctttttcttactttattcgactcaattttatcataattcattttatattctctctcatacttttttctttaggcttttcaccttatgtacataaaaaactaagttttacagatatttcaaaagtctatctatacagagacaaactgttttaattatattttaatttgcttttttaatgtataaaacacattttttgtaattatatttttgatatgctagcctactagtccacccatagatggggtagactgcatatttttgcccacgtctttggagtgggtaacccgccccaattggttatgacagactggttcacaaaataaaattgaagtataagaatagtttgtttatataatttggttattaatcattatagctcattgaatacgattactttaaatttgactagcttttaattgttagtacgagttatgactgtctggataagattataaatagtctcttttaagactagaataaatagtttgactaaatcctacacgaaattcattttattccttttcatttgtgattaattcaagcatacttttaatatttatactactaatacagtagtattttctgacaagaacatactactgtcataatctttttaaaatctttaaggtaaaatataccagacacacaaaaatttgattatagtaatttatttatgggtcttgtaaactaatgatatgggtttaaaaaaaatattattgagatgatataagaacattaataaaaattcatgggcaccataattttattattcctaataaaaaaatattttaattttttaataaatgtccaaagacaatagttaatattaattaagaaatttaaaataaaaatattttaattaaaagatgaaaaattacactgctcattatggttgctcgtataaaaacatttgttttttaataatttcttaaccaatctcttagtcgccgttagagcctttatttatttgtatgaaatgaaacgtggggcgaagacatgtcgacattaaatgatgggtgagattttgaaggaaataaaaatccattggaaaggagccagcgagagacagagcagtccaatgggagtgtgagagagagaggcaataattatcgcaacttgcttttcattttcagtcatatttaaatttaaatgcaagcttctctcatcagtgcagggaagagaaacttgtgaggcagatagtcaaatctagtaaaggaagtaggaaaacgcaaaaacgaattactattacaaaagcctattagtattgcatttaactaaccaaagagaaagagaaaggagggatagaaggttcggttccagatttggtgtctctcactctcatccttcttcgtcagtactcagctttccctttctttctttccttttcaccaactgaaccaaccttccttctcttcaccatccctcacctactaccggcttttcccgtacccgattccgattttcagttcagttctttcttttttaattattgttattattattatgattttgtctgttatttcaatcgtgttttttagtgttggtgttcactgttcactgttctgcttctgcccatgccttttgtttttgacccatctttgggcatatatgcattcctttgtccctttgtgcgcgcgatttggtgcctactcgatttgattttctccctcctcttcgcttatttttccggaatcttatttaagtttatggaatttgtcttctcatttttttttcgattagttttgtttggtatggttccgatcacatcagtgttttatgttaagactcttatttatgagtgtgcagtgtagtggatggagtattgtgattttcaattatttctttggttatttttttatttacttccagataaaattagaagttcactgaattggttgtcttgagaatttagactgcttatttcttcacctttggtgattttctgtaatttgtttttttatttttttttattgctaggattagatgaggtgtcagtagttggcaactaatccaaataagtaattgaaaaaacttgcgattgaccttcccttttacagggtggtgagaagagaattgaaaagtgtcaattagctacggtctagattggttgttacattcagagtgattggtttttatagaccgtctttcctttttatggggttagactggggagtgggtgaagcagatagtttagctgcggctgtctatgtctgcacagttagtttttgaagtacgctttgtattgcaataagacttagtgtatgtacagaacagaatgaaacaaaaaggttttgttctttttaccttggaactagacataaaatagaactccatatcttgtgacccacattctaataatggctatgaaaagtactcttcctatttcctcgatcaggcatagcttcatgtttgatcataaaataccttgttctgcaataagattgttttcatcattctaggaatttgttctgcattgtttgtctttgtatggcatttaccacattttttcaattttcacagcttaatggttttgatgattctgtgctgcagagatggaagttgcttgtattttaattggttttcatggacattgtgtcagtggttgatgccagtagaaatggacttcagatttgtgctattgctattgggttgcttatgttcttttgtgttgcctgatacgcaaggtacattcttttgttcttatggcactcaacccattagtaaatcatataagctttgtaaaatttaactgctaaatgcacatacattgattatctttttatgggcataaaacacagcttttcaaactttaatttccaattcatttctgaggaatacatagatacatacaactgtttattaacagaattaaatggatgcctcatattttccaaaactgctagggttttggacttttgctgttggttctagtaggtgtgtaaatgttcttgttcatttcaggagatgcactatttgcattgaagatatcattgaatgcttcagctcaccagcttactgactggaatcaaaatcaagtgaatccttgtacttggtcacgtgtttactgtgactcaaacaacaatgtcatgcaagtgtaagatattttaatattttatgctgttgttttctttaatttatttgatttgctgaagatgttggctgtcattactcattgtagaaagtgttatatttcacatttttaaatcttgattttgtgcttgctgtgtaatatataaattgcttcattgcagatcactagcatatttgggattcacaggatacttgaccccaagaataggagttctaaaatatgttacagctctgtaaggattctatcacaaaaaatccacacaatcttggtcaactccataacactaaaaattatttttgtcattctactcactcaaattttgatgatgggaaagtaaattgatgcatattatacttgtattagttctttgcaaggtaatggaatcactggaaacataccaaaagagttaggaaacctgacaagcttgagcaggttggatttggaaagcaacaaattaactggagaaataccatcttcccttggtaatcttaaaaagcttcaattcttgtaagtatgacattttgtttgctaggttctacatatataatgagtcttaggccttagcatgtattttttgtgcaatgcttaaaagtgtctgtttcttgtcctgctaccagaacattgagtcaaaacaatctcagtgggactattcctgaatcacttgccagtcttccaatcttaatcaatgtgtatgtaaaataatggtttctagaactttgcattttttttaaagtatatttcattaatttagtatctgattgattattcaaacttctcttttgcagtctgctagattcaaataatctgagtggccaaatcccagagcagttatttaaggttcctaaatacaagtatggatggtaaaaccataaaattagtatatgatgcatttaaagcaccaattaaacttgtctctctaaccctgattacaaggacaatgtattcccatgaaacacttaaatagtggtgacatacatccaaagagtccagatatagaatttcatctaacaattactaacttattccaatcaaccggtagtagatgattctaatggtcatttctggttccacacttcgacttctttatttgcatttgaaagattggtggttgtcacatattgtgtctcaacaaacttaatttagttcttgtagcttgactactttccatgtttccaacatctaggaaataggatttattggacacaaactcctttatattatatgattaatgctgttgaatcatgggtgtcggagtggagttgtatattcccattataaatgaagtgtaaaaagaaatgggaagaaataaggaatcagtcaccctaaaagagcttagggttttgcttaaaagcctagaactggtgttacttgtatcttttaacaggctttatcatctgtaaaccttttgatcctgaagcatggaccaagcctttgccaactgatattttctgccacaagttgttttgaaatgaaataaaggggtactgaggattgaactctcaaccgcttgttcaatgtggatccaataccatgttagggaactcaacatcataagtgaaacaaattggagcaataatgataaaaaaaatgcttcattatattgtttggtggtggttaaaatacagagcttttacctttacatttcctctgttatctggcatgaccatatgccatgttgtctatggagtccttggatagaatattatttgaatttaggtgaatgagatatttttcaaactttaacatatattttataccattacatttcactattttaactgtgctccttattgcagtttcactggaaataatttgaattgtggtgcgagttatcatcaaccttgtgaaactgataatgcagatcaaggttacttgatcggaatatttattccatccttttgatttgctgttatctatttcccacttcctcgctacaagctgaatactaattttcctactattggcaggttcatcacataaaccaaaaactggcctcatagttggcattgtgatagggttagttgttatccttttccttggtggtctgctgttcttttggtgcaagggtagacacaagagctacagacgtgaagtttttgtagatgttgcaggtttgagtttcttttttagattgcaatgttattgtattaggtttctcttaagtgaaatgtggatatagacattaatatgactgtagttgtagcatttaaaatattgatttataaactctacctatgcattcttcttcaagtaactttctccttttattgcaaatatgtttttgtcatggttttcccactttttagtgtctttacctcctgtggcctccaggacctaattgctagatgttagggatttaataccaatcttggcgcccctcttatgcatttgaattttggataactggtgcttaaaactaaacattggaataaatctgtgtatctctattactctaaaccttccatttccaatgaatgtgggatataatcaaattttggattgatagaagagaatttactggttgaacgtattctgtaatcttttaattgtgaatgcttgttgaaataatgtaatagctagctacactaaaattgagataaatgtgaacttcctcctttttaaaatagtcattgctaactataaattactattttatcattattcttttttcttgtttcatcaggtgaagttgatcggcgaattgcatttggccaactaagaagatttgcatggagagaactacagatagctacagacaacttcagtgagaaaaatgttttaggacagggaggctttggaaaggtttataaaggtgttctttctgataacacaaaagttgctgtcaaaaggttaactgattatgaaagtcctgggggagatgcagctttccagcgtgaggttgagatgataagtgtagctgtgcataggaacctgttacggctgattgggttttgtactaccccaactgagcgcctcttagtttatccctttatgcaaaacttaagtgtagcctatcgtcttcgaggtaatatgttacaaacttacaatgcattttggcatcgctggtatgctaagtattcaatttgatttgctacaaaatagaaagtattgtttattttgtaaccggaactggatagagattaattggctgaagaaagttttcacatatttaaactacacattttaggatatatgccaacgatttttagtatttatccaacaccttggagcaatgatttgaagaatttttaactagagaagtagataaaagggtattttggtggttgaaccaggcaattcatagatacatttgaacttaattagataaattatataatatatataataatatatacaaaagtgcatatatgtatgcatgtagattatcagctaatggaagcttcaaaatgacaggaaagaataacatcaaagaattagataaccttattttatttttcctctatttatttgtatggttttaaattcaactgaaaatccacaaaccattgagaaaacgttgagaaccaaaaccttatcgtgacttgacttctggtccaaccaagtccaaattttagttttgcagaactggttttgtaaaccaatctagttctctcttttttttgctgcttttcacttgttttgtgaatgccagggtagtttgactgttcaaccttctaatgtatggggtgcttttagtggttcaacctgtcagggtgatctgttcaaaagaaaattcttttgttttaaatcacttgtgaatgttgagtcagaagtgtttcatcaccaacaccgccatcataatatcataagcctaaattaacatggatattaaatgactaacattatagatatgatttttgtatactttgtttaacatgtttgggtaggttggacttccatatcttatttgcatgtaaaatctggcatctttccagtgatgttttactaatactgatgcagaactcaaacctggtgaacctgttctggactggcctacaagaaaacgagtggcgctgggaacagcccgtggcttagaatatcttcatgagcattgcaatccgaagattattcatcgggatgtgaaggcagctaatgtattactagatgaagattttgaagcggttgttggtgattttggcttggcaaagttagtcgatgttcgaaaaactaatgtgacaactcaagttcgtgggacaatgggccacatagctccagaatatttgtccactggaaagtcttcagaaaggactgatgtttttggttatgggattatgcttttggagcttgttacaggtcaacgagcaattgacttttcacgtttagaagaggaagatgatgtgctgttacttgaccatgtaagatctctttctaacatcatagcctctttgtttgattgtgttttttggtctgtttcttgtttgtatagcatgcttagaacttgtgtgtccctcttgggtggtttggtgaatggtgatatcacttttcacttttggtatttcatcacataaaataaggatcagcccgtcatagttgctccacctaaagagtatcctaacccctcttgacaggagcaatggttgcagtgagccaaggaagttcatgtagttataactgtacctctgcatttttattaagctggaaataagttgacgtgtgttgtttatatgataatattgataaagaaaaaggtgaactgcagtgttttatagagttctgcctctgcgttaatggtacttgtgttattattcaaaatccaaaatctaccatttatcggtttatacttttttttttgtttgacgtgatttatcggtttataattattggttactgttttcgcctgtatttttgtgctctacaggttaagaaattagaacgggagaaaagactagatgcaattgttgaccgcaacctaaataaaaattacaacatacaagaggtagaaatgatgatacaagttgcattactctgtacgcaagcaacaccagaggaccgtccaccaatgtccgaggttgtaagaatgctagaaggagaagggttggctgaaaggtgggaggaatggcagcatgtggaggtcaatcggaggcaagaatacgagagattacaaagaagatttgattggggagaagattcggtctataatcaagatgccattgagttgtctggtgggagatgagaggatctataaattattaaattatgagaggatctagaaatgtaattttccttgttttccaactgtaaaaactgtaaaaaagggggaaatagttgtaaaattttgatgttccaacgtgtttttttcttctcttttttgtgtggataaatcaggaatttattttaaaaatctgtttgttgagatttcagctgtgatctgatcccattacggggtacctatcaattagaatttacaacacttgcgacttgtcaaacaatgatttggcactttaaggttggatgctgtctgaatcccaaaatattcctgatgcggtagtagatttttctagtaggtgggcataaaacttttttcagcgtatatttgctaaaactcaaatattaaagtattgctgtatcaggaataataaaacctgggacgctggacaagatgtgcaaagtggtgtaaattttagttggcctttctgaaacagaaactgtgttcttggaatctagttcaaggtcagctaggtaccttagctaaagcaaagaagatggtaaaataattggctccatatcctatatattttaagtgaatctaccatttttctgagtggttttcatttgatttttcttaccatttttcttaatggctcgtgaagacacaaacctagctaccacaattgattaaacctatcttcactcgaattttcacagctgcctaccctgagatgggaatagcaaaatattaagtattctattcacaagatcaggaatcaatctgctgaccattgctaaaaggacccaagccactgactacttgtgtcacaatttgtgggtatcaaaatcattattttgaatacaagaattcaatacttaatgttgccaatgaaagaaagaaaagcctgccattcgtttccatttctcaacagggatatatagctcgtctaaccagtaccagaatattttgggtccccataattggccttgtccctaagtgccattgccatccttgtctcccaataaatatattatacctcaaattattaacattaatgcttctgcctactaggacgtgaaacacctacgcatatcactcatgatcacgcatgatgttacaagtgtttctatcctagttaattccaattcgacattaagtatattgatttttctccaataactaaatacttttgtatgtaaatactgcatattttattctattcataaatctattttctttcctgagttctagtcatgcattttcgtttcctcgtttccccagtcctatctaccttttcttgatgatttgtgaagtgacaaagtattcttcgttgtaatattcttgagttagcaaatcgggtggtggattctgctccgaatctctaagttcccattcttcaatatccatggcaaattggacattacttgcgactgtcatcgtcaaagccttaaagaaatcaacattttcactgcacaacacaacgtacctagaaacaatttgttgttgtttactaagcatatgtagggatgtgatgtgaagtttgtgcacaacaatttataaagatataggtagagcactttgtgccctcaatacatttcacgtggttgtataaaatgcaatcaggtgcggaatattgcttggagatcaagcttcaagtttgattatgctgatgagtcacatgacatatatggataattgaggcaggtagcggtgcaaattaattagctccattcctgacctcaattttacatctcgagactattcttcaaaggtgaatttgacatctgaaggtcgagtttgagggataagtacctatcatgaatgtctcgagagtgtaacactattgccattgggaattatttataatacggaactctgaattaatgtctaaacttattttcgtttgtgtgcgttagtgatatatacactacaagctcacaactatatcgtttcctaaatcagtaacctcgtgttggaaatgggactagtgaggccttatatatgacaatgtttttgaaagcaaaatgatttttaacactcaacaacctttgacaattaaaagagataaaagaaactaaaatataagtattataagtgatgtaatacgatagaaaaaatatctataaataattgatgagtgttaatgaagtagttgaagaaattagatatctcaaaatatttcaaaaacattgttcaattcccaaactacacaagtagattatgagagtaagatataatatgaattgaatgattaaggggaaagagaaggaagaaaagattcacaggttagattttttctactaataaaattaatattttaataattaatatttattaaaaataaattgagttatttagtttgtgaattgaacaatggttttggaatattctattttttcaaacatctaagtaacatttattatttttcttttatttttttattatatcatattcttgattatatatatatacacaataatatatatatatatatatatatttcttttattttccactaggtgtcaattatgattttgcgtgtctaaatactatttttgttatgaattctctcactctatttcgtgcaaaagttacgacagcgttctgtaccttccaaattccaatccgcgtcagcacaccatcatatattagcgcgttctataccctccgtttcgtggccgtcagcacaccatcacatccttttgttaccatcacttttctggcattagtcaacaataatgatgcatcaagactcacgttttatttgacacctaaaatttatatattatatatgatgagtttgaacttattttatgatatagatagagctgttaattcagtcttcaacccataaagtgtcccatataatatttttatgcatctctatcccatataatataataactaggggctagctacccatacactacacttctgaaataaaagaaaaatattcttgaaaactctcttagaagtttacactttgaaagagatcaaaagataaataattgatttaattaatgatatagtgtgataagaagaaagtaataaaaaaataaaaaaataaaaagtgatgataaaatgtttgaaatttataggtatccaaatacaaatattcgaaataaaagggttaaaattggattgaaggtggcatagcctccaaaagcgttaatatatgatttgtttatacttgaaattgttactatgtatattccaatgcaattttaatgaataaaagcaaaaataaaaattctaatccttttatgcaaaaagtccttttacgtaagttattttccatatgattttcaaagatgttcttattcaattttgaaagctgacatgacaccggggtttgagatatggcagcaggggcaacaaaacgcactccaaaatcaagagtgctgcgataacaaatgaaattgttttttttcttttttaatggatttcacatgcattattgatagtgatactggtgtgttgcaggatgaggactaagttcctctgaacaagcaaaatagaaaactggaccattgatgtgtgcctttcggacgctgccatgtttcaaagtttaacatatgtaatatgtaaatataaattgaaatatgtaggatagaacaagtggcgtttatgaagttgtgaataaaacccagactataattaatgtattctgcacctcacatattgttttcataacatattatttatttatatattttctctttgtcactttatataaattagtgatatccacatttttgttatatttatactaattgttgattaaaacttttaaggggagagattaattaaatagttaaaaaattaaatatgagtaagtaaagttagaaagattgaaataacttctaaggtaaaatatgtgaactgataagagtataattaagataaatttctgccttttattcatatgctgcactgaaatatatataattttattatattatttagctcctaaattatctcctaatatatgcaaaagtttcacaaattaattcaaatacatatagaaggttcctatcaattagttcctttcttacaaatttacttgattatgatacagcttatcgaagcctataaataataaattattcaagtaattcatcattagttaatccattccatagttatggagttgtttgtacagaaataaagaagatcttcttaaaaaaaaaaatcgtgtaatgggtgttttaaacatattaagattaagtgttatgttcttattcatttatattattttaagtgtgattaattcatttatttttgaaacaaaacaatattaggtggaccttttaacaaccaatttgaaaaatttatgaaaataacttatgataatttgtccacaaaatacttattagttttctaattatattataagattcgaaaatttaatctcaaaaagtataaaatcttgttgtcttttttgtcaaccatatttaagccattttagatctaatataaatacatcatgtacttaagtatggttatatatattgttgactttcccaataagtaaaatgctaacaatctaatatattctattcaggtgttaaaaattaaaatgaattaaatcttgattcgtcataattaagaccgacttcaagaataaaaaatacttacaaataatctacaaaattctcagtaatgaaattttgaattcacccttgcagatatgaggtgatcagattgttactattttataatttctgaaaaatttaatcaattgtagaaagtatatatgttaattaaaaaggttatgtctttgtgttgcatagttagcgctcatttttaatatttatttaaaagtcatacttcaaatatttgcatgaaattaaactcttgtattaaacgttaataattaaatgtttttcctagtataacataaaaagtgaaagacactaataaattagtttttaacaataagaatttaaatttaatttttaaatatatagaaaattgtcaaattaattgatgtatgacttaatattaaatcgatctttaaaaaatataatttattatcaaattaattcttaaacattataatttaataataaaattatctcctaaatttaacacaaattaatttatcacaaacttaataatttaaaaattaaatttatattttcatttttaagaatcaattaatcacactttgaacgatgaatttgattatttaggttttagattaaattagaaaaagagagttcccatgcatctaaactatttgagggaagcccgaaggccaagcttcctcccgcatgtgaacagttgttttgaatggatccaaatccaaattcatccaaaccatcaaagaacccttcaggtaacccatccaaaccaccctcactttccttcaccgccaccgccaccgccactgggctctcctcttcaagcatcggtgaatgcccctcgaacagcgacacatgtccgaacagcttgtccttcctcgaaaacgtggtcccgcacgagcacttccacgtggcctctccccgacactgcttgacgtggctcctcaagtccgaccgcaccgcgaagctcttcttccgacaccgctggcacgacagcgttttgggacagtggctcctcttgaagtggttcctcagacagaacactgacttcaaaggcctgaacttcttgcgcgtcttgttacggttgcatccctcgaatgggcacgaaaaccgcgcccccttgaggcgcgtctccccacttgccttgttcgcgagtgcctccggggtcttgaactcgtccccgtgcgcgcgcatgtgcattctcagattcgcttcgcgcgtgaagcctttcccgcacacctcgcagaagtgaaggtgcttcgccagcagctccatcgcgtcgagctccaccacgttgtcgttgtcgttgttgttgttgaggttcggagagtccaatgttggagtctccgagagaggaagcacgtttaccgaggcggcgacgagggcggcgccgttggtgataacgtggcgaatggcggttaggatctcgttggagactatgttcatttggtagtgagtgaggagagtgtgggattggatggaatgggagaggaagctttgaagggaatccattcgggtggtaagttgggagaggttgcgaagggaaacatggaaggactcgaagctgttgttgttatggaattcttcagtggtgtttggcatgtggtcgaattagagcgggttattaatcttattctgtatgtatttagctaagttcttcttgttgatttcatgagtaagatgatccagcaaatatatactacttatatatgctatgatatggggtgagcttaataattttaaaataaatattttttatataagtattttttatataagtattttttaaagaaaaattaaacaattcttttttaaacaaaaataatttagataaatacattaaaaataaaaataaatatttattttaacaaataagtttaaaaaaaactgtgaatcgtaattgttgtacaaacttgaaaatataagggaaagttgcttttgtcgatacatgcagcacgtgttgattaccttatgtcaattgacacaaaacaaaacagcaccagtcttgcaacttttttgacttcattttaattactactagtattttattattattagttgttacacgaaaagtcatggtaatgtcattttttttttgtatttttatttaataaattttatgtgagtgtcgttggaaattttgaaggaaaaacatacaggattgcaagatatcagaatcattataaataaaaattatacaacactaagtatttatctcaccccctacattttatcatttattacattttaaactcctgaattgtaaattttattatacaataatcattttttatagataaacattttactctctaatccacgagatttggtcttgaggtgaaatatttggatagtatgtataagattataaattttaatcattgtacaattattgtatactaaaataaatattccactcttgtaactcttttaattcgtatttctttactgtttttgtcatatatatcactttttctatgtatctttttttcttacctcatatctttctctttttcctcagtacaccccataatttagtcttttatttttaaatataaatttttatttttcttttatttgaacataaaacatttaatcctcatatttttcaaaaattataattttagtcccttattttaaattagagacttagtctttcaattttgtaaaattcatgattttaatcttttcatcaaattcaaaatattgagtaataaaaaattaaccaatatggtccaaatttaataaaataacataagattatttgtttatttcacatcataatcaacactaatttctttaccatcaacactttaagtttgacataaacactaaaataatagatattactaatttgggagactaaatgtctccttttaaaataggataatcaaaattgaaaattttaaaaacatgtaaacaaatatctatagtttaaaataaaagaaacaaatttatagatttaaaaaaataaaaagatcaaaatcacatttaactcaaaagaaaacttatgagattgatggatttagtggagcaaaataaggtttaattagctcgtatctgttaggtctcaagttcaaatctctacttatatccttagagtgaagtaaatgtacctcggacaggacaccatccccttagtatcattctccactgtcaagaaaaaaaaaaatcatcccaaaatgggaatggatgtttctgaattttcaattctaatattataaaataacttttttatctctctttttcttatcgtattacttattatattattattttctcttttttatttctttatctctgatatttttggtgtaggaaagaaaataaagtaaattagaaggggaaaaaaagaaaaataaagaaaaagtgtgaaaaatgatttaactttgtaaattgtttagtataaaagatggaaggaaagaaagttaaaatgtgtataaagtgacataaatattcctaagaaaaacgcgaaatatgtaaagatatataagaataacttgatcttttaattatagaagccaaacgatagaaggaaagattgattacattactccatccacttgcttcctctcacttttcatgtcttccatactttaagtgtaaatatgcatgagtatacacaaaatattattcaaatttctgaatcggtacatgtagcaattattccacagacataaatttaacacgtcatatttaaatacaccaaattaaaaagatatacattattaaaaaaagtagttaagattatcattagaaaagtagagatttttttagtgagaattggaaatcttgattcaattatattgtaggagaccaattctttccgcgaaacccaatttctgttggtaaactatatacatagtgctatcgatcatgttgagatacaaatatagatggctcgttacttcattaaaaatttacaatattattttgttcatgacttcatctatatctttttattcatgcttgcaaattacaacgcgatatacagtggtggatccaatttttgtttttcagtgagaacaagaaaatagtctacaacatttatacagaagacaaataatatcaatttttataaagtatataagttgatctttcttcgtgtatgtgtctatacaggcacacgtcaataaatctatgttaaataagtaaaataaatataaaaaataaatttttgcaagttagttttagacttttagtagtagtaacgattttgtattattaaacaattatacagtattctttgttaatcagcttgaactgaattggtccttcttctctccacatgtgtgtgtcaactaattcatttgcaagttagttttgggaattggtagtaggattgattttgtattaataataatttataggaggatactctgataaaaaaaatataagttattcatttataagtttattataaaaaatctacgtgtattacatacagagagagattttttttgtttaaatatatagagagagagaaaatagagtttagttttgatatattgtgttactgtaaagatttttacattattaattaaataattaattacacctcattctaattataacttttaaagtaaatattaaatcaatatttccttgattatataataatttatgactaaataacattaaaaaatgtatattactaatatattctaattaaattttatatgcacacgaatattttttattcgaatttaattaataaaatgttttcataatagaacgtatccttaaaagacaatcgacctttcaattcaatcctattctgccagcgcccgcaaccatatctgaattattaattcttaaccgtgaattctattttttcttttcctgattagttcaattctccagactttaatttgtttttacagtatttttcagactttttgctaatacaagataatataatgtatattttctaaactgtgtaccaaaatatccttcatgccctggaacgcgttaagaattcaagcttggaattcaacatgttctcgtagcacattcatcaataaattctgtgcatcaaatttttcgtagcgcattcgctaatatatatttgtctttctagttggatcttatccatgccatcgcccatcaggaacacacgcggtcttttatgttatatttcgtatagcaaatcattttttcttataatccaaatccaaatccaaatgaataaaaatggagtatatgtttttaatatattttttgtattattgtatgaaatttatatggattctattaagtaaaatgactttagtattttattttaattttaggcttcattgtatatgtatttgatctctcagttatatcataattctaaaattttggttttttaaattctaattgtgcaagtttgatcttccagtcagatgtatcaattaggcgattgtcttcactttgtcactccttcattagcgtcacacgatatgatagtgtatcaatgatatgacaactaaattatagtctgacacactatagtaaatggttattaaattatttatagtaaatttattaaattctataatattatcataaattttgttcattggtaatataattttttttacatcaataatatatataaatattattattaaattaaaacgatttttttgacagagtaaaaataaataatagtacgtagaaatgattactgtcactcctatgttaatttgatgcatgaatcgtgcaatgaaatttcaaatttagaaaaaagtatccaaaccaccatcaaaaaaccaataattgtaaagtggttacattttaaaaagttaatggtaacgtataatttgattaaaattaagcttaagctcgacaatgtgcacccagatttctgcaatattatattatgaacgaaacctcaatgatcaaaatcaagttgaagactctcttactcccttacttcttcgaggagatttggtcataactgacggccaacttttgccttattaggtatgtttcttactcctttacgatgtatttttttcttcatttaaacaaatattaggtgcatgtattcatttacattttttattagtaagaatcaaagaatatcataaagtttcccataattcatacactttattcaatcaattgaattaaactctccatagatagatgtaatccaaaatagaaatgctaaaaacacttgcttttttcttaaataaatattaaatgtccaataaaagtaaattaatggaagtgctgcatgtatgcataatgcatatacaaaggcggatatatttttaagatggaactgttttctttttctttttctaaatgaagatggaactgttaacacttaacacggtagatgagtatattgttggtattttttaatatacttatgtgttagttaagtggcaagtatttttatatatttatatttttaagaatttaattagaatataaaattagcataaaaaattataatcatccattcacaaattattatatatgatatgattgttgagttttaaaaattatacttgaaatgaattttaattgattcacaatgtataaggcatttcattgataaaacatagacaactgatgattaagttataaactcaaactttagatagactcatttaaataaaatattaaataattcatttttttacaaatcaaacctaaactttaaatactcaattcagtttcactcatttacagcttgtgttgagacgtacgaaagctagcaactaaaagctgatcatcagtgaaatgagttgaaagcttttcaattgtgtcgtttggatgatgaagctgaaagctcagcagaaagtaggccaagagatatggggtccactcaaaatattttcatctttaaaatgaggtgaaagcaattggaaaactgtaatgtattgtaaatattaacattctaacattgcccttcattacatgcttgtgagactagtgatagtcactgagacctgtgaaaactttcggaagcacatttcaaatgcaacttaaaacttttttttttaaattaacaagcacataatcgatatggttatggttaacataatcgattatgtccattcaatttatataaaaaaatgaggcataatcaattatattccttttaattttaaaaaattatcaaataattaggaccagctaaaaaggaaatttcatctgggttgttgaacctaatctagcatgaccgatcgaacctgtcggaccggaacatggtgacttaactgggttagtttcactattggatcgatcatgtaattgacttggtcaaatctgactgggcaaattatcgaatcccaattggaccagttcaaccttaccatgatttaatttaaaaataaataaataattttggaattttttaaataaaatttgaattttggattattattaattgttattttggatatggataaaattttcttactcaaataatgttagttatatatttatatataataaatatataattttaaatttttaatatatattggatcaaaccaaatcaattattgatctaccagtccgattgaaccactgactcattaacctattatctcgaccaatcaaataaccatatccaaagttttacaaatatgaatttcacacttgtttaattttaaatttgttttcttttattttctacctaaccactttaaattgaaattttaatcccttttcaattttcaactctctttttcatttataccgaacaatctcacttttatcttttttcatgtcttacacttttatttttttcattcatctttatcaaacacaatgttaatgttaatgtgtttttgaatttttatttgtgataaacttctgaactattttctatgttaaaacgcactaaaacaaattatttgttgcattgatggagctcgtcttattttcacggacagaaatccaaacacgtactacatacataatatatcaatggtagtattttgtatttttattttactttgtcaattttgaagtctaattattttcctatacgagcttgattccttttctagtttcaactttctaacttctgaatgaaatcacgacctgaaatttgaaaatcaaaagcatcaaacagccaattatattaaattggcggtcgtgggcttccactgtccgccctttaggactttacttcggaatttctttttctttttctttttggtgtactacttgagatttgagaatgcctgacgtcataacatatatatatttggtatgcgaagtatttatattttgaaaattgaaaaaatattttgataaaaggcatattataatttttatacttttttaatcaatatagttatctgaattattaaataatactttttcgaagactacttttgtgtatatatttttttaaaaaagctaatactatcaataattcaatattaccatttcaggtgacaaaacattgttaatgtaatttaagaattaatccattagtaatatcaatggaagaacatcacgtctgtgtaacaacttagagattttgagaacgtaaataagtcaaattaggaatactatacaattgtaaaaggttacaagataatccttgtcataactggtttgatattttaattttttaattaaagtctgggatttaatcatcggtttgaatataaaattacaactagagataacattttatcctaaaattaggttgacccaattaaacatgattagttggatgtcaaatattttttttaaatacatctgatcagacaaaaaaaagttaaaagataacgtaaagtatattttttatcaattgttttgagtgattggaaagaaaacttgcattaataatgtgtttggattagattaacaatgaaataattaattaaatttccatgttaattgtaaagcaacaaataatatttaattttttcatgatctcatcatgattttggtagaataaaatgattcttgtatgttatccaaaaaaataataatcattaacaactataaaattaataagtttaattcttcaataatgattaatcattagcaaaagtaagtaaatactttacactaatagatagtgatccaaaaatcaattgttttaataggatattaaaaattaatagtaattattgtgtttttatcacgcttagtgtgattttcctcaatttgcacagaatgatcttaatggaggatacatttggtctctctttctataaacggaggaacaacctctgcaaaaaaaattcatctgtttgacgtgaaaatgaaaagaaaaagaaaaacacacacaaaaaaaaaaacgcatgtcttcaacaggcaaccaaaaacgcgtgtaacatggacatggaggctaatgctactttgttgagtaccgtatctacattcgatttctctatttttagaggttcaaaaaccagttaggccatctactctggtgttgcaacctgctattgtgacttgtgacatccatcacttctaagacattgttcaaatcttcataatttcgttttggttattttttagttatgttagattataagttttcaatattgatggtgcatgactaatttaactatgcatggtttgtactatgtaatgtactgtattttttattagaggtgtctaatttaattgttatggtgcatacgtgatttgttttttgaaatacatacgtgattttttgttgttctatataattatgtaatttcattttgaacgattgattatgactcaatttattatattttacatttggtcaatttattttaatatttatgaaataaaaatttatttggaaatccatatgaaaataaatttaaaatgctggataaagttatggtgaaaacttaatagtaaaaagaataaaaatcgccgtctgtggggatcgaacccacgaccacgtggttaaaagccacgcgctctaccactgagctaagacggcttatatgttttacaattaaataatttaatacttataaccttaaattgcaagtgtagctcaagccttttcgccttagataaaattggccaggatctatatattccgtaaggcttaacaagctgtgctgcagtttcaagcggctcgaacctcaatatctttccaatattaaatggaattcccattatctatcgatgggtataagcattcttttcatcctactacgtataatttccaccacaatcctcacaaatggtgtttaagattctggtattacctctcatatctcttccccattagatattttcaatagtttttgttcttaaataaataagtctgttactctgcttgataatttttcagttaaggtttcaactattgacaatgttcaattaacataaaatcttacgtgtgttgtatatcactatatccctttttttaacgagtcaatctaatttcagctttatttactgtcagattctaatctatctgttaaactaacttttgaggaagattgttacggttgaattatatcagaagcctctatctccttgagacgtgatggcacaatgcctcaataaaaaagactctagctttacaattttcgcaattgatactattcatttttaaacaagtggtgcacatgatgattcgttgagcctatggtactctagatcagggtgtgatcacacagtcctataaatcctgtgcaataaaacccccctgagatcccctcctcttgattcaaagtgttgttttgtaccttgatcaaaattcaaaagatcgtctttcgcttctaatactaatcggatcttttcttttcttttcttttttccctctcgcaattgttgatgtcttgatgattgcagccgattgaactggggatatttgatgcagcacatatctgaggctttctcatgaatcgggatatttttttgccatagggagaactacttattctaattttaacaggtcaatcaagcagttcatatctaatgatgcatagaagcttctcccacatgacatgttgaaatcagtaggcactaggcacagaatgtttcaaacgcttcactgatatccagtgaagaacactccttacagaattttttaaattacctgtttccacgtcacgaattaatagcacagaaattccagcatgtaatttttttggtgcatgtccagcatgtagttttatgcaagctagttattaaaagaaattaataaatatgtcagttttggaggcattcccagtagaacttcacttcccatatttcttaaattgcaattacccaactggttcaaggggataaataaaaatggaaacaatggatcaactggctcgagtaactgataaatcatttgaagcacaataagaacatgcaccttgcaattcaaggatcaacaaatttatgtaatctaaaagacaagccattgccatgcctaaaacaaacataacacatccacaaacaatgtggcattccataattataagagaaatgacttcagcagtatagtagctccctagatgaaacattccaagtgtttatgaccaatgaattcgaaaagcaaacaattaaatcaataaccaaacgattcccgaaccagggtaaatgcagaccatcaaaatccatgcaacaatagaaaagataacatattgctcaagttctcatggaagcaacacacggaaaactcattcctacactgaaaatgaacatatccaaaaccatttgtattaccaaaatcgcattaatctcaagttctcaacatcattttcctgaagcagaacatacctagactagtaacagcccaatcacacataaaagaaacaaagaaggaaacaatgttgagactcaaatcaaatctcctcgtccccatttttcaaattggatatctcaacagtcccaaccctctcattctccggcaaaaccgaccaattcggagactgcaccgcgcgcagccaccggaaatcatccacattgctccaatttccggtctcggcgtcaagaccggcaccacgaagatcctcctcaatcccttcatatctcaagcaatacggcgcaaacctgacgccgttacagtcctcaattatgggcctgctcctaaccctaaggtagaaatcgcttcttttggcaccgtgaatccgaatctgatgcgacgccaacgcaaacacgcaaccctccgcttcctcaatgagaacggacccggtcacggggcccacgtaaaccctagaattcttcaacctgtgaacgaaaagcgccctcacagaacctattatcctcacttggcaggaatcgagatccgaaacggtgaattccccaacttcggaatccctgaagtcggcaatcaaaagctcaccggttttgtttcgaaaccccggcgagtcacgcggcgcaaggcccgtggagagttgagggggttgtttgggtattggaatagcgcaatccttgtcattgtcgtccttcttgatggtggtggtgggtttatttttgaatgagaatttctttttggggagaagttgggaagtgaggtcgtcgagggagtgttttaagtcggagacggttttgagggaggttctgacgtcgtaggagggtagggcgtaggagttttcagcgacaagtttttctaaatcggagattgattgggagatttgattgaagtggagtttgaggttggaagggtctgaggaaatggattgggattgggcgagttgggactctatggaggtttttagatgggagaagcgtgaaagtatggaggaagtggaggattgtgatgaagattcggggttttgtgaacggatttgggtgcgtttggaaaggcgttcaagcattgctaagtgcttcttctgtttctcctcctcctccattggtcttttactggttgagttgacctaattggaaggaaatggattgatcaatcatcaaagtgatggatgaatagagatttgagttatttaagatctgggttccttcggtgtggatgaataggcaataaagaagctaaccaaccaggtagctcacacattcgcgcttgcgcatgtggcgttcaagggtactgtagagtgtggactgtgtgtagttgtgcgtctttttgtttttggaggcggacaagtgtgccaacttttcttgctgggctgctttgggctgttacacaatttaatttagataataattagctaaattttaaaaatattaacttgttttaacattttttaagtaaaaatttaaaaaactaactttttttaagtttgataataattgatagaagaatatttaaccaataataagttgttgattatggactcgactctcttaaacaagatctcatatttgaattttgtaaatggaaaaaaaatgattaaaagaaaaaatttattaaattttaatcattagcaaaatgggtgaaaactctgcatcaatgtcatggtgacaacaaaaaacaaagaatatttaaaatttgataaattgtgtcccttccaaaaaaataaagacgaatgtgtttttttttatttaaaaaaatagattttaaatttagctttataggcaaacagtgagtaatttaagttatttcgtgaaattataagtacggattactttcgttccaatgttttttttattaaaaaaaatcacttagtacaaaattatttatatttcagtccttgtttattcttacatttccatcatgtttttatttagtacttgattatcatggtagtacgataaggtccacctttgcttgtactctgtctcattattggttttcaatggagcctctgataattagaaccttttttcatttctaaaaattgtttatcaagaatcatgtttcttaaaaatcataatttctgagaatgttacaaatgtgtctggtatatttaaaagattcgcaagaatgttatcataaacatagctaaaaaaagtaactttcatggaactttgattctcttgaatatacctcaggtgatacatcaatttcatttcaaagcgttaagatgatggctaaatgattttaggcaagttctctgttccaaccaacggggttgagaatgtaggcaacaaaatgagaatgtgtggatggatttgtacacagtaatatatagtgcattaattagaaaagaattaaggaattaattaaaaagtagagaattaaaatgtaacaaaggaagattgggctgtctaacttaacttcaaataaaaatgagattaaacatcgcatcatagattattagtgcaagaaaattgtaccaacccactgtaactaataatcttatctctttgttgaacaaattactaacggcaatcaatgtaatacggaagttttctcttcatcctttgttatcaaggatctgcagtgcagagcaaacaaatattgtcacttccattcatagtatttttccttccacagttttttaagaattatgatgcccaccggtggaataaattatcacagacactatgcatgaataaacaatgtatcaccattcatgtgattcaatccggatcaactctttcacgcaacatttggttaaagagtgtacagcccacatgccatatccatgccgtgcacaaccaattttcaggaaacaacacttctctcattaatcaccttaaacacagacactgcatcactgatataaccacatttactatacatgacaacaagggaacatcccacatatacactactttctaaacccatcttaaccgctgaagaatggatcactttcctcctctcaagatcctccaatccacaacaagaattcaaagcactggtgaaggaagattcatttggaaccacaccaattctcatcgtttctccaaacacctccaatgcctctcgatgcttatcattgaaagcttaaaatttcaatttggtaacactgtttttcccgtagacatcatgacttaaccaacagaccaattatcctcaaagctaaacataacttccattaaattttctgctgtagggtgaaccaggttttcatcaatttggattttttatctgtatcatcagatcctaccagggcatttaaaaggcaagtcactgcttaccatttcctagacccagaaaatattacaagaactacacctagattacttgctaagaggcaagtgtttctgcttaccattacactatgagtgaagttttaaaacaacataattgttaagtagtaatcaaaaaaggaagctataactaatcttaaatcatagctacaatataccaccttcttctttccactatctctccacatggcctgaaaaggcacaaagttattgaagctgaggttgcagatttataatttgaaaataatcttgttagattggggaatgagactgtagcagaagttactttcccaaataaaacagtcataggattaaaaaaacaattacatattggaagggtacaactttgatggtcaggactgaaaaaagaggtgaaaccaaagcatgtatacatgagatgagatgccattgctaaatttttttgatattctaatcctttccgtggaaaataagattctactacaatagaaaatgaaggagttcaggagattggtaacaaggtatcaaccaggaaagaaaatgcatccaaaaacaaagcagacacacaattagcaatcgccaatagaatcatccaacaaagtaatcaaactaaggaaacaccaaaagtattcacgctctctgtcatgtccatacattaaatggctaaggttctgaaaccattaacataatttaaaatacattcatacaagcaagtgcaggtagcttacaatatggcaaaaccaagcttggaactaaccataggagcacattggcactttgccgtcgaaatttccaatactgtctattctattatctcttcgattatagagaacaaattcatcatatatgcagtttggaagcatcatcatatcatcactttcagagatgcacaaaggcgtggtcagcaataaatctaattcatgagttggagagatttgaagattctgataacttatattcaacaactgagtccaggatttctcaactccaaattccctcattagccaaacaacgaaatggcttcttctcctatgagtgtacgaaagacacaggcaacccctcaaagccccaaccttaagaggataatcaggaacttcagacagaccatcaggcatggacaaatatttatatgtctccttatttagatcatacgaaaaaattactaattgattgacagtaacagtgttccattcataatcaatacccaacatgcgaaatgctaaccagttaacgttaccaccgacaagatgtccgttgagtaacctccgactaatgggaaaagcagggcaagttaaaatgtttctccagcaagtgtcgcccatgcagtgaagtctcacctcccaattctgtgatttagtattgaaacagagtgccaccacctgtaagtgtcacgccaatcatcgtaaccaaacccaaacttcacataatcctctaaaagtatataatcgcgtcgacgtatacgtaagtgtggcgactcttgggacaggatccttcaaaatcgtacccagtattcaaaattacctctacctctaacagtaaattaacgcaagccaataaacccattgcaggaagctatgaaagagtaaacgtcattgaattggtaatgatcatcaaaaggagcgggtgtggattctcctcaagcaaacaacgtaaagtatttcaagaccgtcagtttctttttcatcatcttcgggatcttcttcttcttccggcgttaacaggacgtgggcgtttgtggataacctttgaaggtgcaatttgacgaaggtggggtggaagataagggaattccaagtcttagaaacgcaccagaggcttcaccggaacccatgacagaatctccactatcagctcctcagggagcaccatcgccatcttacactgatagctctttcaaaaccctggcggaacagaactcacggctcattcatcattttggtcttttttataacaacatgaaagtgaaactgttacaaaacactttacagtttataggcttgggtctgttttcaccattgaccgatcaagattatcttttgacccgcagaacgtgtcatgttctccttgcatctcctttttaaacttgttggttgtgttgcagctagcacagacatccacgcgatacttgataaatcttacaaaaaaagcatataaattttaacataggacacattttaatattaaataatatttttaatttatataatatatatttcatttaaaatttaataatttaaaaaatattaaactaaactaatgatatccataaatataatccaaaaaaatttatagagactgcatttcattctacaaaacagaatattcaatattaaaaaaataaaaatgaaaatagtacaagtcaagctacaagattcactaattcacttgttcaagctaggcacagattatcatttattaggtattaaaaaaataaaaatagcacctagacacaaattatcatttatcatgtattaaaaaaataaaaatagcacaagttaggcacaaattatcatttaccatgtattaaaaaaaataaaaatatcaggtattaaaaaataaaaatgaggtttcaaataacacaacccatacataaacaaggtattacacaagcaaggtattataaaatattgtagtccataaatgatatttttttataaaaaaaacctacaaaaactaatcaattaaaaaaagcacttagccacccacaaaggcccagtcgcccagacccgcagcacttaccttacccccaggagtgagatagcggtgcctcgtgagaagttgaaggagatgagtcacagcgacgaggtgcgagcagagaggagacgcaagcggcggcgcgattgatggtgatgcaatgaacggtgacacgagtggcggctcgtgttggatatggctcatctttcgcagtcagatgacaacccttcttattgtcggggtcagcagaaagtcaactggggtcccgctcccaggtgagtgggcgggggtccggggggcagcgcccccaggcccgtagaggctaggtactgttgtgtaatattttacttttattagtagtttgggctagggcccatgaatagctgctgttagggtttcttttaatcctatttatattcccttgtaaaccatgtgacttgtaacgagtggcggtgaggtgattatagaacagacaagttggacgtagcctacattgggtgaaccagggtaaattactgtgtcatatctctctttcctattctctgttctgtttttcgatttgtgtgtgattgttgatttccaacagctcgaacgatgacgcactgacgtgaagggcgcgcgaatggcagtcggaggagcgaacggcgtgagtgttgtgaaggaggagaaacaaactgcatgaaaggctgaaagctcaataagtaagggttttatatatatttttttattttagacacgatcaaattcacatgtggactacggtcaacgtgtcagagatgttgaccacgtgtctgacaccgtatcagcgcgtgtcggatcgtgtccgacgcaattctgctgatatttgtcgcgtccgtgcttgataggttgcaacccatgaaacagaaagagaagctatagagagagagaacacaacacttgttgtgtcttcccgtacattaaatattattttgaaatatttttaaattaaattgcaatattagtaacatttcctaggtttcgtccattttttttttgtatttctatactaatcctcatgattatttaaaattgcactagtctctacatgggatattgctataaatgttttaaaaaaaataagaaaattatgtatgatctataaaaatctaaaactacaatgataagttaatataatttactctctcgttttatcaaagtagtaaacatttcggaattctagtccgtacgataaatcgaaacagtaacatctcattcatgtgtgaaacataaattattttatttatacttcaaaagcaattctattttactaaccaaataaaattaattcttctcaactcagttttagaacatcatgcttaatcactataataaattttcaaaatcttccaaagtcaattcgaactcgacttctattattggctgaagaaatccatgggaatattgaaaatcttgccatcgataccctaacttaggcacttgattgaaaaataatgttaaaagaaataccaactctgcgtaatcacttgccctttcaaaaacagacatgcatccccattctgattgataaattttgtcactttgagactccaaaagttgatagtcattcataaaacaaattaaaagcaattttttaatggaattggaattcttaatttaatttttcttttacctaatttgaaggatgtgaaccatgattttgataatcatgtatctttagtcacaaaataaaaggcatgaatgaaccttctggcaggaacaaacataaattactacgattaagatctattatacacgagacaattatgactgaacaataactttaaccattgaactctgtaacttgcatatttatgtgtaagctcatgcagctttttcagcttctgcagcttctgctgctgcttcttcctcccggagcttctttaaagttggaggtggtcttacaactatgcttttcttccattttttatcaagctttctggacaacctcttattgataccctcctcaatttctctttcccgcttcacagtaagcatgcgagcaatctgtacggatatttgcagtcacattatcatgcacccaaaaaaattaacatatggacaagaaatgcacagcatcacgccgactctagagaaagaacttatttgttagtaaagccctctagtatcatttcatcatcatttgaaattatacgtaaaggaaatacactaataaaatataaagatgaggctagatcagtatcgccagattgaaatgctcttcgctctttccattaggcacatcttgtattcaacatgctatcaaagcactatgatcccagtgcactgtttgattagatggtggctttaagagtaaaaacaaaataaaatgattgcaaaacaaggactaacatgcagaaaaagattggcatatttatccattacagctcaattgagtcaaaattataagtttataacccggccaaataagcatcagaaggtgcttggagttggacacacctgggaacagaagttaaagacattgcacactacttcataaagaaactgaagtgcatctagcagaactcaaaaaacatgcatataagagaaacacctgatcaagcaaaagaaaaacctagttcaagtattcctacatgcatgttgaattactttgcacatgcatatctatttctcacagtattttcctgctcatagcatagagagatgtgatgctcatacttgaattttatttttgaagtaaaagtttggcaggtctcattatttagatctataccagaaattggaatcaaatgtaggggttgaaggaccattcaattcatcaaagggcgttgatctctaggcctctttacttggccaatcaccaagcatagagctgtcatttctggattagtagcaggtgggtgtgccaagcccagattaccatgaaattagttgctggtcttactctgatcaggttagttgtcggcaacaaatgacaatttgtttctaagtgagccctctcacttgggagacccagagagttcagacagtatggagtaggagattcaaatttatgaccatagattggattgatctatgtgaatctaaccaaacaaaactgagttatcaagccatcatatacagtggctggaatgggaaaagaaatccataaagggagggaaatagtttacataaatataaacatatattgaagcatgaaaaaaaaggaagcagaaggtagtggattaatttgtctatgcataatttgtgcacagagcacgccaagctcaccctttaccacttcatgaagtaaaacatatgattagctgagtacatgagctatattgcttaagggtgcatttggataaacaatttaattgtgtttagttgtttactcaataagctcttatcatatgaggacttgtgtcataaatttaatcataaaacttattaaagataaaaagagcttattttaacaagttactctaagaaatttattgaaaaaagctcaaagcaacttattagagttataagctatttctagaagctcaagtaagctcatcataagctcagcgaaacaccccctaaaaatactaccaaattggagcctttcacctaacactcgagtaagttttaaactgcaattgtagctgcatcggctgcattgatctgcaatatcaaggattgcaacaaaatcgcacccgcaacgtcaagggttttttgggtctacacaaccacaattgtggccacattggccaaatttgtccacaatatcaaggattgggacaaaaccatgtccgcaaccgcagtttaaaacattctcaagctaatcacactagctaatttcattataaaagcagagaaaagcaaactaaattctctcacaaactcccaaggctagcttgtaacccagaacaacaaaaactattaacgtgattagattatcttattttcagttcaaaagagtttataatcaaaatcatgacaagggaacttaaagaagaacaaagagtgaagcaaaaatgaagcaccctcttgcgcatgcgaccgaattcgctggacttgaactcgttgcgagccgatttctgaaggcgaagcatgacaagctcgcccttaaggtcgacaacctcttcgttaatttgttcggtggtcatttgtctaatttccttcaattcctccgtcctcttagacatcatcaccaccggcaccgaagcgctgcgtttcgtgggtggaatggagcatgtggcagagcgacggagctgaatgccattgaatggcttcgggagaaaggaaatggttgaagaagagggtgaagcaactgagagacttaacattctccacgctctctctctctctctctctctcctcttattaccagcgaagtggattcagagtgttgcagataagaagcaacttcttcttcttttatcggcttccctgcgctacccgaaatctcccttttattcctctttttcggggaaagaaatgataaatcataactatattttattctagttattttattaaaattcgttttggtactttacttttttaaatattttttttttattttttaatatcaattttttaacataattttaaaatatactaattcaagacgtaaaattagttccaataaatttacttacgtgaaaattataaatcataaggaactttcaaactaaaaaatataataaacatgatgaaaaaatgtgcaagatgaataacactaatgattataaagaaaattatattaaattattcaattttttgattgtaagtataattcaattttcacctcatttttaacatgttgataaaaattcaaaatagtattcttaaaaaaatgatagttgtttcaaaaattgacccagtttgtgtaaaaaaaaaatgtagttataatagtttgtccttaaagtttgtgaaaggaataagaactaattaatatcgcattcatcattttttaaggtttcaaattattcttgtatccattccattagatttagaagaataaggcaaagttacaccatgtagtacctccattttcataaaagtcattaaacaaagagtatttatccatatattttaaacacgacacaaaccaattagtcattcaagaaccaataagtgggttaagttaactattgtatcatgtatgttattggaccagtgcgacgacatcaaaaccatcatgaaattgggttcaactcgtgaaattcaatcttgagtggaccatatatggcccaaggtatgtcatatgcttagctaaatgtgcatggcccaaggtttttactccctttgttataaatgtgtggcccaagtcacgatgttgtgcatccgaattgtcggtcttgctcataggtgtacatgtgttgttattgatggctttgatattacaaatacaaaaatgaacatactagggatcaaacctatgtccatgtatacatcaacaaacttacttaccatagcgtcataacaatcatttgtgatataattgcaaaaactaatacatatattcatattttgattttaatctttcaatcagttaatacaatttagttagtaaatcactagttcaaccatcagttcacccctttagaaaaacttttgcttttcccaaaaactagattaatcttataatcactaagataaaaacatgttattttccatgccctataagaggatagtaggtaaacacatttctgtttgtgcacatatgtcgggtagcccctatagtctactgtaatttttttcacattggtcacaatattcacctaaaaatcaaccgcaacgataacatctcctcctttaaccaagttgaccctaggcttaagaggattgtcatttcttgccaatattttttttcatcgatcacttggcatttttttttgtttgtatccttaattatgatatgtgcgattaagcctagtaatgacatttatttgtgtttgtatggttgtatttcagttgttgtctgtagtttatccatggttatggaaacttattgattagtaactttgatataaacttatataaaaaaactaaaattacttacctcattgttcagaagcttgtttccagatttgaacccatgaccaatgagtcattaagacacaactttatcgttgtgcagcgctcgctctcttgatataaacttatagaggagaaaaatattttcctacctttaactcttcaagttttttgtgatatgtgttggtctagagtttgatgtcattgtctttcgtcatcttccaatcataatgatgtttttatcatgagcctccatttgtcaacatcctcaacaatgtacttcaagatcataaagtcataaatccatttcatttccttatatgaatagtagacgtcgaagagattgttaaatcaaaatactaattatggtttgtcaacaaatcttattggcatatgtgaactcattgattttttatgatttgtatagaggtttgactttgggtctataaaagtagatgcaacccatgcatgtccaactttctctaaattaatatttcatatcctagaaagttcttgccaacaaagagtttgatctttgacacatttggaacaatttggcatacatggccaacaatgacaaaagcaacatgctatggaatgtagggttcgacgattgcatcttcatccataagttattgatattgtagtttttgtagccgaagaccattgacaatccaacacaaataaagatgaaaagttgagatgcatgtatccttaaagacttatccgcataatgcacatatcctcaagatatattaggtctttctcaatatatatcaagttagcaaatatagtaataatgaactaagtgaggttgataattcataaattttagttgaaatttattgaattttcattgagttgaaatgcttcaaataaatttgaagtttattgtacacaaacaataatttagtttcaaaataaaaaaaataaaatgtcatagatacacccatgcaacaaatgataaaaaatatggacaaatagtttatgtgtatttgctgataatttagttcctatacttttaaaatgaataattttaattcataagtttatcaatattgcgaaaaaaaacaaatgtgagcgaatgtatagactaaataggctatttaacttaaaataaatccattatttctttattatttttcgcttaaataagtttttcatatctggaaataggccgtttttagattactaccaaacattcattttttccaactaagtacctaaaaaaattatgtttcaatgtagtacctgtcgttagtccccttttgttaagtgtgacgtggcagacatagtgtcatgtcatcaagccttgtcactaacacgtcattgccatgtcatttccttcttcccttttcccaacggaaaccactaccaccgtgccatcatcgccatccgacccaacatcaccacagccaatcgagccaaagcgtgtagggcagcgtgcaactggaactgggttttgctccgaagcatgtgtaatggtcctaaaacctttctcgacagtgtgaacaagtggaagtggaagcgcatgcacgagaagctcgccagagacaaacataacagactcatccaataagagaagcagctctaccaagcttgcattcgctcccacatccgctccaccctttcccccaaccaccactccaccgcccccgccacccaccgccctctctccccaacgaccacgtcaaagccctagtcgactacttcatcaaagacaatgccaaagacctctagaacaaccacgacggttctctaactctaaacccgacaacactaaaccttaatttttgccccaagcacactaggggttaccattctgttcctgaggttgggaacaatcgtgctgaggcccacaaatataggttttggagaaatggtagtgattattctacgtctagtgagagcaagagtgagagtgaagttgaatcgagtgtgaagaagaagggtaatagtacttctttaggggaatacgatgtcaagagagagaagagggttgtgcccaagagttctctagagattatgcgagatcaaaaccgcgatgaggaactctatgaagttcatgagcaacagtttgaccattgtcacgaaggagaaggggaaagggttgttttttattgacagcgcagtggtggcgcaatgacgcggtcggtggtggtggcactggattggacggcggtggtggcatgtttgtgatggttttcgttggaaaaggagaagaagggaagaaatagaagtagagaatgacgtgtttaatgataaggattgatgaagtgacatttcgtctatcatgtcatcatttaacgaaagagaattaaccacatatattaagttgaaatatgatttttttcatatatttagttgaaaaacaaatgaatgttaagtaataatctaaaaatgacatattttttatatatgaaaaattaattaagcctttatttttcctcaatttttctttaaattttcatcagcattttcgtcctcactctctcgcacgcgaaacccttgtttcgttccctgctcacgtatctgtagagaaaaccagacacaagaaaaggttcgttctgagacaaaaccccaacgatccaaacggtcattgagcatttcatggtgcgagtcactgagttgaatcggataggaatctgagtttgtgatcgtttaacgcggtcatgggtgctgcaggctccaagcttgagaaggctctcggagaccaattccccgaaggagaacgttactttggcctcgagaatttcggcaacacttgttactgcaacagcgtcttgcaggtctttattccgatttacgttttttacttttccattctatttttcgcgttctatagagactctaatctgttgtgttgatggtttattgattcttctatgcaaagtttgttgcagtttcatatgtatcttcaggagagagtttagtacttaaatgtatattattgttttggacattctgttgacctgtttagcagattcttttaagcgctgattcttagttttattaaactttgaagttggatttgctcttcaatgttttatatgtttcattcaatagtattatatgcgtctctttagatgcatacgtcaatttaaaagtagttgttgtcttgttgcactcaatatgtttaccatctctaaaatatcaatgagggcactagatatgtctggtgataatacttgaagacggtcagtttgttattttttgtaaaggcttttagggttctttgctaacaactgtctcattttgccaaattgtacaggcactatacttttgtgttccgtttcgtgaacaattactagagtattatggaaataacaaaagcatattggacggggaagaaaatctcttaacttgcttagcggacttattttcgcaggtaaatcagtctttagtttggaaatttctcaactttacatgcttaatgcctctaagcttgttcatatttgattgggtcaagcatgattcactatttgaaagttatactgtcttcactggttgtggctattttgcttgcctaggactctcatgaaataagttgttgatttcctagctttttttttattcttcatttatttaataataatatgaaacaagtacctttttgttctttgcatgcttcactgtggttcttgttatctttattgttgaatctgtaaccatgttttctttaataacattggccattaaatagacagctctgaaaaaactcggacaaatacattgcctccatttaatccaaaatctcgctctcgtgatcgcaattaagcacttgcttttcctcatagacttcctttttctaaccgttttatggaaggatttttagaatgttgatgaaagatgctcctgtaacagagaaatctgcatgccaatttatttagtgcttcagtacttcccagcaaagcatactgtgggttttattctattgatcagttgaagtttatcaaaacatgactagctacttataatgcctaaaatatatatgcccagctagctgacatttttgttagctgttctatattttagttgctctttgtctgagagacaaggaattgacaaaggggattccatgtttatctaaatttcgtgttgtaatatgctcgggtataaatgctattattttttttgcctgttgtatggatgctattatttctccttgagaaatttcttcatttatccacagtgtgttttatgttggtttggcccatttattttatttgttttccccctttctgtttgccttcaagttatgtgaaattggtttaggcaattttatgcttccctaaatcttctttatagtatgttcgagtatatttttgtgtgcctgaaaatggctctgcgctatttcatcgtgcttttgcaagtatttccattttgtatatctatagaatttttgctcaattcattgtttcaaatgtctaattaataaacacatgtctatttaatgggcacttacacggctatctcttatgcctgagaacttgcttcaagatatttgtagtgtgccttttgtaagtatcttcattttgtatatgccaaataataccttccatttattatcgctaatcaaatgtccatttaatggcattttcatgcctatttatttctttcttggtcatgaatgtaatataattatttcttttggtgtagataagttcccagaagaaaaaaacaggtgtcattgctcccaaacgatttgtacagaggttgaaaaaacagaatgaactcttccgtagctatatgcaccaggtatgtgcttaaactgtcaaaaatgaacttcctgagcagaaaggtgattattctagaaaacctgtaaatttcttttgactgtaatgtttatattataatcaagagattagttttatcatagtcacacatgcaaatgttgccatgtatgcgtttctccctgcttatgaaaggattctttgcttgtgggcatcgttcaccatacacaattgcccttgctcccaagtagcagcttatttaaataactagagattctatcatatgtattaaagatttccagctggctatgttttgaggcaaattactagttgtcctcttggtagatcaattattagataagtatttcttttgtaatgcttctgtgtagtaggttggaccaaattttcagatttgcaatttgtacacttgaacttggtgtgaacatcttttaataaactggaaatacttttgaactatttgttataatattaagttgaaatgctcatgttggttgtacacttttcagtctttttatatgcaaataagtctgtttacttgaactggagcatatacactttaaattgtatttctattatattattatatgtcctgtgggaagcataatcttttttatatcagttttccatttggcaacaacccttttcactttgtctagtcatgctttgactgtatatcactgatatataaacggtgctttggcttgttagttccccagtcccccctcccctcttttgtgagtaaataattgtgactcatgatgagtgtccatctctggaaatgatttattcgagtttgtataatgacaatttgttgcttttcagtgaggttgtttaccataatgttactgaactcagtgtgctgtaaagtgtattcgttatttatcattgattgttattatctgttaaattcaatgtttcattggttgcataatgtctcttattttgtcaaagtttttcattagagacaacattgttattgtgaatcttctcttggtaggatgcccacgagttcttgaactttttgctgaatgaacttgttgacattctggagaaagaggctcaggctgcaaaaactgatcaggagacatctccaccttctgaaaaggctgttaatgggcccaagaatggtcacgctaatggtgttcacaaagagcctttagttacttgggtacacaaaaattttcaggtggccttgctttgtcaattcaatgttttcattttgcattttgcctgcaacaaaatttgaagggaccataattagcaaactttctatcggatccagtcaattagtgttatctctttaagtgggcatgtattgttacatttaagggtaattcattcatattggcttttatgtgaattataatggaatttggcatacggttatagtactaatttattatagatgaactttattattaaacaatgtaaaacacagtaatttcactgtcaatttttatgtatttttcttgtgggggaaggagtgtttttgttgctctttgtactctgtagtaatcagaagaataagatttacttttatttttaggatttttactgttgtaacttgctctgatcagggaatactcaccaatgagacaaggtgcttgcaatgtgaaacagtgacagctagagatgaaacatttttggacttgagtcttgatattgagcaaaacagttcaattacaagctgtttgaaaaatttcagttccaccgagacactgaatgctgaagacaaatttttttgcgacaaatgctgcaggtatatatatggcttttaggtacaaattatgtttctataattatctgaaatccgaaatactacttctttggcatcagttgttactttacttggtttcttgagtgttctggaaaatttaaagagcttgtttaaccattttgaatcacgtgcttagctgaactaatcttctgcttctttatctaagaacaatagcaataaagccttgtactactagattgaattgactgcatggattaattgatgtcattgactttattgaaaaccaaatattcagaaaatcatatttggatcaagatcatctttaatagtgtctcgtaaagttcttaggtacatcttctaccccttttaactggaggaataaattgtttgtgatctaacacatggcaaatagcttgaatatcatctatggtttatagaaaattttatctccttttaataaaaattagaatgcgctgctattcatgtttattgactaatactacaatttaaaagaagcaaactatgatacgttcatttttccattgattgacattttcttctacctgttatctgagtgggatttggtagccatgtcaatttagtgtgtaaaaatatatgtgctctgttctcttgtttttcatgttcattcaccattctgatgaccaagatgccaactttcttgtggtattagtttgcaagaagctcagaagaggatgaagataaagaaaccacctcacatcttggtcatccatcttaagcggtttaagtacatggaacaactaggccgctacaagaagctgtcctaccgggttgttttcccccttgagctgaagttgagtaacacagttgaagatgcggatatcgagtattctctatttgcagtagttgtccatattgggagtgggcccaaccacgggcattatgtcagtcttgtgaaaagccataaccactggttattctttgatgacgaaaatgtagagatgattgacgagtctgctgtgcagactttctttggatcatcacaggagtattcaagtaatacagaccatgggtacattttgttctatgagagccttggctctggtaacaggaattaggcggaggatttctataactctcttaaatcatttggacttcttttttgcatggtttccatatttattttcctttctaccgttttccctttattcaacctgttggaggagctgttacatcctctagaggatacgggttgtgaaaaggtatacttaggtggttggcatgtacagtggatagtgctaggcaccgtccttttttctttttccactttctcacaataagaacagtatatatatcgggtgaaaatttcaccaacgatgtgtattcatggttgcaagcgttcaaccaacattagaaacacaatgaaatggaaattggtcctaactcatgttagattattttatattttatagattgacgaacactttggtaatagactaatagttgggcattctttggtgagttaacaaccctgtcttcgtcgggactgcaaaactcctaccattgtcacttatttcgattaggttataaatctaaaaatttgaaccgaatcgtttgagaacaaagcagaactgaactgaatcataaaatttcccttccattttttttgtatcagtacacaacataattcggtccatttaaattcagttcatttaaattcggttcaatgaacagttcggtttggatttgagaaaacaattcgtcagataaaaaatacaattcagtttggtttaggcaaaaaaatttagttcagttcttccacagttaagtttggttcaacttttaacactcaaccaggggatatccagcaatatctaactgggaagaaccttggttcctccttacagctgactgagcatgaattgaaaattttggcttgtgtaagaaaactgtgcacggctcatttctgcatttgatagggaacctgacatgtttattttgcattgtaagaattgttttaatagctatgcattttttttaaatttatgtgacatgttagcaaatcaccccttaacacaaaagaatgagaattaagattactaatttactataacaatcaaagtgagacagttgatcacctaactctgctgggaaattccaagtcatacaattaacaacgaaagctaacttctaagttgttgtaggcatgaaaatatcttcgtccaacaatgcttcaagatcattgaggtcaccgaattctctcggttcttctgaattgttagaactgctctcatgctttacctgcaaaagacatatacagaagtctaagctctactggcagtcacaagaagatactatattcaggtagtttaaacaaatatacatataatttcttaacaagctttttaaggtagcccatccaatatacacctttaacagcttcattcgatagaagcaacttattttttggtttcaaatgaggggattcaatccggggatcaagccagtgccatttaaggctctttggctttactagaagcaaattgagctttatgtaaataactaaagggagaaaaaccatattcaggccattttttttacactctttttcagagaattcaactcctctgaagtaactcatttaaaaaaataaaataagtaatttgagttgtgacggaaaaatcaagtcatatattacatacacatgcatcataaaatcatgaatgtgttataatattaatcattaattttcaaaatgcaaactgaaattactgtatctttattaactttaaaagagccaaatctttgtacagaatgaaaactactgctgttatatactgtctagaagagaaaatgatttaaagcaggataattgagaaactttttttccccccttttttccgcgagtgagaaacttttttaaaaatatacacaaataggtaaaatacctgattttcttggatctcagttacaacattcaacagcctatggtattggtctcttgcctctggatactgaaccattgacttcaccctagccagggctttctgcaacctttgctctgtttgcttcctgccttcttttaagacatcatagtcatcatctgttgaagatacatcttgtatcatagttccctcagaattggcctccggtttaaatccacgcaaaccactaccttttcgacgccaacgtaaaataaccttctccaagattccaacggaccaaattatcttcccacagcttttcctgacctggtgacctctcacgtgagcctataccatggaaatagacacgttataaattggatccaattaaagggagaataagattaaacattcaacacaaacaataaatactacaaatgctcttagccaaaaggcttagaaaggtatagacataaataataatgccatttgcacatatcacatgttagagacaaatgtacctgaatttttactatgcgttgtcgaatcattaaaaattctcttcttcccttccaactgcggaatttgttttggattcgtactgcagcagcatggacaggctcatcacgtggtccagacttgtgtgatttcacattcatttttacaagtgaaagagcacgttcatcagataatccaagtttgtcatcatcatattccttcagttgttttctctgaaatgattgcattctgaaaacttgatgaatacgagctgcggcttgggtggcgttacacactgcagccagtgaatctttcaatgacagttcatatgataaaccatcaagatcattaacttgagcaatgttttggagtctttggactacttttgctccggaattttctcctgcgttcctgttcaaatcgagagttgtgaggtgtgcgcttagtgaagactcagcaagataccctgcaattcctttgtgtccatttgcagaagctaggtcagctggtgttctaccagaaggatgttctggacatggatcagtcagtgctccaggtgctgcgccgagagatatgaggaaagcaaccgtgcgctccctgattaagtaagatgcaagaacttaatgaaagatgacaagagtatgcaagaaaatgaaaaaaggaactcatcataacaaaagactcaggtgcatcccatcataaatggcattccatccttcaaacataatgaagtatatcgagtatcaacaagtaaaagcattctaacttcttttaggcacatttcacattttctctcggcactaatctattcttcctcacatactaatgctcttgaaaaattgcaattaatatcagtgatccatcctattaagttaatgaaatgtcaaggatgttacatataaattcaattctgatgaaatgtgtttcattcacaagcactgaggtactcacctgccacaaaatgctgcccaatgaagagaagtccatccatttacatcacgaaagttcacattcacaccagcaactattgtgggttctagggcccaatcataaccaagagcagctgcaaaatgaagcacaccttggccaccctcatctaatacattagggcctttcccttcttcagttattttctgaaggagccatgcatgtaacttatctttcagaagattttgaagcagctgctcctgtaaattttctggagaaaaatctttctcttgagtaagtttcagtagcttgtcccaatcatcatcctcctccctcattaaagaattgattttacttctcagttgagatttctcacttacactaattggatctgaattctgaggaaaggcatgccccagggacaaaagttctccaaatcgaatactaaaagtatcaaaagtgcttccactattctcacctgtagtgttaacttctggagtatagttgacttggaaatcaaattctctcacttcactacatgctaatctattggaacaagttacatagaaaggtaccctcccaaccttgtgtggcggagtatgacaacaaagaacaccttttgcaatgatcgctgctggcacttctacctcgccaaacatgcatgaccatttacattgttctgcttcatgttgacttcttaagaattctccagaaatgataacctatacaatttttttcataaatgaagaaataaataatcagaatataactgaaaaataagcaaaaaagcaactacaacaattcaatgaacttgtgatcaaaactgatggcaagtgcagaatatcaaaagaaaataccttaatttctgacccttcaaatgcccagcttggggaatagtcaatgatgctaaaaagctgatcatgagaaacagatggatccaatacataggtgtccaggtgcccttgggaaggaatagttgtgttgccaacctcattttcggtttcaactgtatcccaataaccaccagaagtggatggtttatttgattcttccacatctccaagctctttactcatccactggttgaaactgtcaagcttcttcagaccctcttcagctggaggtccatctaacagagtccttttaaaagagaaatatgtgtcttctattccattggcctctagatttgattttatcttttctttttcattcaaaagtttttcttgaagatcattttgcatgagaaccttgttttgtttgtgtgaatgtagaagacactgttccaaggatttctgaaaatcaacatcattatcttcctgctcacggttgctacaacttacctcacgtgttgagcctgaataaggactatccataggccaactggacatgcgtaaagaatcaacatcataagcctgttaacaaggatgattaagctttaatcaattaaatgagtttgaaggaaagaaacatgtaacatgtttacacaatagtcacacataaagcaaaatccattgcttgattatatatttgcagaaacacgaaacaataaagatgtcaaaaatatttgcagcatcataccaacaacactttttagtggcattattttcgagtttttgacttttgacataaatatataataccttgtcaaagctcctacagaacatactgcagagcctggatatttgtttagaactaaatattcttatataacataagtaccactagcagatgaagtaccgattttactagtacataatacctgccggtttccttcagctttaatgagacttccattctcatgctgcttagcaatactggtggtcaaatatggcaccattatctcatctccttgagaaaaatttccattgattcccatgttatcaggctgtgttccaggaaataaaggctgaaaaggcacatgttgacttccagcattattttctaagataccttcccatgaggaaaagccaaggggttttgaggatttgtatgtcaatccagcattaagaatgtcttcgattttattgtcttgagtgagtgagatataattcaccccaggaatgacatgtaacttctcttgatcatctgtctcagtttcaataacacaattcatgttaggtacagactttcctgataagaaggccagtatgtatggaagatttataacaaggtatttgattttgatgcaatattagtgtaaagttttttacactatcatgcaatcatgcacagtcacatcatttaaaaaggtttgattcttaaaattagttcaaaaaatgagtgataatgtaaatttacagtgacaaactgacaatgcatcaaagttaaactgataagaacaatttaaaatgaagaaatttacttatgagcggctgaggagaataacaatcagcaggttgaggtgaaatcttctcaacagggcgttgtaactcgaggaaagaataaaactcagaacttgcatggttattgaatgctgtaaaattacagttaaaaaatttaaatacacacaagaaagtgatacaaagaacaaagtcaacaaaaaggctactcagaatgtcctctagatatgaaaaattgaaaacagaacattttaaattattaatgcgcacaaaagaaataccagattcagcttcttcatattctgatgtttgggcactgttcatgcttgtatcaatagtttgtgaaggaacctggtaactatgtggatgaagagtagatgataaagaagtgtccatctctgttttgggcataaatttatcagtttgttgagcataaggaagagattcttcattttctttagcacttgcaaaatttgccttggttccctgattattttgaacaagacaaatgagagaaaggaatgaaggcccaaatgaaattattcatagatgggaagatatagcaactcatgattatatttattacatagttcaaaaagttcactcctgatgagaatgttagcctttttttactttttaaggatcacagtacagagtcaaaatctgagaaagggggaaggagaattgtgcatactgcatagtcatagaaaggaatatgtcaccaatttatagcatcattcaagaaaacgtctggttttgaaacttatcagaccaagtattgattaaggaagcagtgccagttttgttatttttaggcagtatatattattagcatggaaagtctagttacatgatttgggggaataccatactcaagttaggatggaatttccatgttttactttcctactaaatatataattctacaacacaattacatattactagttcattgttctcttaattttactgggaatgtaaaagtaagcaattcttcttgagcttttgtcaaataacaattaggcaaaaaatactaataaaatcgtaacatgttaccttcacttgtcgataatggacgagaacaatgtgagagagttccctgcaacaatgttgaataaaaaaggtgagaagaggagcccattccacagataagaaccatagaaacaaattagcaatttctagaaggttattataattagtttaaaccaatagaatgtgatcaacgtttacagatatatctcagtagttctagtttaaagcacaccatcctcaagcaagaacaaacacataagaagaagagcccaggttttcttcattcctttctggatattactatatgtctgtgagaccgataatgagggaaggtagaaagttaggaggaggtgagagaagaagatagagcagaatcaggcaaatgaagatagaacattaaataaataggggattttttatactgaactgtgaaaatattaagcagaaacacttactcttcaagcaaccaatatgtgcgtctttgaaaattttcattttcttctccatgggcatagtagcaatgcaacacatccacgcttccagcctgagagcatcatatcatgaatcattcaatgcaacagtttataaagaagaaagattctctcaatacattttacttcccaaagcagaattaacattaatgatagtaaataaagcttacagcgacctttgcttctcattttatggtagatgtgattgtaccagtgcttaagacttataaccttacatgcagcatatttaccttcagtctctcgtgggcttctctgactgtttttccatcttttttcttcctccagttatggccatcctttctgaagtatctcagcaccttccgatcaaataagaaaagtgaaccacctaatgtcaaggaaaaatatgataagtgcatgtttggaaggatcttctaaagtcacgttgaaatatcagctaaagtaattttaggtaaatgctcatatatttggtctcacattgagaaactgattttcagcccagttttgattaagagtaaaatcaacctcaggtaacttttgcatgggataaaagatcataaactgagttctcttgttaacttgcttttagaataaaattatccaaatataaatcacttcactcagaattaattttaaccaaaatcaattttacaaccactcactaagacccctgagaatgaccattttgcaattagatattgggcataattgtgtcaagttttcatgcaggtcccagtcctcataagatacagatttttcgaatagattaaaatcctaatcctccccgtcctcccttcaaataaaagaaaataacaatatttaaatccttttctccaaatgaagctattgagaacttaagataactagtgttatctttttggcagaagagaaacaacatacttggtggcatatgtgcaggttctgaagcaattagaaacttcttgtgattactgaggattgcacaaatttcagccggacgtagccatctatgctgtgcttctaaaataatttgcttaatatctgtgtccatcaaagcatagaaattgaaaacaaagtcaaaaacaataaatacgtcgaaggaaatgttaaaacataaagagatggcatttcaatgcttcactatcatggttgcttttgaaaaaaggtttcttttttcagaatttgaattttgtgaatgtcaaatgatgagaaatgaaatatagagaggaattaaagtgaaggaaagctgacccaattgagaggggggaacgtagtgtctggcctcagccatggaagtgagaagctgaactgatcaatgtttttgtctcccgacaaaagaaaacaagtataactcgatatttatttttctgaggtttgaggtaaacgagcactttggaaaagtctgtgtttctaaatctaagcgaaactaaaaagagagatgggttgtgtgtcagatagtattttttaacgcggagagagagtgtaatgggtgctaagagggagatgaataggatgtaccaaataccaatgaacgaacaaagaaaagttttcaacgcgggaacttgtctgtgatagcattgttgtgttgtgttgtactatcaaagagaagaaaaagacattgaaagggttgtccaagtcaaagagcattgtgtgattccagtttgactgatatttggcttatccttcctttttcgtcgcagcttctcagatttttttggcctaaacccgggattatatgacgtcattttgatatgtgctaagaaaataaatatagggtcaattgtttagaggtggacatatgtaccaaaaaagaaattgtttagagatgaatattctaaatttaatgtttttttgattcatgctggattttctaaaatcacgttaatatactaattcttgtgattttatgtaaacttttacacttgttagggaataattttatgaccataattaattttgaattaaaataattctaaataatttttgcattacttaaaaatattgtatactaagtattattattaaattttttataataaaatatttaaatatgaatcatatttttataatgaaacataacttatatcatttcaaaatcaattttaataaaatcaatttaattcaaaattattttcttagatacgtttgaagccaatggatccacacatattataacttttgtgtcatttttttttcttccctttggcgtgaaaattaaaggtaaacaattcaaatagcaaagcaaacacacatcttatcgatacttgttcaaacacacataataataaatatattttatttgcataacttaaaaatcaatttgtcaattttttttaatttaaaaagtttgttataaaataataggttctatatccaattaggtacaagatttgacacaatatcatgtcggaaagagaaagataaaaaaaactattataatggtttttaggatttgcttcatgaaggaaaattcaaatctaattagccaagcataatttttttttatgccccattccttttcctttgttcggattattattaagtaaacataaagtcagtaaaatacaacagaaagacaccattaaattgtttgtgtgagacaccctcgactccccccgcataagggtggccatgattaaggaaatgaggagaaatccccatcttcaaagatcaaatatatacatgtggcgttagtattgcctgcaaatcatctatgttgattctactttgagaactatcttcatgaactcgtaaacaaaataactaatagcagctgacggcaacacctgaaaagtcaaaaattgaaaatatcatattaaatggactaagatgaaaagcaactctccaaacttcgtgaaacaaaaagaataaagaagtttcatacaagtccatcatatggatcttgggatgctttggaacaattcatccaatctacacatggttaatacatatatagtaaattagtaattcgtcaatcctcccttatcttgcaaatatgcactactttggatgccatggatagctctgaaaaattcataggttatcctccatagcaaggagaaaaacagttattttcttaaaaattgttggtaactatttcacagccatggttgtaaagcagcttctgtgcatgacataaatacacatcttcataagaattttatgttcaagtaagaaacttcatcgaaaccaaccattgtatgtgccttgcaattttgctaaatgcattgatttaaaaaaaaaaaaaaaatcattgactatggggcataaaactcaaattttatgaaatataagtttcactttatcaactatcatccactgttttacctgtttactgaaatttaaagaacggcttttattgatcaaagcatattattaagaacagaagcaatacctgcaataaactaggaattaatccaacatagagggcgggcacacctccttgctcaacaatcttgacacaagttgccagtgcattcaatcttgttgcccgaacttgcatttgaagctgtctccttacgacttcaaaggggtaagtagcggcttcagaacaacaacccgcaatagcaccatataataaggttctgacaggacccaattccagttgttctaatgcattcagctcttcaccctcttctttcatgtgttggattcttttcattccttcaggtgaatgcagatatgctgactttaaaatatcataaataccatagtagacagcacctgaaggtgccatgctgataatagaaggtactaaacccttgtaaagagaaaagaagccctctgttttgatcatgtggcggaaggcaccaatcacacctcccaacgcttcaccaccaggtgctaccattaccgtcctgatctgaaagaaatcaatcttagaatgcaagtacaacaaaattcaataaaaaaatgcactacactcaaatagtttgcttgagtaggctacacgatattcttgacaaggacttttttgtgcaatagaccatgaacactggtattcaaatacaaccttgagcatgttttttcccccttaatatgattcaagtttaagtttttgttatttaacaatgattacaccataaacaagaagcatcatggaggaacatattcatcaaaggtaagaatgcaggaattatgaccaaagatatgcttacaacttccaaagtttattaagcaaatgttaagagctctaaacaaccatagttggtcaccagataagagtgggactaagcatccagtgaactcatagaatcactttagaaagatgggtagataagaagagcagcaatcaatcctctttagttttgccaactagctagcataaagtacaccagttaaaagacattgaatttgaaatgtagcaagctacagcttcttgcaaattaaaactccttgggtaagtaggacctatgcgatcacatcaaatctgtctacaaacaccacactagacaaacctgcattaattcatacccatcatatcatacttctcagagcatcacagtccaaagaaagtttatctatacttgaacattaacaataaagttacacaagtcctatcctattgtattgcccctcagagcatcacatttcaaaacgtaaacactagagacaacagatgcaggtaacatgatcctgaatttccactcacagtgtccatgggcaagcagagcaaggtggctgtaatcccagccgcagcacccgcaacaaatctctcaaaattagtagattcttcattccccagcatccttgtcagcttattcctatacgtatcatatgcataaaaatttatagccttaaagggtgctgtccgaagaatattcacaaaattccctttccaaaaacctttcaacccttgagaagctgcaattgcctgaataagttcataaagattcttctgctcaccacgaactatgtactccagcttaagtctctctagaggcgcaacaaaagtcctgatacaccaaacagaataaagcaacatgacaaatttataccacattctccttctaaatttggtaaaaaaacttgagaacaaaaaacaagaataggtccaaagataaacttcagcaaattggcagtgtaaaagtaataaatattacagacactgacaatgtaaaagtcttgaatactgttgtcgaatcatagtcacaaatgtaatgtatagtaagtttattaatttttataataactacttgataagtcataccaataatgattttagattagttgacaatgtagattttacaatgagagtgcacagctaagtttattgactatcagtcaatcacgaatcttattgactcgtgcaataaccaccttaaaggccataccaactaagaaaagaataggtgcagtgatagaggagggaacttgagtgtagaaaaattgtgaagagtaagagtagtaattgttctgtaaaaagaaaaggaataattatgaagaccttgaaaccatggcagcaacagcaccagcccaaagatgtttggtcatattcatagcacccgatccattgagccccaccttgtctttctcttcttcttcacacaccttgttgtgatgctgccccagaatttcacccgattctgggcgatatatctgatccgcagcggttccgtttaaggagaaactcaacgacaagaaggcaccggggccaccagctatgccgcaaagtctctcttcgacattcaaccttcttttgggtctccaacaaaaacaagatactgtaaccgggtctgaaggaatgaaggaagcgaaggaagaaggaagtgtgtgagcgtagaggaagaggccaccggggaagaacgaatcggaggaggattccggttgtgtgattaagtggggcattgtaggtttcgttgtcgtcgttggtacgatgtagtaggagtgtttgaaaaggatcaaggtggctctcactcaagacaaaaacaacgtgaagaaggaatatttgagagcacaacaggatttttttaaaaattcttcattgatggtttttttttttttttttagagtgataatttttcttctttaaattttgggtaataggattttgcaactctcctttattatcagagctcaatagcctagcatggtagtataattttgatggtgcgagcgtggcaatgtcggtttctctcacgcgtacagtgacagcgtcacattcttgtgttttgggcggtgggcctaaaagtagcaaaaacccactctgtttgtttgttgtgggctttgtgggttgtgttgtgtacgcggcactccgactcatctgtcttgttattttcagtgttcttgtttaacatttagtttgaacttcctcgtgcgcattgaatagcctgatctgttggtcaaagatataatatataaattagtaattttctttgatgttaaaattatttgtagctgcttaagagtattatttctttctcatttatgatgagtgtaaaagtatttaagaattagctagatattgataatggtataattaaaaaatatctaaataaataaacaaaaatgaactttattaatggataaaaagaaccgagaaaagtaatatatatatatatatatatatatatatatatataaggcatgtattattcacatcgaagaaaacgaaacctgaaacaaaacacacgacgtattatatgttttctgtttattaattggaaaaaaaatacgattttctgttgtctaaagtctaaaataaagttttaacatgttcgatcaaacaaacatatataattttagtttctattctggaaaagtattgtcgtattcttatccaaggcgtttgacatcttggcatttttcaatatgtttttttttttttagttgtgaaatacttggcttatctttctcacgacacgcacataattaggctttcacctgctggaatagccacctcctggtcgtgactcgtggtgctctcattcagaatatagtttgttggtgtctctttccttcatacggttgtcacgtagctttctttttttattgggtatagtgccccttcacgtaaccaaggcacaaaatatttaattaagaagatatgtaatataaatctcaattcaattttaaacaagtttttttggggtacatattttaaaacaagttattttggtggtaaacaacttttagttatatttaaatgacacccgtacctctttgcctatcttattatatatacaaaaacacattaatcttttgtatctaaaaagacaaatgcctcttgttgaaaatttttgtttttaatctttcgaataatataactaaattaacattctaactaacaaattaacgtttgttcgtaaaaagacaaatctttcgaacaatctaactatagaccaaacaagtgttggaaatgcctaagtcgtttatctaagcataaacgtatattttgacaacttttatgaacgtttttcattccttgtatactgttccattttattttatttttataatgagatccacaagtattcaccaataagacataacttatgattaatgaaaaatcatgatatctgatatagttatgagaaaattggtccacatctaaaattgggtggttctttaggtgagttgttactctaatcgcaatcgccatagaatataaaggaatgcaattaaaaaggcagtgacacttacaaagacttcaaggctgatgtgtccaccaaataataatataatactgatgaacatatattcctttggattatcccctcatgcatattgttgtcaacacatgatgtctacatatatcttccaactcccaataattaaagttaaaacatggatctatgttgactatgaatttatcactaaacatactataagtgaccttaaatttcatctcactagccgaaacggaaaacaaattactattttttcaatttctttatcaagcctttttcttggtttaggaccactttttcaggatactgttttagtttttcttttaaatcaacaaacctttcttttaatccatccaaacataataatagtagacttgtcattaaagaaaagtgttgtactattaaaagctccactcaattaataatctttacatctcaaatagattagtttctagttgttaatttaagcattttagaaaaaagttcttaattttaagaataatcttatttttttaaaaaggaattttaccaaaataacatgatcctatattaatttcttaaaacatacaataatattttatattaatatacttaagaagttaagttttatgagtgattatatcagctcaggtccaatcaagttgagaaaatcaaaacctaagatccttatccatcgagattgagttagtttaggttaaataaaaatcaattttcaatgctggacagaccatattttatagaatggttcggtcagtagtcaagttggtcgggcctttgagtcaaacaagatccctaaaaaccaggcaattctgctttggataggacgatgggtgccaccaagagaaaagggctagatggagggtggtataacataaacctaagaggaacaatttgtagagcttgtttattacctgtattcttacatcaagggactaattgtattacaaataaaagaaataactatcaatatttgtgtcgtacatcaaaaccattactgcaatttgtccccctcacccaaaaactgaagggtcatggatacgaaagcacttttccttcagctccatcattccatttaagcagccaatcccagaattttatcagtgaacaaattattgtctatttcgagaatagtcttctctagcatgagcaacctcctccttgttgctctgtctgggatgaattcaccgtgggttttaaatttacatcgaccatgtcttcctgctttgtagaagaaagagtttccatccctggtaaggcagcagcaatcttacgaaacaaaggctgcaatttggattgacagaaagcattaagtacacaagagccaacatgtgaaggaagatgaagttgaaaaccacaatagtagatcatcaatttgaaaatatgatatatcatggtcacgtgcatcatagttcaggagattgctctaataaactaaaaatattgagatgaatgcagaattcactaattttcaccttgatattgaagcctgcttttgcactggtttctatgaacatgattccgaactcacgggactttgcatctccttcctctatagaaacttgcctgtttaagtatcaaaatggccttgtaagaaaaacttcagagagtaaaatcacaatatgcgaataacaaacacaaagggcaagccgcttggtaaacgaatttctgctctttgtaactactaatgcatgcaaagctaatgccttgagatgaattttaagccatcttaaaactatatttagtctaccagaattttacagttttcggatgaaacagaacatgtaaacactaaaatagaaggatcaaaacataatatggaaaccccattatgataataaaaaacactaaaacatccgcttaacagttaagaatttaacttttctgtatattaaacaatcatataaaccaaattagtacttacctcttatctacaagatcagttttgtttccaaccaacacaatgataacatcactgccacgttctgtacgaacctcctcaacccacttgttagtgttcagaaatgattgcctgtctgcataagaacagcttacccaggttaaataattataaatttcagttaattttgattagttgtgaaaaatgagaactaaagcacttccaaatacacatgcaaaaacagttaagataaaaataaaacataagagaacaggcacgaatgcaagcaagcacacacacaaatagggagggagatgaatgtaataacataatgtgtcttagaaaataagatcagaacagtcactcacacataagtattaaagaacacattcatgcactacaaaacccttttttgagttacatggtcaaataatttggtcatgagaaaattgataaagatccagataaatcatgttaattagataatgaaagtggtatataaaagaacttataaaactcactagcaacatcatatactataactgcaacagaagaatctcttatgtagcttggaatgagacttctaaatctttcttgccctgcagtatccctgtgaagttaacatatactaagctcagaaattgtaaggataaagagtgcctataaggcgtaccagcaatgtgcactctaatataattgttgaaaaataaataaatataaatagactgagcttgtatatatgatttgaagaggagtcatcctaccaaagctgcaggcgaacagttctatcttcaaggtacattgtttttgacaaaaagtcaataccaatagttgcctgaaatttacataaatttttttttgtaagcagtctagcagcaggaagaataaaaattgtgaatcgttgatggaataaaaaaataaaccaagaaaacaagattccatgtccattttaagtaattttatatgatggctaatataaacaagacaataatgatattcatagaccttcatacacacacctacaaagtgcttccgcttcatttttctctctatttctctctttctttcaggtcacatatttcttctctcttcaatttccaaacttttactaggtgtatacacccatggagtgtatacataccaatcatttccctaaacaagaagcattacaagcactcagaaatctaataaaacaagcctcttaaaaaccaacacaatgtggatcttgagtgaagcccttctcaatgactaaaattcttcccattctagcatttcaccaactcaaaccatgaatgctgatcccataattgataatgtcacaaagagttttcaaacaagcggttttatttctagctaccactttagcattcccctaaaaaattgagggataagtttcaacacaagaaaaaactcatccctcaatttttttatccgatagacacaaaattcagagcaaaagtatatgacatagcacatttttctactcctcttgatcctcccaagtcctaattatcgttgatcaaaacgtcttaacaaattcaaattacatcaaaacttatcgtggaactcatttcccaaataaagtcaccaattaaaatgatatatatatatatatatatatatcatgccgtcatcacagattgattcacgtgagggaaagcacatgcataaataaaacgcatgtcgtaaatagagatcaacggcaaatgaaaacgaaattgaaaatgagattgagattgagaatgaatgtgacctggtaggtggtgtcgaatttgtcgtacatgaagcgggtgatgatgctggttttgccaacggattgatcgcccaagaaaacgagcttgtatttggcgagaggggacaccgtcgccatttctcacttttttctcctctcacagacacccaacccaacgcagatctgaatctcccaaattctcttctcgcaacaaaattcagaagaaaagagagagagagagagagagagagagagagagacagaaagagaggatgaccaaatttaacgtaatgtcgagtgcaatgcgttttatatatacgggataccacgataccgcgtcatgccaactttctaatttgtaccatgcacctatttattttaattttctcccactcctctgttatgtcaattaattgtcatatatatcatatatgtatcctccctccaaaaccaagacgaattagtctaattgtattcgagaatactctatttaacaaaagttgattcaattgaaaagagtttaatgatgataaattgataatataaaataattttgtattattctttaattataaaatcattattaatataattttaaaataattttataaaacttatcataaattataatttttaattgaataatagtgtaatattagtacatacctatctttctcataaaaaaccctcatgtttagatagaagagcattatttttataatactaatattttatataaacattttattttttgttacacaaaatttaaattatagaatgaccccaatccaacaaagaaagcttcggagttcaaagaactaaaaaatgtgagatacagtcatgtcaaaatcacatcataagattaaaaatagtcaaataatgttaactaagacaaatttgaatcaattaaactgttcccataaccattaggcaaaagtcacaatcaacacttatattcatcagtaaattctagttctcgtgaataaatttgaatcaattaaactgttcccaacaatccaataaccattgaaacgttaaaggggaaatgaaagtggcttcacaacctccaaactctaaaccaccccctccaaatttctccaccagtaaagaaacacaatcaacagcatcaccacaacaagaacccaacagaaccattatgtggtggtgtatatatgttcttcctcttcatttggttggcctagttaccaacactggccggccacacgatccttgccaacaaaaccatttatgatagacattctggtcatatcaatttgggttccttctttgtaggattctgataaagtgcgattggttatgttggattggtcaaaaacctcgagccttaaattgatgatccttgccttgcaaaccaaggcaaccatgtcagacaccatgcggtctcttaggccacgtaggacttttgcactgtgagtgcactttgtctcttcatgcagttgcaaaaggtcgaataagaggttggcgatctcttccatttcaaccttgattgcttcaacttcttggaagaactgtgagaggttatggtaatccgtggggttgtcgagtttccctgcttcaatgtcacgagagtcttcaagatcgtccttctcagcctgtttcttcagttcagcgtagctttggaacgattttcatcaaatcattcatctttgcaaaattctgcatgcagaaccaacaaaaccgtgaatgaatggaatgagaacacaaggaattattgtggtctatggtcttggtcaacttctacctaacacttaaccaaggttttcaattcaatttacacaagaaatagctaataaaatttggttacatgaaaattggttgggatcatggaaatgtggttctggaccatagaataatttttcatgagaacttttgagatataaagcgagaaagtggaatacttgtgggttttcaggggaagaaaatgaagcattgaagcacacccttttggataatgagttaatttctcattggacgcaagtttttgtcatgaaacaatactcccaagtgatcaatggaacatatataagacaggcaacgacgataaaaggaagacaagagaagcactatgttcaaagcataaaagaaaaggaaaaaacaaaaatgtaaagaatggaatgttgaaaatggattcttttattcttccacccacagaaaatttcgagagattttacactattgaacaaagaaatataaaacctgaaaagttattgtgcagttttaaagtgttaaaacttttaaaaataggaaacgtgaatgagtgaagaagagaatagtgtgatactgtgattgaaccttgaggaaagcaatttggtcactttttcttgagtgctaatgatccctcaatgaaaagcagcaaacgttacaaagctaaaactagagcttaaagaaattaaccaaaaactagagaaagatataaaaaggaaataaagactaaattaatattcaaatatttgttcatttatttcttaattttttaaaggtagaatatattttgtataatcttaattgatactaattatacatattattcatgtatcaacattacatttatatatatatatatatatatattacttcaattcaaaaatttatcttatatttttattctctataattttatcctctgaaccaaaggcatcttaattgaatcatattgtgtgtgtacactactacaacataggcattcaaggtcagttatttggatcatataaagtcgatttccgaaccaaccttgtcttagatgactttaaatatgtaagcgaacaacgtcgattttttaaggatcgactttgaaaattttttattttttattttttaaaaaaaatcatcttttctaagtcggttatttcaaaaaaccgacttagaaagctgagatacaaagtcggttatttgaaaaaactgactttgtatcttagttttctaagttgattgttttaaataaccgactttgaatttcaaattgaaaatctgggtgagtttcaaattggcgctgagcgagaatgactgagggagaagctgagaagggagaagcctctacaaagtcggttactataataaccgactttgaaaatcttgaaaacgacaacggtcgtacgtggaaatcgacattgaatggatacacaagttaattttttttaaaaaaaaatatgttaatctttcaaagtcggttattatagaaaccaactttgtagaggcttatacaacgacggtcaacaaaaaaccgacgtcgaaatgccaaatcaattgaattatttacaaaattaccactgacctacctaccacgtcggttttcttacaaccgacttagaagacacgacgttaaaagtggcttctactgatataaaggaagaccagcttaattgataatttgataacaagtcactgaatttcaaatcataaaatctatactcaattcagtttcgataactgaaatgattgggtcctgttggtttaattttatttttttggaatacttatataattgcatattgtctaattttttttaaaggctaatgaaaattttagtaactggtctagatggaacacaaggtgtgcccataatgaccaaatcaacctttagttgttttgaaaatgtgtaaactatttaaaataatattctactatacatgcataaacgatatccaacatgacccagtcatctcattaatctggtctaatccgaaactgattatacaggttcaagttttacaattagacttgatgcattttgagaagaattgaaattatacttcgagtcatctcaactcagtttagtgttttatagttttttgtaaaatataagttcttcgaaaaattatatattaataataaaacttggattgaattgcacttttgattctcaaagtattgtaattatatgactttgataatccatattttaattgtgcaaattagaacctttaggtaccaatatgatatgacattgttagtatataacattttttcttaaatatatgattatgaatttgatctctaactcatatataaataaaaataagttcaatacttaaatgaatctttgagggactagtcgttggtttttggacaactaaattgtagtttgacaacacactggtgcaacttaatttaatttcttatccctcctgtttgctagctagtaaagccctttacaagcaagtatttataaatgatcagagatcgagtttccaggaggtgagaataaattattaacgaatttaaatctacagatttcaaaatagatgaaattctgtagccttttttttatagataagcctctctatttttgtaataactgattttctctaatccagaagcttgaatatctcatatgtttgtgtttctcatttcaacgaaatggcttttgattcagaaaacatactttcgcaactgtgcactatgtaaagaattttatactcatcactaaattacgattttatgtacgttatattttccaaaaaaaaaaaaaaatcatgtgaaagaattttcgagttgccataaatgccaaatagatgtacaatgcctataagccacaagtcgccaaatcggtcacactatgtaaggttgaagggggacaaataatggcccagatccttcttaataatcaaagatagatttgacaatgattttgacccccaaataaaataggtaaaaatgattggaagggtgggggtagaagaaaggagatagatgtcctataatttttttttctgcaataatataaactatttttaatacttttaaaattaatatttgatcttaaaattaaaatctactttatacatggtcatggtgggagtaaaaatacaatgaaatgtaaacctaataaaaaaattataataagactccgggtacccaaatttataatacaagaaatagatttttttattaaagagaaaattcaaataaaataaagcgacgttaacaaaaccatgcaccgtatatatgcatatttggcctcaaacattcacacggttattatttctacacaacaacagaatgttattaaagttgataacctataataaggaaagaaacaagtcaccaaccgtcttaactacagccctacactgaccacagaatcaatttctagcattaaatttagacaacatcgcgggtcttataccattgtccctttgcatcatttagtcatcaaaatggagtgtctactctatcccaagtttactgtaattagctaaactatcaccatgaaatcccttcaagtagggcaagcacaacaagactccaatggaagtgagaaggtttcagacaaaagcatcgtagttcccaacaaattcatcgcaatagctgatagcttcaaaggagaacattcatggtacttctagaataggatctttttatagattaggcagctaaaaattcagtaataataacaatatctacatgtctaaatgaatttgaatttgcatgtctaaccaagtatggtaatggtactccccccacccctcttattttctcttcctggtttccatttttaactaaattctacctaccacttatgtgtatgtgttttctttttcttctttttgtttcttttctgatttggtcctgtgcaggttcattgctcctcaaatcccaacagacttttcaattcaagtccaggaaaccacttataatgttcacaaggtatagacaaactcttttgacatatttaaagccttgtaaatgtagaaaatcacccgatgaattggtttattaacatatttccaaacaatcatcagcggggtatatatagagcacaggaaatcgataacatcataagtcataacactgtctttttaccatactcttatctcaatgagtgacactgactggtgtagaacatagttttatcacagggagcataagaaccgcacattccttttctttgtggtatgtgtacttgctttttacctttttggatagggtaaaaaaaattactcgagatagaaagcacaaaactttagagaaggtttaagagtcctgaaaacagaacagcagaaaacatggggaaactaacggggtatttcattttttttaatatcattttcaatttatatgtttcactgataattataaaaaaaaatgtagcattattttttttcccttgtttttaagatttcatgggggaaatagtgaaaatgacaaagcattgcttctactatttccttaaacaaaatctaaaaacaagaaatataaagaaaataacgtttaatttttgtaataaaaataaaagaaaccgaacagaccagcaactcatgtcttaatcattttgtacgatagcgcttttgctgtaacatcattacgtacgttggtcacttttttttttgtaacaacagtaccccttgatatcaaagtgcggttacataggacaattggaaattcagcctttgatctcaaattctggcagtgtgctcaagcttgaaaacttcccaggtggatctgaaacatttgaaacaattctaaagttctgttatggcctccctatagacttcagcccagataacatagctgcactaagatgtgcatcagagttcctagagatgactgaagaactagaagatggaaatctcatttctaagagtgaagctttcctcacctttgttgtgctttcttcgtggaaagacactatcactgttctgaaatcttgtgaaaacctatctccgtgggctgaaaacctccaaattgtaagaagatgctgtgattccattgcatggaaagcttctaaagatgagctcacaagcgaggatgcgacacctaatcaagaaagctggtggttcaatgatgtggcagccttccgcattgatcattttatgcggatcatttctgcaataagttcaaagggaaccaaaccagagatcattggtaaatgtatcatgcaaaatgccaagagatggctgccaggaatggaggtggagttagaagggtttagaggatatgggcatgaaaagtgtaacctacagttcagtatttttagtgggaagaagaaagaaagcagtggacacagcaaggagcaaaagacaattattgaaagcctaataagcattattcctcctcagcaagatgcagtctcatgtaagttcatgttgcagatgttaaagttggccatgatgtattcagtatcaccagctctcacaacagaccttgaaaagagagtgagtttggtgttggaagatgctgaggtgagtgatcttctaattccaagatatcaaaatggagatcaaggaaaaacggtcatgtgagtatgtgacaattctccttttttttcacacattggaattggcattaatgccaaaggtcaaatttaactccacagccctctaaaccatttttttttaaaagaacccaagagttatgaaaacgactaatgacactaatatctatcttttgtctttttctattcttttccctcattagtagcatgactaattcatctgaagaatgcaccatgctagacgtagatgtagtgcaacgaattgtggaatacttcttgatgcacgaacaacagcagattcaacagcaacagaagactaggaaattcaatattagtagactcttggacaattagctgaaattgcaagagatccaaatctttcaataaccaagttccaagtttttgctgaattgctaccagaaaatactcgatcatatgatgatggcctatatagagccattgacacctacctcaaggtcatcatttaaagtcttattttcttgtgattcagtttcccgttttaactaaaggcaaataaaacaaagttttgacattctgatattgacatctctccagacccatgcttcactgaccgagcatgaccgtaaaagactgtgcaaaatcatgaactgtgaaaaactctcacttgatgcatgcctgcatgctgcacaaaatgagagattgcccctaagaactgttgtccaggtaaagtttgcaatctctggaatcaaactttttaagcttcatacatgataaattaacaaatgaccatgaacaacagttttgagaatttcggattccaccaacaaaaaagcaaaacttgatgtgatggttatatagcagaattcacaattcagatttagcagcatctgttctacaaacacagtagtcatgttaaatattagaaccaatttaggataaattatattattcattatattaataagagtaaattacactctcacctcctatgttttttttgttttgcaccttacaaaaaaatccttaattgtttaactcacattacacccagacctcctttttcctaaataccgtttaataatttaacagaaagtagatacatgttagtcacatgacttttaatgaaaatttatgtctaaaatacccttatcttcctcaaaatcacatcttgggttttacaaactctcttcttcttcaacaacccatcttcacttaccaccaccagtccaccaccacctccttctcccacagcagcatcatctcttccttctcatcgtcgttctcgcccaccaacacgacgtccaggcgcgcacccactcccgccggagcaacaaccactactgtagtcacctcctccaccatagcaaccgtcaccaccgtagtcgccgccgctaccgtcatatctacctccaccttcacgtcccctgtcgtaattttggccactatcaccgctgcatctggttccctggacattggtgccgtcgggtaaaagtaatgtataaaaggaaggatatcgggtgcaatatgagaaaaacacaagggatgcgagtgtaatttactataacggacaatttcgtctactcagatatttcaattgacgttagttaaggacgttaacaaaatggagtaaaagtaatgtataaaaagggagggatattgggtgcaatttgagaaaaacacaggaggtgtgagtgtaatttattctattaataattgtaacttcacaaactttttacttttacattcaataggaaaaccttaaatactaacagaatctaaagttgaatggaaattttttaacataagtaggataataataatcctcctcataagcagaaaaatgaaaacaaaacagaaatactccccaaatcaatccctccctgaagccacatgctaaaggagaggccagaaaaacaatcctatcccaatggaaaatagttgacagtaaactctacaaattatttcctctatacacaaaggatttttttttatgacaaagattgtgttttactaacctatagtgattgaaaaaaaaattctcttaaaattgcagtaaaacataattggttagaagagagaagtttaaagaccagaaatgttgagatatgacaatcatcatgtgaggagattcaacagaaagaatcaagtattttccaagtccacttttaatatgaaaattgaattctacagaacagtgttgaggaactggttcacataatatacaccccatgtaagatagtgaggtagcacaagaaattatagttaaaattacatagcatttttagagttaacgactagagtgatgatttggcataaaagctgccaactgaaatcctgaatgaaagtatacacaacatgcaggttctattttcagagcaagtaaagatgaggacagcaatgcatgagaaagagccagcacaaattggaatccaatctgaacaagaaggaaaccatacatctgcaactatggacattaaggcactcaaagaagaacttgagaatgtaaagtcccaaatggtagaactgcagaaagactattgtgaattacaacaggagtatgaaaaggtaagcaaggtaagcaacaagccaaataattcatcaggctggagtttaaattggcagaagattaagaactccttacatacaaaaccagcaggagttgaaattggagacagacaggatgcacccaagtcaccaaacaccattctacgtagactaaaccctagaagaaggctctccatgtcttaaaagtattttatttttcaagtttcaacataaaaagtcctgtagtaaaaacacctagctagccattctttatatgaagcatatagactaaattttgtatcttaagatattgttgacttcaaagagaaaagtttctagtaggctgtagcttcctatagagacaaagactctgaaataaagcaatacaagtatactgtatacatacctgaaaagaaaacgaaaatgtgactagattactgatacaagctcatggcccctaagaaagtacagttgataggacatcaactaataacttataagtttagcaatgaagcataaaagatgcacatgaggggaaaacaaaatgctctagcattgcagaaaaatgcaacttgagaggaaacaatatctgagttcaaattaaaggaaatatgctgctaatttatagaattcacaatcaaattttactttaggatgtttgcttatgctggtttggcgattaacatgttccttctatcagcgaattacttggtcatttcaagataaagattcttggaatcatagtcatactgtttatagtgacaagatttttatgtttatggtaagcactaaataacaaaactgcacctagcctacaaacttccaaactcaaattctgggttttacattattattactattcatacatgggtaaaatgaattatatgaattcaaattaattttttaagataaataagttaatttatcatttcgaatataaagggttgagacttgacacaatgcatagagaagagtttataatcgaagagcaaatggtctcacttcctagaacaagcacagagtgctgcagaactactgagataaatttatgtcaacagtcaatttagctaaaatatcattccctatgagcatttccaaacagtagaactatttctttctcaaactgagcatggttttatttgattctgttgtgtgtgtttcaccatcaagttagtcccaatatatcaaaagttcaaaaaaaaaaaatcatcatttgattttgaattgtggtcactgttgtgatttcattgcaaaccttgatattgcagccaaaattacagacccttttttaatccttatatagcacaatcgccatcaatcgataaactccaataaaccactttaacatccaatgttttttatgccgaaatggaaccaaaaaaaaaaaaaaaaagagtgaacataacaattgacaagagaatactcaaccccccaaaactacacacctagcagtgagtggtcaacatcttctctttcttcttgtcttctacggtggaacgaaagtgctaagggtcctgagagaacgaaagtggtttcttgagggtgacgtaagccttcttgtaatcgggttttgcgaccaacgatcccgcgtaacgcttcttcttgcccttcatgttcaaagttcgcaccttttcgacctccaagccgtagaaggtttctatgaagagtttgatttcgactttggaagctgaaggagaagtcttaaacgcgatttctttgatgacgtttgaggaagtgctgggcatcagtggcatcatgggaaggtttgtgatgtgtgccattgattttgatttgaacagtgaacacttctttgaagacaacttttctcctctccgtccgcgcttccttaaaccctaccaacgaccaaaaccctcttcctctgcccctgtacctatcaatgccgccacctgtttttgtctctctctttgttttgttttgtttttcttaaatttgtatgagtatagagaagaaattaaagaataaaaatatttgtattaccgcaaaaaactatttttataagcttactttatttggataatatatttctattttttaaaatttaaatccgcactctcatcaaacatttaaaagtcaattataggataatttctaatttataggtttgctatgtgtttaccaactttttctattactgtttttggttgaaagctaatttactatctttaggataattcataaatgatggaaagagtaaaattagtacaaagaaatgctgttaatataaaaagatttatactatcaaccaattaaaaatcaaagttaacatgacttttaaaaaaattacgagtgaaataacacgtgccatgaatatatattaaatttagactttacaattttttatattattgtatttttcaatgtattttttcagtttttttagtttttatctaaatataagtaaggatatatatatatatatatatataaatatgaaaaaactatatatatcattttaaattcatttgttttaaaaaaaaatctttataaatacattcatattttgtatataactagatatatgcataattttaataagagatgttcataatgaaaaaataaatagattatattttgtaattattatttttaaaaaaaatatttccataaaaaagactaacattaatgaatacaaagataagaaaagccctcataataattttgttaattaatgaaaattatttaattctacaaaatttatatagaaagttgaaataagtgggaaaaaaaacatcacttatattattcacttacatattgtaccaaaaaatattattcatttacatataatttagtagtatcttttataattgattttagaaattagataaaaatgacttgtatttttataaatttttattggtaataaatagatgtgtattaattttctttcttttcattccttttttaattttgtagtgattgaccctgaaggtgggatatggaagacatgtttcagtttgtttgcaatgttttgatgtcaagttattcaaaacgtgaggtccctaaagatgcaaaagctattttcagctcattagtcattagtaatcggaatgcagtgtctctctttaatgtgatgagaattgaattgatgtcgtgtgtatccaatgatgttacagttatggcctttctcatgttcttgaataacaacatatggtcctattcagtaaaagaaaaaattatcataatgcttcagttcatcagagataaaggattaaacgacaataaataaatatttttctgagtgaatttcattggtgatcattgtcttctacgatataaatttcaaattgaaaacctgtaatccacacaacaattgatcatttaaagattccagagtattaaaaaaaaaaaaaagaagaagctctgtataacaacctaattctattgagatccagaagacatcgaaaagaatgcttgccttctatgttctatcatttacaatatgctaatatattttggataagaaaacaaagtagtttcagggggaacgaatgaaataaattccccatggtcagattctatgactccttcttcttaacctggtaggggtatttctggtatattgaaatgctagtgaccactagtggaagagccacaaggcaatacaatgaaggtggttttccatcgaaaataaactgtagcaatgctgtaatgagtaaagcagaaacattgacaaacccctgcaaacacatagaatgaatgacactgtaagtacattcgtacaaaacagaaaatgtgaagaatttttaatcctaatattccctatgaaagaattttcatcatgtccagcaactccaaagttactcaaaagtaccaaaagtttgtgcagttactgtctctactgagcactgataaggtgcaataataattttctcttaatcaacattaataatgcatgttagaatttagattaaatcccccaaaaaccatgaaaaaacaaatgcatgtaatatgtttcatcccattaacctccagattattacgtgaggtagggaaattgtaaactagcaataaggacagactaacatctgatcaccattcaccattttatctgtcatctgaggaaagggcattctaaaagtaattcagtaatggttcacaaagttaaacttacctttcgaacaccaccagcatggcttgtaactaaaccaacaagaattccaccaagggcattgaaaattactgggatctgaattgaataaaaaaaaaaaaaaaagatttgaaattaaaagttaatgtacatcaatatctattcattaacggcaaaatcactcttgcatatggataaaaacggccagaacaaggcactaaaaagttcatattatgaatttgcaagtaattatactcacaactctctattgcagttaattacaaatttagcatcaactagaatgtacggaattaatcaaacccccattcccaacaaaataaataaataaatgttaacaatcctgattcctgacatgaaaaagtatatgtccaaatttacttgtgcttgacacagaggtcagaatatcaaaatttgaacctttcaattttatagagtttactatctttttagtccttaaactttttataatttttgtttatagtccccgaacttttttatctgtttttagtccttcaacttttttatcatctttactttaagttccttaactttttcctcctccttacttttagtcccttaaggctttgtttgggagttaggagtggaagggaaggaaagagattcaaggggaagggaggggaaggaaagagaggaaaatgagggaagttccttactccttgtttgagagttaaaaatatattaagagaggaaaatagagagttaataagatatttttacaattttgtccttatttcaaaaattaatacactctatatcttacactgactagggtaggataataattttattaacattgattggggtaaaatagtaattttagttacttttccttctaaaaacctccaaataggggggacaacaatttttaggctttggaggatttcagaggagttttaaaaatcctcaaatcttttccctcaaaaattaaaactcccaaacaaggagatgtctctacataaacctttcccttccctcccttcccctccaaaatccctctcccaaacaaagcctaaaaggattaaaagtaaggcagaaaaaaaaagtttaggaactaatagtaaggattgaaataaagtccaaggacaaaaaacataacaaaaagttcagggattaaaaatataaattctaaaaagtttagggactaaaattatagtttacccttttatatatctgtgttggctgcatgacaacatatctaacagttctaagaattgtatcacacaagtcaaacagcagtaagaacattaccaaagtaagaggagtccaaccatagaaaaacccatgttgtctcatagcttctccatctggggatttcaaagtactggcaagcaaacatagacttccaacaatagacatttctatagtcatcaagtatgatgagtgtttcttaacctgtgatagaaggaatcaatagataaataataatatcaatcaatcaaggaattataatattgaagagaaaattgaaagttctggtaacctgtgaggcccactgacacaaggatgaagccagtccagagagcactgaagcaactaatacaggaataattccatagaataaaatttgatcagcattggcactagcagaacctttgctagagccttcgccaacacttaaaagaactgccgcaactattaacaagaacaaggctccaatttgctcaatcgattgtttttgcctgcacaaaccattatcagatgcctagtgtacagtgttagcattataggttagagaaggaaaaccaatactggtggctaacagttgatgaaagtatgattatggatgtaatctgttacaaacccctaacccaatattcctatttatgctaataattaggtcaagtactattagtactagtataagactaataaccttataacaataatttattatcactccccctcaagctagccttataacactaagctttagtttgttaaagtagcagaacaaaacacatataaacacaatccattttaaccaaagctaccaccaagaacaaaaagaaacccagcaaaataaaagacgttggaccatccaaacacaggaaagaaaagaaaaaaagctgaacccaaacaaagcataaagaattaatcagaaatctatccagtaagagaagaagagaagaaaagcctctcagaagagtctcccaataatcaccctctgaaactgttgcagaagcacccaaacaacagaacaagaaatcaacattatccaaaacacctaaaagtaaaaacagtgagtgaactacaccaaacctaacaaaatattgtttgaagattccggaaaacaccaagtgcatgtcaatgacctacccccaaatcacaaactgcaagaatataagtaggttcaaagaaaacaacctactcaaccccaaaattataacttggccagccaaaatcacaagaaactgggacaattcctgctcctcagaatagattacttttagttttgagtttttttaaacagaaacaacagctcttgagtgaaaccatttgcttaacatagataacaatttggcatatcctctttcacaaacgttaacgaatgggtttgtcaaaaatagcagaaatactaattgttgtcattgttgcaacatacctcaatatgaaatatgtaaagaatgcagtgaaaaatatttttgtctgattcagcattgagaatgtgagtgaatcaagattcttgaaagaaatttgcagcaaactattttgcaatgcatatatagctgcaggaagtcctgatgcagtcaacgcaccaaccaaagtccactctttatacactttcctcagactaccatctttagccatgaaaaacactgcacaaataacctaaaaggcagattacagagatagatgaaagatcccaataaagaataagaaaagtacgctatagtacaggttttataattaggcatgccaaaacagttcaagatttacctttgcaagttcacatgtcaaaacagatgaagtcacaataacttcacgtctgcaggaagagggggaaatagattataagacacgcttcacatggtcatttacaattattatatcaatttatggtttaatgcacaaggaaatgaaagacttaaaagatgttacaatttaaaatccactaatcacatgaacatatttactttaaccttagttaaaagaggaagcagatgtttcataatgattatcatacaatacaatattggagttaacatcatatccatgttggatacacagtcagatatgtcagcctggatatgcaatttcttttttcatttcaattttttgtgccaatatggatgaaatgggatgtaataagaataggatacaagatagtggataatgagttaatcaataatgctgacttttgaaacatttgtgcctttttaattttgattttgtccttcaataagaataactatgcataaatgcttacattttaaattgaagtgcttgtgttatagtatatgttttagtgttaattgtcaattttgcatgttatatacacacacacttttttcctgaatctctacttaggaaaactgaaggaacacttgctggtactggaaccatgcacaaggacaaagaagtaaatcgaaatcttaaaaaatagatggcaaaacagccaacttagttctcataaaatcaattctaagctaaatgcatatgaccaaaataggaaagggctatgctcaaaacatcaccatgtacaggttgtgctatttagagtaagaataactgcatggataatcctacagatatttgtaacattatcagaaactaaaataatgaataaggatggatttagctcctctaatgtgaggaaagtacactttagaggataagtgcagttatagccgttacgtagaaaacagcagttaagaattttaacaacttcataatgctatatatgtgtatttatttcatcacaatctcaaccatttattttcatatcaaggattgtagctgcattttatccaacaaggacaccagtcacttaaactgatcttgatctgaattcccactttccgagcatgtctatcttgaattgtgtgtgtgtgtgtgtgtgtgtgtgtgacatgcaaaacatggtgaaaataatgcagctaaatctaaatgaatttctagaatccctgcttcctgacaaagccatgcaccattcctaagtaggccttcaaattccatatgtctaagaatcaatacaaatgacttattcctttttactttatatttgatcaagtggatttcttctactgcttagagactcttgttctgttcctttgttttaatttttttttcttgtgggattgcataccatccacagtgccaccattgccaactttgatatagttaaaatatttagcgtagcttgttcaattatgtcaatctcgtgatactaaaccaccaagtaatactactaaccaatcttactgcaaaaatcacagcatagatcaaacggaaaataattaatcctgctaacgataattaaaatagcgaatattttctatgcttaataaaaaaaaatgataaatcccaggtccaggactttttattttactctaaaaaatataaaaaaatggttgggcagtaaccaacggtaactacaattaaaatttacaaccgtatcgtgaatcgagaagaaaagtatagaactgaaaccgtgaaggttgaaaaatgaaaacctgatgaagcgttgggagatcaaaggttgagctccgtattggagagcgaggagaatggaaaagaagcgaatccttgcattattcatcccctgaccctgagatggtcgcggtggcgccattcagggctttgattctgattcctccgatttcgattctccgatttgacggtgaatgaatatagaacacaactagatacccactccatgtaacggccgcaaagaaaacgacgactcaagtcatacgtacttgccacgcgtgctatgaaacgacatcgttgcctttttcaggagaggaacaaattgagcatgtttgatatttaatatttttgctttttggtgtgcaatctgaataaaccatgaattaaaacaaaaaaaaaaaaaaaacagctttacagatttaattaccatcatggtacgtttggtatgaaaaaaagttttttgataccaaagaaacataatttctgaaaaagtcgattctttgaaatatgtataaatatgtttgattcgttttagcgtgtttcttgagaatttgatactaatataaaatttgataattaatttttttttcttcactcgaaaaagttaaatgtctaaccccttttttagaatgtttttttatcaaaaaagtgaactaaaatatattctcaagagtcataattttcttttaagattcttaagaaagtaaaaactttttatctactaaatattccttcaagataacatatctacattgtgaataatataattatgaaatttatttattttttcttatatattagagttgatggtgaatcaaatttgaattatgtgcatcatatcaaagaagtatatttctataatattaatatttatccatttatttatgattgtataaattctattaagtgataaagcatttattatttctctaaataataataattaattaatctaatatatatataatacttataattgtttatctattataataagtgtgaacaaacattctacattattagaattgtcaacatttgaaaatattttaattattaattattcttatttacatatagtatccataatatttgtcttgagcaatattgtgatattataaagataaagatattataaagttgtaatatttttttggataaacatctaattttgtccctaaaaatataatcgagtgacatatgggtcttcatagaataaaaataaaaattagtccttaaatatacaaaaataattacatatcaatcctattgttagtttattccattatgtgttaatgttgatgcttacatggcaacttgaaatttaattgtcatgaaaatgaatgtctcatgagatctgactcaatcaatttatcattaaattgttaatgaactaatttgtcatttgcaagtgagaaatcggatttcagacacatgctaacatactatggaaaaaatcaccattataattttttttttaattcatggctcaaatttcttctttattttttttttctctttctcgttctatctttctcatttttcccctccttctttcttctttgcatccaccacaaaccttcataggctttataggttgaacaccatataagtgatgataaaacttataactcaaaaccttacaagttttgggataaagtgtgatatcaagttcacttacatggttgttcataactcattggtgtaaatctctccggtgtttactcctcaattgcataacaattggtatcaaagtcgatggttcaacttggtgattggcttggatgagtaagatagcgacgatggatccttggcctagggatcccttatatcgaaagtcttcctggtgccgagtccaagcagcgtgtcccgtgggtgaaacgacgatgcaagtatctaaagcatgtgtgctctaatggccaccatgaaaatacttgtgaataaaaatgacttccgcttgagggaaaagttaccatgtagaagagaagtacttacacttgagggagaaattatttgagtacaagtgtgaggtgaagtctcacatataacgcccctgattttcgacatcttggtggctcttacattacaacacttcacgcagtgacatttcactcaacatttttgttggtcataactcttcataagtagtccttttttagacctcaaaaatcaactttgtttgcttccaagattaatgacttacaacacaaaccaacacaagattttttggcgtgttttgtcctcactcatacgcgttccaaaatactttccagaaagtcacttatcccataactattctaagtaaaatacgctcaaccatgaagttattaattgatggactactgaaaagtatatgcatcttgttgatataggtagtgtcaattaattattttaagtcatccttagttgtacagtctcatacctgcacaacctctatatctctttcattttggtgtaattcaatcagggtgttacaccacatcggatataaatgcaaaagttgaacatcatatatgtgaggagaagacccataaacatgagtcttaagattttaggttaaaatatggtgtcaaattcatttatatgattgttcatttctcatagtcacttatatggcagtacacaaggggaaacaacgttgtttgggttaaagtagacattgacgatggggaccaaagttgagatgcgaagagctcgttctagaactcatgctcaccctgcagggaggcggagtccatgagcttcatcaccatgggatcaccgataagcgtgtaggtaaagatgagaattagttatatgtttagttttcaattattttcaggacactaataaaataatattcttcatgttatagtgtcgctgtatttgacgacatggataaggaagatgagagtaaaattgaaaaaaaaataatcttatccgttaattttaaagtgaataatatcggttgatgttgtaaaaaatatataataaaaattgataaattaatccatcgataatttaatgataaattgatcctgttaagtcactatttcatttaatatttccaattacatttgagtttatacttgacacataaagaccaaccaaaaaaactaatgacaagatcaatatgtcatcatttttatccatttggagattaaattttatttttttatctttcaggaattgatatgtcattgaattatattttcagggataaaatttgatatttattcttttttttacttgaattgttatgcaaaaaaaaaaaaattaaagcgtattttcaaacaaaagtggttttttctcaaaaaataataataattgagttcttattcttcttgactttttttctcagccacatgaagtgtgtcaaattgggcagacaaggcatgatattgaaaactatatataagtggtgcttgcgcatgcatttgatgatgtatcgatatatacaccaaaagtgcgtgaatccactaatggggcatgcctattcgtttttcccatcatcactttctatttgctggcacatttgtgcaattgcatcatgtatgccttgactgatccctgaaatattttcccttctttttgggtgatggggggacagtggctcattttgtacagggagaagctacaaactagcaaacaaacaagacactagcaacatcataatcactcgagacccgcatattgttacacctatagcttattttaaaggaaatcgatcctctccgtttttttttttttttccatttcttccatttttataagtttttagaaaataataaaatgaagacgatacactttatagagaataacttttattttttcaaaagctaaaagcttagtgataaaagaaatgggaaggatccaaatcctattttaaaagtaattataaatccacttgcatttcgttcttacaaatcctctcaatactaaataacgagttaaatatattttgttcaaattcttcattatgaatttgaacaaaatatattttttatgaatttgtgttcaaagtaaatttggtacggaaaattctttgttatgaatttcaatcacattaaattgatactaaaaaattatttattttatacatcaagtaacgaatttgttatgaatttcaatcatattaaattgattctaaaaaaataatatacatcaagtgtagtaccaaattgtatggtgaatttgagggattgaaagattcaaactatcatttgaaagtaggaattaaaaataatattttttaaatttgagggattaaaaaataattttttatttaaaagactaaaaaaaatacactccctaatttgaagaaccaaaatcataataaaccaggtgctttattttaaaaatcattccatgacttattcaattagttgtacttaaaaagtaataattagtcttcatataaaaaataaaataaaaaaggtaattagtcctcaaatacatcaaacaatgtattgttctaaacatgtatcatatcaacagtaaattggttaaatcaggggaaaacacatatagagaaataaaaaagagtgaggactctaggattttcttggattatgagacatatgtttatgtggtatttaattctaacagattctttaatcacttatgattcaaattctaggagaatattgtcttgattacaatcctttacaaaattgcttcaaaaacaacttttattaaaattttgattgcagtattcagtattgttctgattggtgtttttcattaatttcattttttagacttttttttagagttaggagggaaagggaatgaaagagattcaaggaaaatgaagaggaagaaaagagagaagtttctacatacttgtttaagagttaaaaatatattaagagaagaaaatggagagttaataaaatatttttacaattttacctttaaattgtgattaagtagctttttacttaaaatatcaggctcactgtaggtgacaagaaaaaatatttaagccttgactttgcaaaattacaaattattaatattagttatgtagcacattcaaaatggtttttaattgtttctacatttaatgattaatatattcatcaccgcacggaatataaacttgtgctttaacattaacattctcattgctttttgggttcagttagaatttgagctcgaaaaacagagatcatcatctttcactatgtatacgcacattattatctgtttttataattgtatgatctgttgaaccctcattcctcttcccccttcaattacttttctgtgcttggtaattaaattagaataatattggtccaaatgtgtcttggacacgtcagagaaataattaaatgatgcaatacaaatactagatggacttcagtttccatttatttagttttcagaggcaactctgttgtgctaactgtgtcaaacactcgtgtatgttcaaatgcttgatataaatccataaagagtgcttctaaggaaagcctctcaaacttattgtgtatatataaagtcgtagtgttattacatttggtcacacttcaaggtaggagggatccatataaagctatgtgttttaagatagccagctttttccaataaccagagattctgggttagatcccaagtgaattcgattttttttccttgcatttttctcacttttcagttttcactgccaatgccatataaagttattattccttgttgatgcaagattgatattcaaacggaaaaggatttcttgtcaaaactcatgtgtccgtgtaattagaatagtagaatcaagtaactattagaagtttgatatgttaaaaaaataaatggcttattttctttattactccctgtatttttatataatagtcgttaaggagatcttcattgtaatcaacaaatgtaattactccgtctccactcttttcttaataaaattgtagacacttttcctattaagtcccttctcttactccacgtttttctcaatacccataactattgtatactcctatttctctctctctctctccataactaacacatattcctaatttcctattggtcaagatttcattaattatctctaacgttttttttttctgaaacaaagcatccaatttcgtagatgtaagctaatgtttcttctgtcagccaaccttttgatatctgttgaagcatttctcttcctttgttcaattgacacttttgaaactgaactaaacttccctctataattttattcttaaaatgcttaccaccaaaagttttgatttgagtaaacattaagatctttcccatttttgttactctatacttgcatcttacccctcttcatttttaaatttagattcaaagcatgtattatctttaattctcttttgttgggaataagtcatttgtggaaaagtggagaagctggagaacgtgtatgtattccactgcatttaattttttgttgttgaagttttcaactacttataatttaatttatataaaaaaatatgtaaataattaattggaataatggtataattgacaaaaaagaaataatgctatctttgactttgaaaacgacagataaataagaataattttttattaaaaatctgacaattaaaaaacaacggaaggataggagtacttggaattatgttcgatcaaaatgtaataatgaattattttgaattttatctatttattaattgatgtatcctatgttagacttttttttctgctgaattaatgttagacaatactgctacctgcaattacaaatatgcgtgaaatatgttattaatccatataaatatggtttcatgcaatttagtcttttacaggtttttaattaatttttattctcgtaattaaacatcagtttatgctttcgtgctttacacattttttactaaattattacttacttctatttgtaaagtaaaagtaaaatgtatggtaatttaaaaatttattgcaaagaactacttaccaaagctatcattatttgaatcgcaagctatattacgataaatattgtggaaaaagattaataaactcaaaacaactcaacgacaaaagatttattttatcaaaaggttaatcattttttaactataggacattaatatatatatacttcacttcaaacaacacaggaatatatataccattccattgtattacgtcaaatgtcttagtcggtttgataagcacaaaaacgcaaaacaagacacaaggttgaaggccttgttcagttttataattaccagaaaacacaagacattattatcctgttttatattctattccattttactttgtcaaaagcttacccaaaggtcatacactagatttataaaggtcatactcatacatattaaaaaatgacgactcaatattcctaaaacacgttgttcacaaggatatgctcaacggtgcttcttactggcaccctttttaccacttttcttcataccacctttccctgtattggacatattggttccagtttcacgatctcttgatggtgttgaattttttcacattgagtgtgccatttctaaaatgaccttcacttaatttcagacccctgttctctggcttgtgcttcccagcagattttttactgctaccaccaagctttcccccaaattgtccaagaatcaaacgctaaaagccacaatgtaataggtacaaatttatacatgaataatgtcagtaacatacaaacagaaaaataacagggccagggggataaaagtggggaatgatagaaattaattacctcttttggagcattttctgctccctctccgtttgtttcttcatcatttgggcgtgccacacttataaggtaatatctgattcttggggggctacattttggaaaatgataaacagcaaaaaaattgtttcctgagcacccttgaactagtatttgcattggcacatggcaaacaaaatagaacatcaacaatagtcctcaccttcccaccaagacaaacaacattcctattttcaacctttttgcgttctttccttgtcatatgtgagtagcctggaaaatgatgcaataattagcagccattattagaagaagcaactgcactaccatatttgcttggcatattggaaaggcaaacaaaaccaggtgaaacgggtatggttaccataaagttttcagctctaacaccccaaaattaaaataaagaccaaacattttcttatcattcaagcatccaatatgcaaaataaccaattttagtccacacattactcaacaatttgtaagtagcactcttatatttccaacaacaaaatcctaaagaaaacttatataattggcaatcaactatacaattcaatcctctaaatcatcctaactaaaagttacaaatgaccttaaatgttgcaagaacatgaaaggacagtggtaaattgcagccagtgccacgtatcctaaattagaagattaggttgagactatttcaactaagaataagttatgttttgcacaaaaaagcagagactttatgaggaagaggattataaccatgaaagttcattccttgaccaacaaaattaagaattttacaagttactaactcctccatgaacttccaaatccataaacaaaaagtcaattgaaacatacaatcacaattcctaacttcctttagcgatgagatgtaatagtaacgtacttatttttgttccatgtggtcctgttccatgtgcatggagatcaagacaccgaaaaaatagtaacgtactcatttttgtatgcaaattagaacacgtcgtttgaattttgaacatatagattcccggaacaaccaatgtcacgttttattcgtttgaacccaatttcacgttttatttatttgaaacctatgtcacgtttttcgtaattccatggaaaaaggttataattagaaataaattaaattaatgcataaaatttaatctttatgcaatattacaatatcaaataatctgaaattattttcactgtaaccatattctaaatataacaggtgactgtgtaatataaatctaccaagtttttttaaaaataatgaatttcataataaaatattatcttttaaataattcttagggtaattattatgagagttaataaatttatgatacatactaacaatttataattggatgactatataaaaaaattatactctggatgcattttaattatgtaaatacacaaaaaatgtaataaaactgaatttaaaaaatagtaaatgacaaaccacttgcttataattttttttgacaaaccactctctttggtgctattatccaatgagaattagatttcatcttgataatttgtgtaaccttttttatgcaaacctttgttaggaaaactatcaaagtgaaactccagttctattttttcttcttctttagatcagttctaattgtttaatagcataaacaacacttaagaaaatttatctaacttttgtcctttgagtatttattaataattaattttgttacaaaagtcaacaatgtcttatcatacataggtagccaattatagttatgattaaaattaattttctttttaattttttttcctttgtggtcgataataggtttgtaccattccttgtatataaataaatggttaagctggcaacaactcctcaattttctgcatcacatcacattgcgcacagagatcgtgatcgaaaatggcgacgttgaaggttcctgctcaacttccttccccagtggaagacagtgagcaattgcgaaaagcttttcaaggttaccttaccaccactcattcatttctttgatttgaatttgttggcttttattttgttgttagatcatcgatctgcttatcattttctcgatctatctcgtttggatttaagtcttttggtgtgtccatgatctgatggggttttattatatatcaactcttacttagagatcctggaatagattgttgtgtttggtttatgcagtcattgttagttatttctgcttgatgagtgctggaaccgcattcgatgcagtcatatttttcatacgttcattcagttactaaactgagaccgttggatgaatatcagacaactcatgcctacaataagtgctttatgataacttttggtagggcagaattttttttacatttaggagaaagaataaaatttgtttggttcacaattgaaaatctttagataaattttttaggaatcaaagagttacaaataaatttttactgattattttatttatttattatattatataatttaataaaaaataatatgatattttttataataataaaagaaaaattaaactcaaaaaataaaattcacatctctgctataagaaaattttagtaagaaaataataaaaaacatttcagaaaacatcatttttcatgaatataatcttttaaaaatacatatcaaacatgagagaccaacctatgattccccataaacaaaaaatgtgtctcttaccaaatgcctcctaagttcaatctacaagatcgaatacaagccttttgattgtttttatcttcatccaacggttacaatttgctaactgcgtagacacgttgaaaattcgactgacggaatcattatcgttgagatttggtttcttttctttatatatatatatatatatatatataaaatttaagtttcattcttacattttggttggataaacttcccatatgtactcacaggagaaaaaaaatgaaaagatgtagatcttgtgtttttaagaactaaatgcaaacgatgtttggcccagcgttaattcagtaatactaatagttaatattagtatgtgtgtgttcagaagtgctcaaacaagtgaagatatagataactattacagaaaattaatacatagtgaaattggatctttgaataattcagaagttttcaaataagggaatttactttgttcctttgttttatcatggcatgagccattttttattctctcattgcaagagttgctttgattgttcatccaattttgtcactgtgacatatctttgcagggtggggaacgaatgaaggattgataatatcaatcctgggtcatagaaatgcagctcagcgtaagttgattcgtgaagcttatagtgcaactcatggagaagatcttcttaaagatttagacaaagaactttcaagtgactttgaggtcagtttaaatcttttaatatctggcttctttatgtaaatctcaatttgacgcccatttcagttttcagaagttagaattttcaatgacactatcagttattgaattttcaattttgataatactccatttctgtgttctatacggataaccttgattaaaggaaacggatagttgcagttataaagttagtttcttatctaatgtttaatgttttgaatataaaagcgggctgtgttagtttggacattggatcctgctgagcgtgatgcctttttagctaatgaagccactaagatgttgacttcaaacaattgggtcattttggaaattgcttccactagatcttcacttgatctccttaaggcaaagcaagcatatcaagcccgtttcaaaaagtcccttgaagaagacgttgcctatcatactaaaggggacatccgcaaggtaaaaccttaactttctaatgtacttgcttacaccttgataaagaaaagttgcatattcttacataatattcaaaggctgatgcctctgcttgatgtcatttcttcttcgatcaaaattttccaatgtatataaaccttttcaacttaaaagagaacctttgtttagaagtgtgtcctagatttatattcaagagaacctttgcttgatgtcatttgaattgctagatttaaaagcttattaatattaacattttttttatattattttgctatgtctagatgcatggttagttaaattatttttttaggttcctgagagaactttaaaaaaaaagaaaaaaaaaaaagaagcgattccaatcatgcatttgatctggcaatttttttcacacatttttccccctattttctgatgaaatacgtcaataacagctattagttcctcttatgagcatattccgttatgagggggatgaggtgaacatgacattggcaaaatctgaggctaaactgcttcacgagaagattgcagagaaggcctacaatgatgaggagctgatcaggattttgtcaacaaggagtaaaccacagttaacagcaacactgaatcagtacaacaatgagttcgggaatgccataaacaaggtatagaccttttgactgtttatgactcatttctatgattttagcctaacatctgctttttgtttgagtacctactgcagcacttatgctgatatagtgctgaatttatgaccatgttttgttcactttaagaaacgtgatttccactgataatcttgttttagatgaatcaattgctacattttaaaggattatattctgggcttacttcaaaacaaaaaaataaatatgaagacaagatagaaattgtgatttagtgattttagattaatcagtgactggtagttgaactgacaattcatcttatggctgcaggatctgaaaaccgatccaaaagatgactatctgcaattattgagggcagccattaagtgcttgacttaccctgagaaatattttgcaaaagtcttgaggatggctataaacaagctgggaactgatgaaggggcccttactagagtggtgaccaccagagctgaggttgatttgcagcgaattgctgaggaataccaaagaagaaatagcattcctctggaccgcgcaatagccaatgacacttctggagactatcagagcattctccttgcactggttggacatgaggattaagtgttctttctttctctcttcagttgtctcatggaattgatgcttaggctatttgcttttcctattatcatgaatgtgatgttgctgtggatctctggacagaggaattcagtggcttgccggtaaagctgcttacgagggggataaagtataaaccatccctgctgttttagaataatgttttgaatgtcgaaaattcaagacacagcgcttcacctctttattactattaaatcatagaatatttgctgcgtattttttctacttttataaagtcacaattattcctaccagcataccatcacatttcacaaaaagtcagtctagatagcttaaaggcaactataattgttaacttctcaacaatatcagcaaatatacttctcaacaattatcgcataaaaagcataaaccagatagagtaaataatttcttattacaaaaaaatctcaacaattttatttatccaatcatggccaaaaaaatctcaacataaatgaataataaacatttgcacccattatggcaaaccaaattattctgtgtcgggggttataccataaatatacgatgttgacaatccaacacactgatccttccagtcaaaacacggaacttcagaggaatttatagaaagtacacagttaattggacgaatttagatgatcaaatttaaacgagcgcaatgctgcttcctccaccgggggatctgcgggcacctagtagtatatggtctctgctttctgcctttccatcagcaaatatgtcactccctccaccgggaggtctgtgggcacctagtatatggtctctgctctctgcctttccatcagcaaatatgtcactccctccaccggggggtctgcgggcacctagtatgtggtctctgctctctgccgttccatcggcaaatatgtcactccctccaccggggggtctgcgggcacctagtatatggtctctgctctctgcctttccatcagcaaatatgtcactccctccacctgggggtctgcgggcacctagtatatggtctctgctctctgcctttccatcagcaaatatgtcactccctccacccaggggtctgcgggcacctagtacatggtctctgctctctgcctttccatcagcaaatatgtaactccctccaccggggtttctgagggcacctagtatatggtcgctgctctccgcctttccatcagcaaatatgtcactccctccaccggggggtctgcgggcacctagtatatggtctctgctttctgcctttccatcagcaaatatgtcactccctccaccggggggtctgcgggcacctagtatatggtctctgctctctgcctttccatcagcaaatatgtcactcccagccatttctctaagtttagctctgctcgaaggcttttccggtgatcctgcaggaacatctcccttgaaaatattattacctgtcatctctgtaaacttctggtcatgcatttttttcctcaatatcttaactggttgttcactgaatgagaaattactttggccatcggctcgctgcaacaataacaaaactagggtcaaaatgtaatcataaagaggagggagaaggcacatgagctaaagggggaagcacatggattagaaatggatgaatttacagcttaatttagaggaaaaattaatgtttcattattgaaaacctaagaaaaacatgtcttttgtttcaacaaaaaattctaaaaggagaaaaatgaaatttaagaagaaatctgacacggaaactacaaaaacatgtagacaaactgatggacctcttcaacataatgaatgtgcagtttggctctaactcaagataacaggctcatatcttggcgagggaagaaacattaatgatagaaaatttaacatccccaaataaatggtattcttccagagctgcaaccgtatttctattacaacccttgggttataactacataaaattagacaaattgttctgcatttaaattttgcctttcaggaaaccattaggctacatttttgcaccaccaaaggtaaaaagttcatcactatgaatagccataagacaggattagagcaattaaaaatttctgtagacatttatccaatataaatgatttatatgactcgtgattggtcttcatgccaagaagatacttacattagaaacttgcgcagatgtgctcactttttgtggaacagatattctggtgtctttactttcttttgattccaaagtgtgtgcagcagccaatgaacgaggcacaatttcaggaggggcaaatatatcacttccgctgagctccttggtcttggcacttgacgtttgcttgttgatcttcgtgactgtttcgctttgatatgttccaccaagttcacgttgctttgctatctcgggaagagaggttggttttttaggagaaatgtttccttcagtgctgaatgatatctgactgattccattcattgcttgctgagatgcaattgcagggaaataaaacaagaatactattatcacaatgaagttggtatttaagaaacactcgcattcatatggtcaaacctcaaattgccttggaagttggaataaggtaaccatctagcataccttatatacgcgtatgcttgttctgttttttgaatttgcagaattttcttctgatgtggtatcttcagaattacccgaaaatataccacttccagtcatctctttcaatttatatcctgagcagggtttcctgagtatcaagaagaagaaaaagaaaataacaagaagaagggacaggattactctgagaccatgtcagaagagaaaaacgaaaaaaaaaaatgattggatgcacaaggtggaatttgacttcattcattgggctggaagcctatttatataaaatgccacaaagctataagaagaaaaataaagcaaggtagttacaatcacaacagaacagcaaaataacagaaacaactagccatgacggctaataaccgaaaataaacatattaaaattaatcctttaacagtaaaacacatgaaaagatatgtttgacaacaagattatataacagcatgcactttttaacttaactagtagcaaacatactatagtataaattcgttatttcagtttaatttttatcacgttgaagttttttactctgacagctaaataaaaaaacactttaaatagtaaatatgaattttaaagcaataatttaattagaatgaaaatattatgaattatcttgtataatattatgaaaatattataacattattaatattaaaacattttatttgtaaaaaaaaattgatgtatttttttttttacaaaagatgttttaatataattggttcaaatgtaaattaagaaacaaaagaattttggtaattagccgaaatcatgagatcagtttttatttatttttttttgtacagcatcatgaatgatcagctgtatacacaaattcgtaccaattagcaattttccaaaaaataatttcgtgttgattgttcatcataacgcaattcttagagtttcaagtttcaacaactgaatgcaggatgccaatgattggcttctcaaaacgttcccaataataaatagagggaaaaaagtcgacacaaactagaagttgaaaaaccgcatagggtttacaagataaagaaacaaacgctgaatcggatcacagaacgaaacaattaaaaagttggaaaaaaaacaaacaataacagatccaacactgcgatagaattgaaaagaaaagatgatagcattacttttttgttagactctgtgcttcttccgcggtgagcttgcttccgcggagaacctcaccgattttatcagaaggctgtgaatagataagcgattcgaggaacaagctcattatatatcttcacgagagattcaattgaaccaactaaaccgatgcttaaataaaatataaaacagagacagtaaatagaagtagtaacctggcgagagcggtagccggaggcggaggactccggcggaggttgttcggaccacgttaggagatcggaggtggaggtgtgagggttccttagcggcgtggttctctggctctgcattttgtttagtttgtgaggggtgatgttattcaccacaccagatttgaaaaaacgtttcaacgataacgaacccaaataatcactatccaaattcttttctcttctttcgatttccaactgcaactatgccacccccacctacaatttacgaataatattatgacaaactctcgagaggttgagttatcagttattatgatggcacctagaaatggatactcgcactacatgctcaacgtgtgtcattccactcccttatatataactactttgagtagtagttataagtgaaaatatttttacttcttaaataattttttagtatcttcaaagtaggagtatttttattgacaaatggtggtttagttggtacataacatactcatattttaaaaatatatgggtttttgatttccattaatattgaagattttgttggtcgatgatatgtaaacaacataaaagaattatttattttgattttagtacctaagctcttattgttatttttgacataggtagtcgttattaatgaatttttgttaattgatggtgtggttaaagaaaagttcgcatcaaatacaagccatttaaatcttatcggtcaaatcatccattaaggtacctttttttaaaaaaaaatgttaaagtacaaacaaaaattagataccaaaacatccctattttagaagtatcaaaaagttatttaaacctaaaattaaaaaaattaattattatcatcattgtatcacacaaatttttcactcccttccttttccttttttttcaatgggatacttcttgaaacatggcttctttgcaacacacaaaagattttggcgaccacccactgtcgagctgtaacgaaatctcatggctgagcagctgaaaacattcgattatgatttatggcaagcaaattgaaaatgacgtcatagtagagggagacaaatagacttcaggctatgcttgaatggaaaatttgttaacaataaaagtaagaggggaggggggataaaaatttgcatgaattaaaatgaatggatacaacatatgaagacattaggtggggcgagagttgttgtgcatatcatatgacaatatgatgataattcttttttttttagttaaggaatatcatgccgagaaagataaaaaagagaggagcagagaattaatgtgatgaaatgatgatgataattaacttttctttgttttaagattaaataaccttttggtacatataaaataaggatgttttggttttgatatcaaaccttaagattaaataacttttggtacatataaaaaggtagcagtcaaggaaataacataaatgctaagtcaataatttttaaataatcaaaacttaatgatgtgacactatcttagttgtgtcaagactgattctaataagtctaagtcatattaaatatgattttaaatgttagtaaaaaaagttaacattacattgttatagtttaaatgttaaaaaatattttttaatctataataattttatcaaatgtaagtaagattgttacatgtagaatatacttgtttccttaacaaattgtagaatttattaatttttatagtaattatctaaaatattatatcaattattatttataattgaatatcaatatacaactatttatattttcaatgtataattattaaactcatttcaaaatattttgagggactaaaaatatattttatcttaaattttttatatctctttccatcttagcctagaaaaggatgacaatttaactatttctattttcaaattataattatagatccactattagaattatgcttaattaagacaacgttatttaaggagagagagattaataatcgatcagctgttaattgtgatatttgaccactttatcaacacttaataattggtgggtaatggtatatccctaaataagtagcttagacgttcccctctcaacacttacggcaatttctctttccagaattccgaaagttttgtttataaacgtagctaacaattaattattccgtgtttcttaattatctgcttctagcaatttaacattatcgtttttgggcaagtaaaaactacttatctccttctaactctttcagtcacggctgcaaaacgccacaacatcttcatgacgattttttacttccattttttgtggcttcttatttcatcttaaggaaagttatactcaagtaacttttagtacaaacaatgagagaacaaaaaaaaaaacaattagtttaagtaaatagaagttgactttaaaggtactttaatttgtgttttggtaattttgtttttgtaacatttatatttattgaaatataagcggataagaatgtgaagattgaacactctataaatgaaaataagattcataaatctaagctttaagattttagattaaggtgtggtgttaaatttaagactcaaagataaatttgacgtcatatcttaacctaaaaccttaatattcataaagatcttgttaaaaaattataaaaacttatttaaaatattatcaaaattataaaggacttcaaaataatttaaccaagaaaaatcacatgtacaatttgaaaagaaaaaaaaaatgcaattatatcgtacttaaacttacaaaagaagttgtgattttatacgggaacaaattttgcgaaaaaaggtatccttggggaaaagaaaaactatcttagagaatcattttccccaatttaaggttacgtttttgttagactttatgaaatttttcttgagtgtttaacacaactgtgtaacaaagactcacaaatttattaatgacaaatgatcttatctaaaacatttcaggtggtaatacagtactttggtatttgaaagtggtgtatgtgcgattttcaaacttacacacgaagtattcaaaaaaattgtggccatagctccctccatcaacatgaacttatgaagaagagccatgtataacgtgttgcaattcatcagtgatcaccctaattaacatttgtggtttggatacgcctacaacaataacggcaatgacccttctacttttaattgtctatcgactaatcaatttcgtttattaattaattgttaataacggaagaaaaaggttttttcaatttctagttggtagatctaagtgctaagacagaaattattagagtcgtgagttattatagataacagatagataccctcataaattgatagagtctttgttaaacaattcaagggatgtggacgccaaagttggcaaaagttgttgcatttcggtgttccaccatatatatatatatatatattgataactcacattaatacatgcaatagttcagggtggatttcgaaagattaaaacaaagaaagagcctaaatataagaaaaataaccttcgatcccccttttccttcgtgtatggaggtttgagaagcttgttagaattaatgtgaattataacaatattgtatcccctcttaagtaaaatatattggtattcaatgtaaatcagtttaaattcaatatcaatttaatctaataagtaaatagattgttccgtttttcttttgcttcttttttttaataaaaatattacatgttaaacaaaccatcaagtatataattaaatataacgaaaaaacttatcaaagtactaaacatttcatcatgattcataacatggccacataggaacaatgaaggcaacgccaagggatgagatgaaagcagttcaggtggcacaagaagaaaaaagaacataagaaaaaatcttacacaacagcatgggagtttttgaaggcaacaaattagctcgaagaacccttctttcctgctgttttattgattaaacaatttaaatattaatcattacatccaatggctacaacatatgaaccaatatcaactacctaagaagaaaggggggaaactatacatgattgatcaccacctatacactgcagagattatgcaatggttgtgtgctcgaagaacttattatcaacaattttggctgtttcagctgtttgtttgttagtcccctagtaaacattgaatctaggagaatatggaaaactcaaaataaaagcatataggattgacctttgttggcaaacctaatttatgctcggaaacagccagcttgtgatagactcgactcgacaacatctcaaatggtatactgagtccatgcagcaacactgttttagtaaactcactgcttgatcaatcgaagcttccaattaccttcaccatcaatcagccgcagttccatggaatgaaatggtattaaagcaggacgctgggggcagcagcagagaaatttagtttgatcacacattattatggctaacatgcaggtttaatgttagacaagctataactggtttatctagagctaaagaaataaaataagtgtacactaggaaggaaatgaggcaacatcaaaacaactaattagtgaactactcttaattcactaaatttaccatgacagtatttttttttttccaatatacttgtataatcaacttacttgtgaggaagtaacaaccgtgattcccatatcttttgcaagcccgtataggtgttcttcaacatcaacactagttgcactgccaacattattttttttaggatatgaaacaagattaacaataaaaacaagcaacaatttctctgaaaaggaaaagacaaaggcaaatcatacatacttggtgcactcgtcaaggataccaaatttgggcttatgaaagaacaagcgtgccttacagaacagagtgagcaacattaaaaaccataaaagagaatattttaaattataatagatgtctttctttaaggaattgaagactttctaaggggcatgctgtataaaacaaaaatatttaagaaatttaaaaaactgtctaaaatttcaagagattatatttacataccatgcccaatctttgctgttctccaagagaaagaatgtcttcccattttaaatttgcatcccagttgcttccctccctttctagaagataattcaaccgaacactctctaggataacctttaatcgtgtgtctaacaaatttcgggtgtcagcatgcttttcacctgaattagcaagttataattatcagagctaaaatggaaaagcaaataaataaaatgcacactttaaaacagttggagaagagcaagaaattgttattgatctgtaaaagaaaactgaccagaataattttccccaaataaaaagtaactaacaacgaacgccttaccctaaaccccaaataaaatgttagcaaaagagaaattttcaacaatatcagcatgaacatcattctattgaattgccacaaccttagaatagctcagaagaaaacttattctcagctagtggtgattaatgaaaagtaacacaatagaattgttataaactttagttgactcaaatactaaaaacagtagacttcaaattactcactttaaccatggtaatatccaaaattattggtcaatagagaatcaaagcagatttaccaacttgccacttgcttatgttaatttatagtcagaaactttcatttttacccataatggcatttctaaggcctgccttatttctcccacccaagatatttaccttttccatacatcttcagtactttaacctctgcttcctcacaggaaaggggatatataatttgatcccttagggttcccaaacatgtatatggacgttgaggaacatagaagatgccacaaccatatccatcctcttcatccacaacttcagatggtctagatagtcttccactggcaattggccatagtcctctaagaactctgaaaatggaactttttccacttccatttggaccttttaaaaagaagatacatgtaagaccaaaatttacatcacattggaattccctcttctgaaaggacaaaccaaataaaataatgactataccaaccagtaacaagtaggcttcccccatgcttaatgtcaaatattaactcccttgccaacatcttttgagaaggggttatgatatcaacttttgagaaggaaatgacatcactggaatgaacatccctcactggagatatagcactaacactcgtgaaattctctgtacggtagaaggtcatattagcacataatttgatggctattaaagagatttactgccatacaaacagcaagatattgattgatatgattgattataaaactaaagaaggattaaataccagattgtgccgcatcaagaagttcttcaagttcaaaaatccgattaattccaccagagagttctacaaactttctatgcaattcaagaatatcaccgaaagctaaaaagctttgagaaacaacagatgccaaaaacctcagtgcatgtgctagctcacctattagtatagtgttgtctgtgagagaggagagcaacaagagaaatatagagtaaatgattcaatgcaaatatcttaccctgagtagttactgatgcacggtctcccttgtgttccatggcatatattaagctcaagccccaagtcacattatgtggaagttgctttgtgataaaatcatccaggatgccaaacagccacttcttttttaaaaggtactcggagtggctgagaagttccctgaatctagactcgaccatctgctcaacattaagagagtaaaatttagagattgacgataaccatagttttaatctgctcctgttattaaaagtagagtcatccaaccattatcaaaacataaataggaattaaaaagaaaaataatttttttgaacttttcctgtcaaactgagacccacttcacacttccccatattagagccctacattatataaaatttgatcaaacacataacatgtataaaatttagggtatgcttaatcaaggaggtggaaaatgagaaagtggaaagttatgagaggactgaacacggggatggaggctgagttttactctttattgcttggtaaagattgatgatgaacccccatcataatggtacagttgctgctttatgaccagacagtcaaggttctaattgcagaaacaacctctcaactcatagttataacccaactgccctttattgcttccaaaaggataaaacttctttcaactcactttcaagtaacaggagtgtccaaaatttgaatggtgaattggcactctagtttcagtcatcccacatttttattatgacaagcattaggtttcatttcaacctttcatgtcctcaaacaagcacacacttaaagaaaatacattaaatattgcagagttaggatgctcacagctttttctcgagcaccacctccaaagaaagcaacagattcagcatgagtacaaagtctttcatgcatgaacctagaaaagcataaagagaaaccgatcagaataatttcaacagaactatttgattagtacctggattgttagctgacagtagaatgagtttacctaaatgttccttcaagctgttgttctcgactaatcaaatcaccaaaatctggagtaacagttcttagaaatcccaaaccgagtaacatgtaagcatagagtatggcaactcccctccgacctgttaacagcttcattctccaagtgaacctttagaataacgaaagtactcagtaagtaaaaaaaaaagagcataataactctattttgcatcaatatgttaattgaccatgtacaagtaaaatacaccatagtaacataataactctattttgcaaatgaattactcaccacaaaatatccacagatggctttaccattccagtgaccagtcctgacaagtctgttgttaacttctccaagtcatgagttatcctctgatcagcatcaacatttttgcttgccatgtggaagacctacaaagaaatgtatgtaatgtgaattcagaaccaagccccagtcatccggcatctgcctaaatagcttaaaagcaaggtgaataatatatttattattcataataataacatcacattttttgttagtgaaatccaaacctagtctacgttctcaaactattgacatgggaaatttggtctgtggcatcagtaaggttcctgggataacatccctatggagtgtcaaattactgagttaattaattttaattttcccacattttacgagaaaatgatttgtggttaaatttaaatctaataccatcaatcctaaaaattgccaacttcacataaatgtatgtgaaggtaaattttgttatttaactcaatagttggggacactggaactatgaagaggtcaaggaacaaaattgaaaactgagttaaatttgaaggggaaatagtagaaagtaatgatatcaataagactgagatacaaaattatttcaataaaaggttcaacatataaaaataaaacaatatgtgattgtggttcatcaggaagtagtaattattcaaaagcataggtatggagttatggacacaaaaacaagtttacagtatgaaaaaaaattaaagaagtgaagctgaggaatgaatgaatagtttaccttgtagaatgcattgtttcttaagtagttcttgagtagatgttgtgtcaaacgaatctgccccccaagggctagcctcgcagtcaagtgtctgtagaacaagacaacattttaatttttaaatttacttttcaaagactcttgttaggtcaacctattcaaactttttcccagtttcaatgctttgaactatctacaaattatccaatatttttcatattttaagtgcaatcaataatttatgaataatagaatatagaatcaatgggatgtaaactcaacaaaagggcgtagttgaactacatcacaagccattgtaaataggcactaatttaggataaaatctccttttatatatttagaatatatttgcaattattcagataatttttttcctatttccctcttgtcaatggaattgattagcaggacattagttattaattggcacaaattgcagaataattgttgttattggcacaaatttgtgggccattcaaaaacagcaaatcttacatgattatacagctgtaattatctccttaattagttatcccagttgtaggatagcatttattgaagattggctatttaatgcacagatgtagaaatcaaattgtataaacactatttaatgcagaattctcaacatgagagaacaaacagtttatcatctgcaaatttcttagtctaatatggtatcagtctaggttgcgatcatatcatagttctgtccaaaattcctaacctcttggttttgcaagactatccagttcttgctccttgttccttttgtgatttctctcttgtgattaccttttttttccttagccttatgtctaatgacaagtatgatgcttattcattcgccttaatggcaagaaccattctgcctgggcattccagttccaaatatttgtcaaagataagaatctttggggtcatgttgacggcaccagtcctgcttctaacaaagaaaaccagccgaacgaatatgatgcatgggaagtcaaggacgcctaagtcatggcatggatcataggctctgttgatcctcatattgttctcaatcttcaaccattcaacactgtagccaagatatgggcctatctcaagaagatttataaccagaattcatggcatggatcataggctctgttgatcctcatattgttctcaatcttcgaccattgaacactgcagccaagtgatgggcctatctcaagaagatttatagccagaataatactgctagaaggttccagctaggacaagaaattgtcatatttcagcaggatagtctctcaatttctgaattttatcttagttcatgaattgttggattgaatacactgacattgtctatgaagatttgtcaaatgaaggtcaaattgcagtgcaacaagttcatgagactacaaaaagatatcaacttcttatgaaattgagatttgactttgagagtattcgatccaatctcatgaatagagctcatgtcccatccttggatacatgcctcaatgagcttcttcatgaagaacaacgtctcctaactcaagcatccatggaacataaaaatctggctcttttccagttgcatatgctgcacaaggaaaacttaaacgtcgagacctgagtgttgtccaatgcttctattgcaaagaacttggacattttgcttcacactgtcctaaaatgttttgcaattactgcaaaaaagatggccatatcattaaagaataccccataagcccaccaaggaaaactgaaacagcctttactgctgcagctggtccttctgcgaatcaaaatgctcttttgcctctgcacaaccaatgaccctgaaatggtccaacaaatgataatttttgcattttctactttagggctttcaggtaaacctttttcttcttgtactctggtattttgactctggtgcatccaatcacacaccaacagtgttgaatcccttaaaaatgtcacaagatattacggtaaccttcaaattcatactgctgatggaaacaatctacctatcacagctattggtgacatttcctcctctttaaccaattgttttgtttcccctggtctcactagtaatcttatttttgttgatcaactagttgacaatgatagcaaagttgcattctcaaaatctggttgtcttgtgcgggatcaacaattagggaagatgatcgcgaaggggcgtaaagtcgaacgtctttttcctctttatttctctcagcctcaatgttcttttccgccttttgtttcttgtaattcagctattgttaattttcaaatatggcataagcgccttggtcatccaaactcttatgtacttcatggcttactgaaatctagtgttcttgataataaaatttccttagtgttgttcaatttgattgcaactttaacaaacttaggaaagtaaaatactaccatttccaattcataaatcaaaggtaaatcagccttttgatatgaagtacactttcaacagaaaggcatttttgtcaatcagcacaaatatattcaagatctattcaattagttggtctcactaattctgctcctgacactccaatggaaattaatctgaaattgcgacgagatgaagatgaccttctacaagacccaactttctatagaaagttggttggaagtcttatttacccaaccattaccagacatctcacttgttgtccacatagttagcaaattcatgcaattttcttggtgtttgcatctttcagcagtacaccttattattaaggatctacttggtacttccaaccgtggttttttcttccctactggtgcatcaacacaacttcaagcatagactggttctgattgggctggatgtccggaaatccactactgactggtgtctgttcttaggggaaactccaatctcttggaaatgcaagaaacaagacacagtctccaaatcatccactgaagcataatacattttgacaatacaagtgtcattcacattgccacaaatcatgtttaccatgaaaaaacgaagcacatagaggttgattgtcactcaatctgggaggcatatgacaatcgagttatcaccttgtctcatgtttctacatctattcaactcgctaacattctcacaaaatccttgacacattagcaccataatttcctagtcagcaaattgatgcttttagacttaccaacatcaatttgaggggagacgtcaatggaattgattagcagaatattagttattaattggcacaaattgcagaatattggttcttattggccattcaaaatagcagatcttacatgcttatacagttgtaatcatctccttaattagttatcccagctgtaggctagcatttattgcagattggttatttaatacacagatgtagaatcaaattgtatgagcactatttaatgcagaattctccacaggagaacacagtttttcatctgcaactttcttagtctaatacctctttcccttgatatgtttaatttctttattttgtttaataaatttagcctataaatagggatttgtgcttgtattgtaaaacacacctagtaatattttttttcagttcttttcttttcaagttcttgtctttcaaatcaaacattacattgaaagacagcagttgtcatgtacaaatatcaataaatgaacaataagcagattaccaagatttaggctcagcctaataatagagaaacatttcataagcatctaagatcaatttattgaagaaattcatgtatttattgtggaatcatggcttgattctttgcgcaagaaattgaatggtaaatggtaatatgtcaatgtgaacaagtattgagatatccattccagtcatatactgaagatcaaatacctaatttcaaacccccacaaaaaatattcattcatggaaggaacaatttagacacaagtgaatcccaaattaccttatagaaggtgcaatgaaagaagatgcagcactttgaagaacacttataccaattaatcgaataaaggaagctttatcctgctccaaaacaagcttcacagtagtacctgagagcataaataccctagaatgttataaatatgatctctcttaataatgaaaagtcaaagataggacaataccattcagtgatgcaatacgatctgagacccatgttcttgaaacaacaagaaaagcaacagcaactagttgtgctccttgtttatcaaatatggtgggcacctgaaagcatgcagtacacattaaaaaaatgcacctgagatctatcgtatttatggattaactaatgtgcacaacacatcctttaaaaaggatgttggctcatagcaagtcatcaaggagatagtgcacaaatgactgcatagtttcatttgtttcaccgcattagacacttaactgcagacgcatcactgaaatgcataaaagatgtactaaccaacatccttttcatagtaagtcgtcaatgagataacacaaatgaccatagagttacccagggcccagggggtctagctaaattggttgagcagtgtatgtgagttattgtaaacaccttgataactgcatttgattcatatgtataaaacaaatgaccagagtttcatttgtttcaccgcactagacacttgactgcagatgcaccactgaaatttaagcataatgtgtaaagaaatcttattcatattaacttcttaaataggcgctattgtaatttgatagaaatataaaccatttgtgagcctacaccaaacagctcaagattttgggagagttagcctatgatataatatcaaagccattttaactgcttcagggtttagacagggaaaaggaaaacagaatagcagctaacaatgtattatagtaagaaattgcaatacccaaaccctatactttcatttatactgataatccagttaagtactagtgttacaaacagaaggccaaccccattaacaataagactaataacttcataaccctaatatcttccaaaaataaccaagtgatcaagagtttagtaattgtcacccccattttgaaggattaaattaaatttaagcataacataaaagtaggcctgggtattattcaagcttcaagccctcacatgagttttttttttttgggggccgggggggggggggggggggggttctagtcagtgtagatgataaaccaatatagacctccaccaaacagcttaaaaagcttttggaagtgttggtctttgtaataatttttcaataagctaagtcaaactgtcaaagatgtctaggcccccatgctattaaatggaataaagtttctatctttatgaattaaaaagtttatcatcccccctttttattgaagctacttcttaacaactttcccagatatgttgttatccagaaaaataattatatttctttgtttcaaagccctagttggttcctagtttaaatcttcctagcctctccagcaggctccaccatcacagtcctgaaactaaaagagcattcaattttagcaagtgaccctgatcttaagataacctctgattcaataaactcattaccactgttagtcaaacctaaaaactgaattggttgatcggacatcctgattttgcataactttactagcaaggtcatatagtttgagagaattataattgcaccaactttgcaaccaagaaaaatctaaaaacaaaactgcaagtaagccaacctacataacaatgtcactaatcactatcaatcagaagtatactagaactgcaggttgcagggatttagaactatagtaaattaaattgacagaaaagatctaggaagaaatatttagacttataaatttataattaaccacagaaaataacaacacctaagattttcgtaaataatgtactcaaaaacatatagaattaatcaataattcaatatgatggaaaagttgttgactcactaaaacaatataaagtaaaaatcttactggagcatatcaattcaagatacttaccaatactttgcacatggcagctactctcatcggcaatgcctttgtattaacatgaagttgggggacagcagatggtgaaatattacgctttatagatggagatgatgctattatcacttctgaaatatccgattgtgcctttgaatttgagaatgcagaatcctaggcaaagaaaaaaacaaatagggaagctttcatcatcaatataagataatgaaccgtgaagaaaccaaaaacaccagaatcacaatatctaaacctttttattcatagcaaatgctcgttgaactgccttggcatcactctgtctttttgtctccaaagccttcattgtatcattccccaattcagtagacgagtcctcactggagttcaaaatttgaatcttatatttaattacagcttcatagtaaaacaataataagcagcacagtaaagttccaaccttctatgatgaacactccatcctccctcaccatctaaagacaaaaccacatcatggaatgcaactaatgctggacgatgtgatatggtaatacatgatgttcccatagccagaacattagcacaaaaacgttcttccatatcagtagtgacagcacttgtgcactcatcaagaatggcaaatttaggtttatggtaaaaaagtctggccatgcccaatcgttgttgctcacccaacgaaagttcatcaccccagtttacctctgtttcagacgggtaccgatccaatagatactcaagatcaaccttcaatatatgtacaagcaattcagatgaataataatggttaaaataacatataatcatcaaacactaaacattaatgtggcactgagatagaaggaggattagatgtgagtttcacatttttcaatagctccaccatcctgctatctgtaagtggctcaacctcttgatcagcagtaagagggtaaattaactgatcacgaagtgttcctacagcagtatatggtctttgtggcacataaaagatttccttattaagatcagatccaactccaggtttcacaatatgtccagataccaagggccaaagacctcctaaaacccggaataacgagctctttccactgccatttggaccttcagcaaaataattgtgaattacatgtcaaaacaatcaaccattagaaatcttattttaaaaatccaattatacaagtgaaacatagtcctttcagattgtcaaatgaaagctaaacagataagtatcataacaattttggtttacttaatcaaattccaaattatctaattttccagccccttcaaatgcacatgctcatcaggattataatgaccaaccaggagtgaacaatgaaacttttactattttgttgttagtttacattttcttgaacacatggatatgtgctagtccacacattagaactgatggattgctcaaactgtgaaacaaaacaaggcttaagaggtagaactggttcaatgatattcccacaaaatgcatcaaaggaagtgagattttaacactgtgcgtagcatctgtgggcagaatctcaatcactagactacaaattcactaattaattttattacaattattatcattcaattgtatttgattggtgcacataaaattaattatcaatgcaaaaaaccttttgctaaaaataagcaacatttatgaaagcagtcaccttattaaaccagttaatgatcaacatggcaaataacagttattaaaccagttacattgtcttgtttgattgataaattaaaaattaatgcaatcctaaactaactagaataacctaaagaataactgttagaaaattcagcaactagtaatgatcaatagtcattactaaccacacgccagtgggtgaggtgaattgccaggagaatgtgttaagggtaaaagtgggttatagatgacatcgggtaaaaacaatgctcatgcgttactctggacagctttccaactcaaccggtacatgaacaacaagcaccaagccttatcccactaaaagggaatactcagtttttatttccaaccagccaacatcaataatttacaatggcacctacagaaattgcagaaaacactcatttgaaataacatagcttgaatataacatgtctttgacacagaacctggctgaatgcattaacttaggcacttgccaataaaaaagagacaaaggaaacaagacaaagttctatttacattattgaacttggagtcaatagtacacaaaccttattatacttccagccatgtagatacaagcacaaagctgtatgtacagaagatatgcaaaacctttctagtttctagacactatgaatgcacataataaaaattaagccccaaaatgcatgaatcaattcaacttcccccaatcaaatacacaagagaatgattatttcaacaaatgaaaagaaagaataatgaaataagatcaattatcatggttgaaccaaccacaaaaagtaaaattagaaacgaacagcaagcagagagttcaaatggctacctgtaatcaaaagatttgatcctgattcaaccttaagggtcagatcatccactaatacattaccggtgggggtcacaacctgaattttgggagcaacaccacaatcaagatatgaaaacataaatagaagtaaatgttcataaatagtcagcagaattcactagccttgacaccataaaatccaacatagttagcttcacttatgtaatttctacttccttgtctttgcagtgaagatttcccattgtccaggcttagctctcttgatatggtcattaactcgtgaatgcgatcagcataaccactgtaaaacatacagataactagaatatttgtatacaaaaaaaataaaccctagaaaggaatagcatcaaagcatgtcctctaatatcaacttctaaaggaacaaatgaccagtcaaatatacctgagtcggttgagccgtcttgcactaatagaaagagttcctagagattgaaataaggaaataatgacactagtatgatatcttagattgcttagcatctctgcacgccctaaagttgaactgtcaggccttagatggccagaaaagaaaggttcaatgatcaaaataacagcaacagtagcaccaaggtacttcaataaaaaatcctgaatcatgccaaaccaccaatggtcatgtagcactctattaatatgtctaactaaggtcctaaacttctgctgaatatgagcttcttctctcctctctccaccataaaatgctatactttccgagtgagtccttaaccgcgagtgaagctgtcgatactctccttccaattcctgctccctggacataagtttaccaaatgcaggagagaagtttctgattgtagccccagctccaagtacgtaggcctgcagggaaacaactgttatcaaaaagacaactaaacttaagattacatcaaacaggctccagccatcagcaacccaaaacaaaattatgaacaatagctgccagtgagaaatcagtgatacagtacagtttaatgagagtaccaaaatccagaagatatatttagggcttgcatacgaacacagccgccaagtgtatagcagtccatcagtcaccgcagttagatcatcctgtacaatctcactcaactctgaacagaaccttggcacatcactggcaattctttgttccggattagttatccgaccatcaacatgtgatattttgtaatacaccatgttctgaaataaaggtaaatgataaacagaaagctgacataaaaactaaataaaacattataacatttgatgacgcatggactactcttcctataaccaccaaaatatgtgcaatagtgcatgggatggtgattggcacccttgcaatttatatatatataggggcttgctaatatgcacagaccactttttccattggtgtgtattagcaaggtgcaccaaaaatttaggacagaaaaaccaaccttatcttttattctaataaactctttttagggatactatagtaatttgagataatttattttaaaaaataaagaaaaaaaatgtcttctctctcctactccctcatgtagtcacgctcatttaacattttaggtctttaacgaaaattctcaaggaggattcatctctctttttctactttgctttcaacagggcatgtgttgacctcactacatttcacctctattgtgaaaataaatttaatatggtgtgtgcatatggtgagaattagaataatgactagcaagagatagttccatatttatgcagaagatatcagcaaaaccgtgttgtgtgcaaattagcaaaacagaagccgcgattgaggatgttgcggaggaggttgcagtgcagatccgacatggggagaaaaaaattttaggggagagaagcaattttttccttatttttaaaaaaaaaaaaagaatttatctcaaattactataatatcctaaaaggagtttattagaataaaagctaaggttggcttttctgtcctatatttttggtccacattgctattacacaccaactgaaaaaatggtgtgtgcgtattagcaagccccatatatatatatatatattgaattctggataatgactcttattttgggaaaagattgagcagtagtacaaagcacctggagggatagcttaaaactgaaatgctctagtcaggaccagtccaagatcccaaagctatgcccaaaacaagaataactgaaccacaagacccctttttttattaattattaataagttcaaagccatgtacctagctgattaagagtctgtaacaactattgtcctctttaagcagtataaagacatgacagaacttaaggctaacaggaaatttttgaaagcattgcatattgaactttcatacactgcaaatgaagaagaaaacagacaagccttataaacaggtaaaaacaactcggaaagattttagttcacaagtatatatacagacacttcatatgacaggaggaatgcataaatggataacaagatcaatacagacaatcaaatatagtaagcttttacatacaaatcaacaatatctacctcaaaatagcgagaatggataagtttagtcaatattttacggaagtgcagactcaaagtcccagtaatgtacttagatgtagactgcatggttgataagaggaaacacaaaagaatattttctgaaattagccgcagaaacaatggcacacgtcgaagaaaagcagcgcgaaataggaaaccttgcacttttgctagcctgttgctcaaagtggttcgcagcacctgcaaatatgtgaaatttaaatgtcattgactatcattattatttatttctggtgaatcaacaaacacattttcttttctgatattcagacatctattctcatacaaacttgaacagtctactgtagttttctattcaaataaaaaaataaaaaaaataaaaatctctttttccccaatttacttaaacactctactatgtctacatagtgggtatacatgacatgttcatgaatgatgcctcacaaagtccgtcatttaccccttaatctcaaggataagttgacagagtaaaatatcacaacaaatacatgaatacataaagcaactgtgcattgaaatgttgaagataagcacaaagcatactatccataacaaaatagacttaccactatagaaactaaagctaaaaggttctttgcacctaattggcccatctcagataaaagaattgcagcaaggacttgaagtgacttcaaccctcctttcttttgtttattctttggtgcagaagttcctttcacgacctcctcctttgtgagttctttatcattattggactcataggaatcacctaataaatcatctctattacctctaaaccttgattgcacatatgctgcagttccaccagcaactaagataccagttgcaagtagcaaagtttttctggcacagaaggacaatgaataaacaagataaaaataacatgcaaaactagttcaacattgtagtgattttattaataccaaacaaattagtgtataatgaaaaacaggatactactactaatatgaagacacaaggctataatcgaagtggaaaaatatttatctgataaatgtaagataacaatgttaaactcaagaagaatacatcaatatttcatccaaaatcaatcaaccacaacatacatttcccttaaagaagcaggaccttagagaaataaattttagatcaataaagaataatgaaatttcttaacaatagttctattaggacaagttttgcagcttttctgatctctaatgataagcctttaagcatatgtttcaggtggaaaatcatacccaaagaaggcaagtttaagggtcaaccattttactctaacgaaaattcttgataattaccaatttctacaatacttatcaggtatctgtttctaaggattgaaatgcatgtagaattagaggtcttgagattccaacacagggattttgatgtagcataaaccattatctaatcctatttattcagtattttttggatcaaacgtattagtattgagcattgttgcaaagtttttaaattgtggttgactgattgcaattacaatttcggaaaaacctggatattgcagaaaattgtagataaatgtggttgatgcaaatgcaattgtggtcatgctgtggttctaaaataaccataacaattctttaagggatcaaacttttgagatttgagcattatgtattctattgctgattatgagaatgtgatcaaatattctcttcaagcataaaacaaagtttagttatagagccattacgggaaaaaaaaagttgataaaagcataaacttggtgtagtaggtcaataggaaaacaaattaagtggcaagtcatcatcaacatctaaatgaacttactcatcaccaaaaacattcagagaaaaagttaatatacctccttgaagccagaaaactccggccatgctgagttagttggaacagttgaagggaagacatggcggaagatcaacctctctttaccaacaaatgaacgtgtcacaattgctcctcatatcttctggggcaacaaaatctagccaaatttaaaatgcacagaagaatgacagatcagcagccagaacagtgggaattttcaatctcaaggcaaagtggcattctttagatgcaccatgctcgtttactcacacaatcacattattgaggttcccatatacatgtcaaaccatatgcacatattttgtgagcatggtgtttcagttcaagataccaaacaatgacctcatcacatcaaaaggataattaaataacaacagccacgtaaccaggtatcttttaaatcagatatcactcattattaagtataactaaacaaaaatatacgcaaacaaatttcctcaaagtcaaaaaaatattacatatactaacataaaactctccatttgtccatagcagatcccaaatgtgtaaaaatccctaacagtagctcaccttcaaggtcaaaaacgttaaccatgctccgccaatccaacgcgtagaacatatttgctaaaaaatagaatattctagctcaacaacagcgagcatcttcgattgttcgtgaaagtaagtccacagcagcgatcaaagcaacatctcagattctgcaataacgtcattgatcaccgcaaaagctcgataagcgcatccgaagttgtatacaatagagaaatcgtttttcacataaacgaaaacaagtcaaacaaacctaatatacaatatataatcgataattaatcctcattcggtgaatgaagctgggaacgaagaaggaacacgaaaattgatcacgcgcagctttgctccaacaacaagtgagtcaccaccactgatattgaattgaatagaaaaggaggtttaagaattatgaggtacgtgtttggttgcgcgaattatatatctagttaagaataaaatactaacatgactgagacaaaaagacgaacaaggtagaacctaaccgaagagaagagagaattgatgagatatgtgaagataggtgcgaacgagggattagagtgtggaacgcaatataccaacgtgttccacacgggtggtcttcttctctacccaccatgaccgattgacaaatcgggtcgggttaatctatattagtatatttttgtgtttccaattattaaaaatgtgtgtttaattcacagattcaaacctctaactaagtaactatcacatgtcaaatcataaaataaaatgtagctaacaataaattcaaattataacaaaggatgatataagattaaagtgaactttttttaaggtatgattaaaatgaacttgtttctcaaatcagtaagaaaatatgcgtttatttatttagtttaaagaaataagtgaagaaaagtaagatagtgattgcactaaaaaaaagtaagatagacattggccttaatgatataagaatatgtagcatattaaaagtgtatatataattcaaaaaactctgtcaatgacaatttaggttataataaaggatatgattgaagtgcacttgctcttaaagaattttaatattttttaaaataaaactagtgtattttttaaaaaattatattataaaatagcctttttaaaatttaaacaaacaaagttgcatttgcttactttaaaacaatcacatttcaattttttgaataataaatattattatctttgtgccttttttatttctttattttgaaatataatatatagactacaaatataattcataatttcatttatattaaaattagttttaatttttattatgacattattaatattttaaaaaataaatataatttaaagtaataattaatattatctcaaatttattaaaaaaaataaagaacacaattttatttatttatttatctttttttaaaatatttatttatttatttatttatttcttgataacgaacaaaattgtattttaaaagtacatgcataaaaaccaaacagtcttcttttttctacagaaccaaatagtcttacctaagaatttgtggatcgatggaacaagcaccaagccaacggccaacccgtttccaactttttaaagacattgattggaagaaatcacccaacgcattcaattcaaacctttatattaatgttacacctgtgcgtttcatgacttcataagtagcggcttataataataaatgaaaacaatatttcgaattggacttataagaaatattgttttcaaaatattttaaatgagtttggaattagattactatgcatgagttagttctactgaaatgaaacaaatataaatgttgaaaagtactgaatttataaatattgagaaccagtgtataagaatggacagaaatacattgctggagctacaataataatagttgagataggcatgccaaaagaaataaaaatataggcagtcggttggtcatcggttagttagatatcactactcaaaatgccaattagcaatcatgcacgtgaccagacttgtcccaccgcattggcatctcttatttattagcctaaaataaaataaaaatcttatcccacagacacctttaggtttaaaaaccaaattctattagtccagattgatgtattaagtaatttattatttaattaagatttaaatattttttaattcatacaatttaatttttttttttacttttagtccttaaaaaggtaaattatttttctgtttttcattattgtgacgttttagataacgtttttttttcattatttaaagtgttatttaaattgttttaagaactaaaaatagaaacataatttacaatgactaaaaacaaaaaaaaacactaaattacaatgacaaaaaattatttaaaccttcaattaatacatgtttgaattaactttaaaaaataataaatttcaacagctttttaaaagaatttaaagaacaagattattttctaaattagaaaccaatcatcacaatggatgaaagaaactataacatgcacaaataatgaggcaaactgcaaccaaaataatagtggaaacggactcagaaaacttaagcacaaaggatttatatacacaaacctccggggaaaataaagggggaaaaaaaaacttcacatcctccaaacgctatgtagttctccaaacttaaaatcttcaatttttacacttgacaaggaaaatggggagaacaaatatggaacatggaaaactttatataaaatatcaacctcaaataatagtaagaccaaatactcactcatcactttcaacccgccacttactacaacgagcgacttagaattttctctttttaaagcccacaaagcatgtagagttagaatagtcacagcagccaaccctgcttcattcgtgctggagagaacaattgcaccaaatgcaaggattaccatgtcaaggttcttcttccgcaagctgcacattgtatccatgctttatatctggaggaaaccaaacttttgaggattaggcattacaccacttgcaaaaagatgccatatataataattgcaatttgcatcttaattcagtaattaaaaactatgtgatttagtaagattaggggctcagttgtttttgtaagcaatagcatattaactttttccaacaattattcttttctttttaagtctgggtccaacctattcaatcaaattttctcgtttgcatgagtataaatcacagcctgtctgactaaccatataaagggcaacgatctgaactattcaatggttttatcagacaagtaccaaggcaaatacaggacgtctggcttatagcacaagctttcagcaattcagctgatgatcagcgttccgaagggtggtcaagtgatgctacaaacaaggaaaggctggttacccaaaatccagagtcgcataggacctattcttttcaagaagtctaaaagtcgaaactaaagctgagagatacagattatatacacatgaaaccaacaatgaagataaatctctaccatatacatattttagcaaactgaaaagtttaacgttgctgtattcagtttttcccaaatagacagttggtgttcctttcgggtgggaacaatgtcatccacaagaatttgcatatcgatatttcaagttgataggacctattatttttgccttttactttaaaatgcaaactctttggcatattagccaatttcagtccccactccccaaattaaacatgcataatcacaagcacgaagtaggatcacataataatggaaattattaataaagcatataaataggaaatttatagtgaaaatacctttcatcgagggtttgtcgtaatctttcctctcaccatcatcattattccaatcaccatcgtcgtcatcgcccatgtcatcccgtccatcatttcctatatcactttcactagctgtctcccattcagaatcatcagtctctgggccatacatatcaccaccatcaccctgactatggaccccaccatgcttaatagctgcctctcgaaataaccaagcagcacgcatctgcttcttaactaaacgctcggcataatctggaactttattttgcctcagtgagagatcaggatcatttgactgagagcactcatttataaataaaatagcatccaataaactctccttcgctaatccaagcatgtcataagcttgtgctcgtctccaaaggcttttggcatgacgattgacaggcttatggagacatagtgcacgggtagcatcacttatggcagccaaaggttgttgcagcaaaagatggcattgagcacgattactgtatagaacaactctctccttccttgatctcataggacacaatgccaaagcttcagagtattttgatgcagctccagcaatatttccagatgagaacagggaatttccttcaagcttgacaaccagcgctgcagcctgcttaatatgtagatcttccttgggcatattcttttcccactttaatctctgcttggaattcaaaatatcctcaatctgttctttagtacgactactaatcgagcttcgtcctgacccttgagactggatgcactcttgaagaacattaataatagaatcgccaagctttttatgatcacccagagttgtaatctcagcaaggtcaactaatgtaggcaccactttatcaatcacctacataatacataccaaggccttatcaaacaaagaatcaatttacaatattcaaatgatgtaaactcatagtcataatctctagcaattggtgcttgtataaatgaaagcatcaggccaataaggagaaatttaaaaatgagtaattctttgacacaaggtattgttactttgttagtatgcatctagtttacactttacaaaatcattggtgtcttgacaaggaccagccaccttctttggggacactggtgagggaagtaataactagttttaagtaagtagcctacacatgaccacgagcttgaaatattattcccaacagcaatgtctttagatgttcaaatgaaacagctatacaaaacaaaatacttagcaaaaaccattctttattaccttctcaacggactaccattcttgtattcagaaaccatctcatccagtagatttccctcatcagacctcaactatcaatgaaatttgagaaattgaaaagctttttgaaccaaggagaaatacaaaaaagaggcaagcagtgtgataattctcaaggtgaaggtccatgcctaataaaagtgcttgagattaagcataacagctgttcttaatttcatttttctttaattgaagttagtttaaggcacaagagtcaactttcattcacatgttaatcaaagcattctttcccagacaatagtattccttaatcctcagtgttcatcagtgcaaacaagctcaacagatgtgaagtaacagaaccagatgccaatgcaaagtcatggaagttttaccttgtgacatgtattgggatcttgaagcagccatagaaggcaatcaatagccatatactgccaatcatctgaagaccgagcaatattacacaatgcatcaataataccagggcaactggcaacaggtcccctaccaagcttttgatgacaaattgttcttaataaaccaataccagcaggtgaattttcattaacaagtccaccccacatgccaggtagttttatcagaaattcgggtttgcatatggtaggaagaaattcatgtttaaaagcaaagcaattaattagctgaagggaccaacactgcaactgactagcccattcctcagccttcctggactccatttcaacaccacccatgccacgtgtaagcagatcacaatgataactaagccttctatcaacatattggtaaaagtgtgaataaactatttccagggaactcattgccaattggatggagagctcaagaatttcaccatgacttgctatggctggaaaagtgctggcatatgtagccaagtgtcccaatgctctaaccgccaccctctgctcaacccaagttaatctacctcgtaaaagctcgaccaaaggaggaatgaccccagcatgcacggcactttctgcaaattcttccatattcattgtgtaggaaccgatgatatgagctgcataataaggaatatatatattttggtcatgagaaagccagcgcctgttcttcagtcccttccatatgagagcagacatgcattcgaatattcctagctctaggaactccgggtcatttgggtgtgccatagcggtgttccaaaggccactgatagggagaacctgaccatcatcatcttgacacggaagttctctaaagaatttcagtacacttgctctgcgcttgcttggattcccttccttcatgacacaaaagaagcatcctgggtacggacagtctgatgaaactttatccatgctcgataaattagaacaacaacctcagagatcaacaaatcaattcctcatcgggtagctgaagcaagaaaaccacttcaaaactgcacacatgccatatatcagatcagtaatcagcacccaaaagaccaattcatctgtagttccctaaacaacattagattctcagaaagaataagtaaaaaaaaaaaaatgcaaagcatcgtttcttttcacaaccatttcccatgccctaataaaaatgcccaactaattccacaaatgagtccaaactacataatacaaccacaaatcatgaaaattaaattacaagtcaaaattgttttaagtgcttattccgcaccagcgttaaaagagacaaagaaagacacccacatcatcaaacactttaattaataacaaaaaacactgacttgcaacatttatttttttccttttccatctgaaatagtaagggtaaagaaacagtggttactgaaacagaaaaacccttaaatattctcacatgaaaagtcaaacccagagtgaatcacggaaagagatagggtaagaagaggatcatactacctagctagtacctacaaaccagtcacagtatcaacattcccatataagtcaaccaaattctcaaaaaaaaaaaaaagttatattttgtctttgttgtgttgcggaatcgattacgcattagaaacaaacggtttttccgatggccgaaatcgattctacatgcaaaagaaaaaagtgggtgataagattaccctcgttgttcaacggtcttctgacagtaacgggaaaagtagaacactacacagaagctgtgaagttgtaacggtgaggaggaagagtgtggtggtttcagtgaaacgtcgtttaaggcggagatcggcaatggttgtaaacgacagatccaaattcgtcgtcgtaggttacaactttcggccgttacatgtcggaattcacgtgttcctcggatgctttgtggatttttggctctctccttctcactcacgcttttctcacagcaccgtcatctttgatctaggttaatattccagagagagagagagaaagagagtgagcaacggagaaggaagacaacggaataatgctggggttctactacacactgtactgtactgttcaagtataaattttaaatgattgattttattttagtttttggtacttattttattctttgatggagggagggaaaactaaatagaaatgaaaagaaaaaaaatactaatgaaatattacgacattaatgtctgataaataaaaaattggataaatactaaaatttcatatgtgaaaatataatttgttgatatgtaagtttctaaaagatgaaaaactaaattttgcctcttaatatgtagaattgttaatatattagttatctcattaatttagtctataaagtttaacatctttcttgacgtaacaagtgaggactaaaatattatgagaaaagattactaattgatagctaacttgaaaggattaatttgtcatcaaaatatcaataaaaaaattgtcatctttggaatttatttattcctttcttctttattatttttcttccattattcttctctttctattgtactattgcctaccactatgaaaagatatttctcatgattatttcccttcagtttctccaatcaaatctacaaattcgacaatctcatcatttacccacaaaccaaatccaaaccaaacaactaaccattgatacttggtagtcatacccattgaacaacacattgatcgtcattagaaaataatcaacctaattatgctcaactcaatccccctccccaacccattccttattgtgccaccatttctcattcctccaagctcaatccaacctcattcatatgctcctcaacactaaacatttcataaacaaaacaacgcagggttgtaggtttgaagccttggagaagcgttgctgcacttgtttatgcccttcactgactcaaatgtgtcatccaaaattgcctttcgttgcagcaatgcgcatgacaatggtgatggtggccttgttgggaaggatgccaagggcaaacatgtgacgaaggattgtgggtttgagagaaggttgacaacggagttggatctggcgcaagaggagggtgctaaagttgtgttggtagaggcgggtgttatttgaaacaacgacatcatagtggtaaatcctcaaattcgaccttcaaggatccaactttcaccatttccacttcggctatctttgtttctctttgcattttctttcttctctcttttctcttcactatccatcttattcctcccatcaacatcacctcatgaaacttatacattacttaattctcaaccatttttatgttttcctttcccttttgttatttttcctgaagaatagacaaagaaatttcttttgttgttgcaatttcttgatttatgattttttggtttattggattagtttaatttgaagaaaaatctagttgcaattatatttcgtgtggagaatagcatgtgcaaaggtgtagaccccttaatcaaaaattatattttgtgtagagcatgagattcaatttccttcctcataatttgattttttcttccatcactgcaacatcatcatcattgctaaggtcattgatggaataagttataagagaataaggtgaaagaggagagaagaaaaggaaagagaaaaaaagaaaaagaggacaaattaatctatcaacattttaatgacaaattagtcatatcgaatcaactacctaattaataatatttttcatgacatttcaattttcacttgtcacgttaaagacgttagactttacgaaatgaaataatgagagaattactatattgacaattttacaaatttagggataaaaaaatagtttttcattttcaaaaactcgtatattagaaaaatacacttttagggacaaattgaatagttatcctaataaaatattatgatgttaatataattttttttattttaagacacaatctagtttcaataataataataataaaaaaaacagtctagtgtttagtggcagtgcttggttacattgttatcgtgtcaccaacaaatttttctattgtgattacgtgaaaggaaatatatatttttacaatctcttatttaattaaaaattatgaaatatttaatcctgttttagtagctttaagtttaagtatatatcacaatatgaataaataaagaacttaaatatatttttaattcattttctctctctgtaaaaatatgttttgtttagtctttaaaaattattattgttttactttttgtttttaaagttccttagataatgttttaaataataaaaaatgtttatttaaaatattttacggaaaataatagaacaaacatgatttacaataatttttaaaaaattacaatgatttttaaaaaaaataaaaacactaaattacatatatcaaaaacactttaattcaattatgtatttgttttgttgatagttaggcctacaatgcaacatttttttttaaaaaaaaaaagcaatgcaagattaaatttatttcggtaatctaatacttaaatcttgaaaattaattttgaaaggttagttgattaataataatttttaaatgttaaaagataaaatattcatcaaaataacgaaaaataatttgtaccgacatattgataacgaaaaataatcatattcacaaaattttgggtttacttttacatgataaatttgggaaggtaagcattcatttaatttctaaagttattttattttattttttaaaaagaatattaatttattttcttgatcataaaaatattattagtttagtttttgtaaaaattaatatatgaaaatactaccattatttttttattgtgaatataatttagtctactaataattgaaaacgatactataaattatataaaaaaatggcgtcaaattaattccctattcgtgtctatgatcataagaactgttctaatgttgttaatttttataataaaataattaaaatattttggagaatcaaaatagcaacttatttttgtcaatgtttgagaagtttttttcaaagagctatttattattaaaaaacaataaaatagttaaataatcgaatttaaaataaatcaaaatataaaatcctcattaaaaaatgatatttaacccgaatttacttacacaaaaatcatacacaattcaggaatcaggtggcataatttccgtcacaaattctcaattttacttgttttgtaacttacatatttatatttatccttcctaaaagttttatatataaaatattaacgagttggattggtattttttatggaaaaaaatagggtactacgtagtaacacagcaataattagtttttctttttttccctcgtacattccgctatttgtatgggttgtgtttcggcgtgaccccatcaatggggccaattgcgcactagcgtataattttgaagtgtgcatgggatatgggccaataacattcaaacccacgcttagtgacagtgaagaagaaatcaaaaagtgaaagatttgatttgaatgacacagtacacattattctttatgaaagattaattaatattaataatactattgaatagattatagtagtattttcttctctcgattgatgtgattatcacactgcgtccaattttttagaaaatcacatcaattttaattttgacgtaaaattttaatgaaaagcttcatatattcacatcaaccacacatgttttaatcatttagacgtgtattcaaacatgtaaccatataattatttcaaaaatttgtgcactttatttttttaaccaaaaattgcacacctttcaagttaattcatgtagatattttcctctaaatcatcattcaagaaatggaaaatttaaattataaatgacaaatcttaaataaaaaaaagaagtaattaaaataaactgacaatataagtttttatgctgtttttcactgttagtattttatttatttatatctaattatctatcttgacccgcagattaagcgggtttgtgagttttaaactcaaacccaccttgtctatgaaaatcaactatatcatcatttttattaataacctatattgtcacgtataactttattttgatgcaatgttaatataaacatttatagtcctaattaatcataatatatttacataatccaataagcctgatatattatttaatcaatcaaaattattaagacaacattcaaaacgatgaaaatattgaataaaaaatattctgaagagtagaataaatatatcaaaataatttcaattaaactgttagatttgaaccagtaatgacaatttaaataacatgcatgaaatcataagttctaatttcaaatttcagtgcaactattatacataaaaaagtaaaaagtagttatagtcatttagaataaaaagaaaattaagaaaataattatttgctcgtgttattcatgaaaaaaaagcattgaagatatatcttaaagtttaaatatttttcaatatatttttttctatttttttcatccaaataacataatagaaaatattttttcttctcatagacacatataatatttttttcatccaaataacataatagatttaaatttacatctaattatcacgtattgtcatgatgtctaaaatgtttacttacaggataaatttattaaaaaaatattttataaaaatcaaacaattgtatccaataacttctcattaaaaatatgtcaaattaaatcctaattttacagttttttgcatttttctttttccctaaattattgcaggaacagattattatatgcgtaggtaaccatgagtcatatctgctttggtattttttggttcgaaggttagtggtagacctagagatagatggctagaatagatcctatgctctcttcacgtctctgtctccgggccttcgggtaggataactaatccgtaggtaaaaaaacaaacaaaacaaaaaaagacttacagtaaggtaaactgaatatatgcatttatttaatagtattaattattaacttttttcatatttttgaattgaacttcttttattcgaatttataaaccataaaatgcaatggttttttatttggcaatttcaataattttaaaattaattaaacgaagaaaattcaaatcacattatattaaaataggctaaataaaatgttaagaatgagcaaatttgatatatacattaaattattaagattataaatatttcatctaaaatctagttaactaaaggattagttacagtttctttctttctttttaatacaagcgggacttatgtccaaaaataaattataggattacggaacaggagagagaaactcccctattataaaaaagaagcaaagaacaaagcccagaaagggctaactcaaacaaaacatagctatatatcatgaaaatccataaacatattagcaagagcatcgacagacacattgtcttctaaactcgatttattactaattgtgctcaaataaatatatactttaaatatatgtttaaataaatcatttcatcagtattatattgtaactatatgttttattgtattacttagtatatatcctgttccagtataggaatcctcaaccaggaatagaggtgacctatccaaagcatttgagtatgtgatacatccttccctaggtcagtgttaggattttaatttattatacttcgtatcttaatctgtttctaagagtattgggagtggttttcccatgtcatgggttgattgcctctcggccagcatttatgtgcaagacattaggctaaaattggttggttaatctgggtctcagaaggtatagttacaacccgaaaaggtagtcttggagagaccaatatagagtttggcttagagaattttcatctttaaagagattgatttagagacttccaccttagagtaataggcttatagtacatcagtcatgaattgtgaactttgaagaggtcgacccaaaatctaaaaaaagtacaaataccatatatatatatattaaaaaatttagattaattaattgttaatttgatttctttattcaatatttagtttaaaacatattctaataattgttaatttattaaaatacttttaatcactacataaaaataatgaaatataaaaattaatataatgagaaaagttacaatcttaaggattttaaaaaaaaaattgttaattacagagactaaagatattaatataatgattaatgaaacgtaaatatttaaacaactaaaattaagtatttgttcaaatatcgttatagaatttaatcactatacaccaacttggaggagggtttctttacgaaaagtgtcagcaaattactactatgactttatgaggctggattcaggctgttctgtcctaaataactgaagtcacttttccaaactccagttggttacattaccagctcccacaaagccagtaaagttaattaaataatcatataaatcatgtgctaagatattaacatattggtgagttcatttagaatttgtttattatctacacaaatttaaatactacagtactacgtatttatttgcatcggtggaactaattacccgtaacgggaacaactgccttcactatactaacatttttaaaacttacaagacacggttcgtttccaaaacatgttgtcctatgctttttgaaagaaagctctataattcttagatcaatttttaacttttctagatttggttttattagattaattttgtttatactaaatgcaaaaaatttacaaaattaatccactaacaactactgttctattataagggacgctaacgtgcatgtcataacttgttttgatttttttatcaacctaaggatgctaatttcgttgaatccttctcattctcataaatagaaaaaaagtatcttgacatgtattagttggacgttctttatcttcaggcttttcatgaatcgagatcttccgcaattacatatttaactgggtaaatcttaatattttaaaagatttacttttatattaaattgaagcagaaaatttccttttaatactcatcaccgtcatttcagaccaattatcaaccatagggaatccaattcgtgaatttcggctttttatactatcctttgtccaagttgaaaattttcatgcaaagaagtcaaacagtcaacactctttttattaactgaaaaataaaaatataaaaaaatctttgctaataaatactctagtctaatttaattcgaataataagtaaactttgcagattctgtttccattttccaggctcaaataagagagagtataagaaaagataagctatgttttcatctaaatccggaggcatgaaactgctgttgtcatgatgtacgtagtcttatttattgaagaagcttgcaattttgccttttcttttttataaatttaattattgaattgaatcaaatgaaaataataataataataataataataaataaaataaataaatacaaaggtatcttctcaatcaatttttcttgccttctcctccaccgtcttccacgtaagtctttttccttctatcagctctggcaagcacacagatgagcagaaaacacgtggcgtaaatggcgtggatcttccaattggtcttgggcggttgctgcagcacgaccctgtgaaagaccgtgacgtagtaatgcagcccaacggcaaagcccacgaagacctgggccaggcccaagaacttggaggtcaggccacagtccgtggagaacacgagcacgaggtacatgaggagcagcagcaagtagaagacataagcgagggtctgcagcacctgcaggcacagatacgtggactgcgaagtagagtatagaaacctgaggggttcgaagccggtgaagaacgatgtgacacagagaatagtgaagtagatggagagatagacttggatgaagattaagatcttctggagggagaaataggctttgatttttgtgcagaggagagagactaagaggagagggatgagtatgaaggcgcaagagataatggtggcgagggtgggtgcgtattttttgccaacgtagggtttgaagcctttggtcatttcgttgttggctttggtgatgtaggctttggaagtggtggagattcgttccaggtcggggaggagtgtccggtggaacttgttgggtagatctgtgaactctgaaaccaaatcatcgtcttcctcttccagctcctccatgatccaactcggtggtgctttttgtttcgtaggtttcttctgagtttgttgtttcttgtttgttgttgttgcgtcgtgagtttgatctacttttgttgttttggcttgcttgttggtggcggtggcttttgttgttttgttagtaggtctcgcgagatccaatgctttcttgttgcttgaaatggaaacggtggtgccgggttttgagggtgggattttgatgtgacgttgagcttcttgatcttactattgagcttcttgctgaggggagtgtcggtgggtttggttttggaaggtgaattggtggagctaggcttgagtggcttggtttggtttttggttttggagaaaatgttgttgttgggtaattttgtggttttggtttggtttttggaggaaacgagtttggatttgatggttttggtttggtttctggaggaaataacgttgtcggatttgatggttttggtttggttctttgaggaaatactactggtgggcttggtgttgtttttggtggattgggtggtggttttctttttcaaaggcttctcttgctcttcttttccggcatccaacattcttctactatgttgaggttccaaccggcaaccaggtggcactgaagcaaacagaaacagaaaggaacaaaagaagatagaacagtagtacctttctgtgattgagttgagccattggtatcctggaatattttccgtcaagcaagatctacaaattaaacagaggacgctccctaagatctagctatatgtagtaattaatacatatatagaacactcacatgcgaatttaataatcagatttcggaagagagaggaaaggaagggaggattttatagtttttatgggtagtgaagtggaaaatgaagtgagtgagagtggaagtgtgtgctgccaaagttggcaggagaaggaaacctatcacatggcgcgcatgagattgtggaatttcactgccttacgatttattattgtgttagtttgtttaaatttatttattaaaataaatatttatttcaataaaataagtaaaaaaaattattttttagtatatttatctaaattattcctatttagaaaatattttttcatttaatttaaaaaataaattctatctatttctaaaaaatatataaatcaaacaaactcaccggttatctgacccgcaactattgctgcctcactttctctgtcttaatctctaccctacattatgttatctctcatctccaaatactgtgttagagaccattcaacgggtcagatttgactgcactataagcctgctggagaggatcccaagtgctttattatttaggatactctcttcgaggcgtcccatttttatattctggataaaataagtgaaaaatcattcacttgttcgagttcagacaaattcatagatcatagagttcaatactaaaaaataactcattaatttcagtaagtttgttacccaaaatgcccacaaaacaaagaaacaagagtaatatactgacttaggagtatactttaattaactcttgaaattataaaaatcttattttgaatggaaaactaaattggattaagataaatgtcaataacacgtattttaatatattcttttaactatatatgtatatttaactgagatttattcaaattctcgaaatgatgtatttcttgtactccaaaattataaattctgtagactttttctttaaaaaattataactttttcagtcacatttctcattcatttaacaactgtatggacaattaatttgaattatgtcgactaaaaatgaaatgtgaaggtagtaggcaagcgttagtcacaatatacatcaattaataatttcttgatttatttgtagcagggaattaagagaatacatttttctttatctaatgaatcttacttataattttcaaaatatttaactaataataataataataaaatatactacaaatgcggtgaatattaatgtcgaggttgacgtcagtggaatacgatgcaatctaataaatgtttcatagatgctgaactgcctgaacatatatggaacgtgagaagggaacacatgttatcattgttatgtacgtatcattatacagtactactactatattagtaaaaatgtacaatgattataaatggatagatagtttttacatttcctataattaacaacaaacatcccaaaatcagaaaaaaagaaaaacaaatatctcatatattatatttataatgtaagaaaatataaaaaaatattatttttaataatgattgatacagcttataaggattaaattcacatcttatcaaatgtgagtttaaatttactcttaaaatgagaattttattatgagtaatacgtagatgcgtaccaattgtttaattcataaaatctaaaatctcttcagtcgttgattctcataatccaattcatctatcttttttaaaataaattatgtgtattattaacattaacaattacatttacgctaaggtgaaaattaagcattacaattatataccttacctatccacatggtaacaaatcctcctatatctcacttggtgagtttacgctgttattgatgcaaataagaagtcttttaataaaacgttatatcttaaattaagaaatttagttttttttttttctttctataagtatgtttggtagtaagaaagaaatatgaacaaaatagaggaaaaatagaagcgttagatttaagagaaaaataggagagaggagtaaaaatacaacactgacagttaaattatgaattcttcgtaattgattatcagcagtaaaataactattttaatgtgtaatgacattgataatcaattatgttttctttataatctatcattagtgacgaaagactcaagcattgtgcaatttctattttctatgcatatcaacaaggaaataataaaagtgtgaatttcaataatatcttttttattttgccacctatttctttccctcgatcttatttctttacaacttaaataaaaaatattttgagatgatatcattaattaaaggtgaagttagttaagatttattacatatgtttttttccttcttatatttaaatcttgttaaaattaagattgaattatttagataatactttaaatttagtcttttaatgaaaataattattgattagattttatttattttttgactgaatttcggattccttccataaatcaaaggaggattaaaacaataaaaattttgttaaggagagtactcatctattattatacattttattcaaaaaccaattaaattttccccttctccattttgtgtcatttgtacataaatatttggtattatataacattcctgtctacaactagtgctaatcaattcatcaagataacctaattaacaaaagtcaaatttatagtaaatatctcttatttcctttaatacatttttatttgtaaatttataaaattgatttaaatttaaaaatatccttacaattcacagatttttttttttacaaacgatatacacacgtaggaaactaaaaatgttaagcttaatagaaaaatatcaattatattctttaatgtatttttatttataaatttgatttaagtttaaaaatatccttacaattcacagaagaaaagtttacttattaaaacgatatacacgtgggaaaaaaaaaaactaaacttccccagccacctcaggaatcaggataaactgttgaatttagaagacatataatatatctttccgttattttcaccaaaaaagaagacgacatatatctagcacctgcccagagtgactactttgttgaacttgattaatgtcgacttctcacatgtcacatgagacaatgtgcagcagtaaaggatctagcctagaataccctaacataaagtgaaatcaccatgctaggtgctatgggattttgacttttgagacctcaagagtgattgaatatgatccatttgtcaaaaaatacatggtatcaacagtttccggagtcacctaacagataagcttcacccctgtttgtctaattacgttgaatcaaaaaagttatccaattccccccaatataaaaaaaaaggttatccaacagtaaacattataacatttgatcaattaaacaacaattttttttataacatttgataaatgaaccattgatgccttgcaaaagtgaaatactaggacaacaaaactttcttatcatcatcatccacgtcgacgctctcttcccttgttggataatcaatgccaaacttgctactttccttgccattcaccacatttgactctaaatattcatgaatttcgcaatattcttcttttgtgccatcttccacttctagctgctgcatttctgattcctctaatgataccattcttgctcgttccctgtcccttggatacgtgcaataaagcaatgaatatacggagacgcagattgacataggtattagaattgcagtataaagtgccttggcgagagatgcagcattttccctatctgtttcaatctccacagaatctgaggatccgcttgggattggtttgtaaccataaacacgctgagccaatagtccaacaataggtggagcaaaggatgccaagatggactcaaaagaacaatccaaagcatatatagcggttcgggacttctcagggactatttctgcaaatattggactgtctacactgttacatttgaaagaaaactaaacaaggtgcattttaatcgatgttcaatagttagctgcaatttgtttactttggacagtttgtttagtttgaaggtccacatcttgcaggctgtatcaaacaatttgtttagtttgacagaaaaacaacctgcaaactgtttttcttgcatatatgtatctctactggtaaatgtttgattatggttggtgattaatgatctaaatagtctacaacaaccttctttcatactttcattatgcattcgtcactattcactaattttggaacaattatagatggatcattaattaatcactgttaaagttttattctgacaaatgctgctagcatacctatatagaaaaggtagcaatcattatacagtcacaggttcaggagattcaccactccctcagctaagaggagtaagagctaaaaagtttaaaaatttgtttgactcatcttattgggtgtttgacctatcaaaaagttatcatatggtttgggactaccttgccatggtcctagttaatttttacctaataagtaatcgagtttttcaatctaaaagaagagttaataaaactcgattatgtgtcatgtggagattgactaggatcatagtggtccagaacaaggtaataatttctcctagtgtacccgggtgcctcaaaacacttctactaattccaagatatatttggtattaagggaggccactactagtacaagaaatccttacagctttaaattctagtaatcctgaatataaagaacacagtcataaactattgcagttatgggtacgtacttgttagttgctggagcattccaggctgaggtgaatcccatgatgactaaaacaagaccatgcatgaaggcagtggatgaatcgtcgggcaatcccaagagcaaaactgctgctaaaggaatgactgaaccagcgcttatttgtgacaatattattctaccagagttgggtaaccgtagggataaaaaatctcccatccaccctccaaacagagacccaaatgaagcagcgactatgaatagggtccaaagggtcgctgttgtgacatgggagaaacctattagttctaaccaaagagtggcaaatgacaagcctgaccaggggaatgatccaaacactccctgagccacaattatctgaaaagttggaattctaataactgattttgcttctttcattagatctttcatttcagaataaaaggacttgtttcgagcttgagttgttgctgtctcatcgcgctttgaatagtgtggatcgtcagcaaagaggcgcaccaatatacccactataacgctgatcaatgcaactagatgaaaggctattctccaaccaggtatacctgcaactgtggttgaggctataagtacagataagagaccaccaatgatgcttcctaagtttccggttagttgcagccacccaaaagccataccacggttgctatcaacggttgaatcagcaacaagggactgaattgctggaataacaatggcaagtcctatcccatttaaacctcttgaaattgccacctgataatccatattgtgcaacacgaaggagtaaggaaacatgtaccatgattcagggaaaacatgggctaagaaaacacaagtatgagtaacaatgcatatacaaaactataattttgttaagcaaacgatcatgatgtttgttatttttatcttgttgtatattttgaattagtcatatgatcatgcaaattatggtcaatcctgaaagttaatcacagaattttatgttaagtatcaggttagggactgcagaacttcacccttttaaatgagcctatccaactttacttggatgaatctcaatgtaacttttaagagtgacatgcttattatattccattttttcccaatacatgcaaaaaaatttaagaatatttttttttatattatcaagtcaactatatttaatttttatataaaaattccttttttcataatttatggatgattatattataaaaactattatgtttaattatagattataattttaatccacccaattttcttttcaagctctcagccacttattagagtatattcttttaaggatagcttgaattagtgtattcttccttttcgtttttattttttcttttaaatttaaattctcttaagttaattatacatatttttttacaatttgattttttaatacatatttttcatatttttatgaataaattatacatgcttgccttaaacattttgaattaatttatttatacagttaatgtttacatgaatttaaaaacacctttatgacgcacaatatttatgagtaaactaatcaccatattattataatgtgaaaataagacatagacacaaattaaaattaatgaactctaaatgcactattataattagtcttgcgtctttatctctcgtaacattactttatcgtgttaaaataaataacatgagattttccaaatttaataattgagtgaatttctaaatccaatcgataaaatcatttttaattttaataattcctaacaaaacctaaactcattctttacttagtaataactatcaagtatatattaacatatattgagtctaactgctgtttggttttctttgtaccctttagtgtgagcactaggtaaggcttcgtttaaggttagtagtgttttggcgtgcggctggtttggttttaaactgctacatgtgagcttacaatttgtattgctcttctatcaagctaaacatgccttatgtttagtttgatttttaatgaatttcagttttagcttcttcaaaaaaaaaagtattaacataaattgattagcagtatagttatctaatcctcacgcttaattatctaaaattgaaataacaatgttatatcatttttatgtagtttttataagaataaataagaaatatatatgttatacaatatttttttttataaaaaaaagcctataaaaatgtgatctttaactttcttctgaagaaagaaatgtgaccttgaattaatcctttatgaatcataataaaaaagaaattgaattgtcttggctactaagaagtgaaaacatgttgaatccaaataagaaaagcaggggtaagaacctgaaagaaggtggaggagatggcgacgaggaatgtagcagcagcccagagaaaagcaccgagagctatgacatgtgcacgattgtgacgcgtggcgaggtaagccgcgagagggtaacagagagactgaacaagtgatctgaagagagtcaacgaacccaacgcagtggggtcagccttcagatcctcaccaacctctttgtacactcctggaagcaacgactcatccgctctctgcataatactcgccagattcaccagcaccaggttcactgtctccgatttcattttcacacatatattcaaccaacaataactcttctcacactctatttctccacttttcacaacccaataacacaggaattcgctgtgcccttggatggacacatggatgctacggtgggggcaacacacaggatcggaactgtgggagatgatgagcttgccttgcacgtaattccacaaaatgttgaacgaacctcactggtttattacttttatatgctgagcttggtttatacttgaggttggttagtttagctgttgctattttcaaaatatagtaatgaccataatttgattgatgggttaacattaattacgcattgaaaatgtaattttttatataattattcaattataatttattatgtattataaatttattgatttttgaaataattatttaaaaataatttaaatatgatttctgattgataataatataattttttatattttttaaatattaatttttttaaaaaattgtaggatacatgaagttctaaattcacaaaatatatgttattatatttgctcgcatttgtctttttctggcaaagatcctgctggtccatgtgccggtatctatattatatagttttttttttaggttatcaagagaaactaccttagaaaataagttggacgactataaagaattaacaagtttatggtccttttatttatttaattaaaaaggaacaagtagggcggcatacttttctttttgtttgttttttatgacgtaattggtatggtatattgtggcagtataaataatttttttttcttgtttttttttagataaggtcctaaaggccgaaacatagaaaaataccgtatttggctaaagcatcatggatcgaattggctacatgaacaatatgtgtccacgagatagattcagctatatggtgaatgacttgaatcaagctgtgccaaggataatgtgagagttttaatcaaattaacggtaactaagtaacttgttgggagtgactttcaatgataatgcttcttaaacatctagaaatggctacttaaacataacttcaatcgtgatacacactttaggtcagccccgtgcttgatctcctctcattgaggttaggatgcaaccaagagtgaaaatcaagagcatacttcttaaacattattaagaacaaaataaaaattataaatcactttctattctctacaaatagaagtacatcaacttcgttcctttttgagatcattcatgatacttctatatggagtaagatatgtgtgaaatacaaatacgtggagcaaatgaaaatatcgatgcttcctatatttcacttcaagtgatcttgaattatcaaatgaaaatgtttctatatgtgtatgaacctccgtgttcccgctaagtgaactaccgggacaacaaaactttctcatcattatcatcctcttaccttggataatcaatgtcaaacgtgccactttctttaccattccatttgattctaaaacatgaatttctcttcttttgtgacgtcttccacctctagctgttgcgtttctgattccactaatgcatccattctcgctcgctccctgttcctcgggtacgtgcaatatagaaacgagtcgatggaaacgcagagtaccgaaggaatacttattgcagtgtaaagtgcattggcgagtgatgcagcattttctctatctgtttctatctcaacagtaaccgaggatccttttggaattggtttgtaaccataaacatgctgagccaaagctccaacaataggtggtgcaaaggacgacaatatggtctcaaatgatcgatccaaagcatatatagttgttcgggacttctcagggactatttctgcaaatattggaatattcacacggttcaatttcaaggcaaactaaacaactaattaagtgcacataatgtaattgtattattcatataacattttatacaacactttctgcgtctatttctttccatcctatcatttattactccacatatttctcttagttgacatgtacaaataacatttctctaatgtaaaccctctacaactacctccccttttaactgtcattttgcagtcatcacaagtttctgggccattatagatagatgattgattaagtactgctactgttctgatcgctgctagcatacctagatcataatggtaactaacacagggcatggagatacaccacccccaatccaattaacaaaaaatgagaactgaaaattcataatgtgtttctaatttcttaaataatggaaattcataatggttgtacatttcattttttatgttgcatttatgtggtgccttggtgcttgtaaacacctatacaccgggatttatacaatggttgactgaattacgatttgaacatgccaccatactcctaactaaatatctttatgctcacttcaacaacagggccacaacattatgcacaaaggtagaggcaaaacataatattaagcaacctacctttaaatacaataaatctaatctcttaattggtttcatttagtcagcatctctcccttgggattcgttaatttgcttaacaagctatgatgaaataagtagcactcttgctgtataagacaactttgatttttttatttatatatggtaagcactcaattcaacatagataatccatcatttaactttgaaagattattcgtaacaccctcatcttaatgaagattatttattttataaaaaagtagattatctaaagcaaatacgatgtgttttatgttgttttctgaagaaaataaacaagtacagtgttggatatacatacttgttagtggctggagcattccaggatctgattaaccccatgaaaaataaaagcagaccgtgcatgaaggccttggatggatcataacgcaatcccaacaacaaaattgcagctaggggaatggctgaactggagtttatttgtgacaactgacaacaaaattctaccagagtttggaaaccgttgggataaaatatcccccatccttcctccaaatagacccccaaatgaagtagcaaccacgtatagtgtccaaagcaatgcagttgtgacgtgggagaagcctattagttctaaccaaagagtggcaaatgacaagcttgaccctggaaatgttccaaacactccctgagccacaatgatctgaaatgatggaattccaattactgactttgcttcattcattagatctttcatttcagaacaaaaggacttgtttggagcttgatatgttgttgctctgccatcgctctttgaaaagcatggatcattagcaaagaggcgcaccaatatacccactacaacacgaaccattgcaacaagatgaaaagctattctccacccaggtatacccgcaaatgaagttggcgccataagtacagaaaagagcccaccaacgatgcttccaaagtttcctgttagttgcagccacccaaaagccataccacgattgctatcaacggtggaatctgcaaccagggactgaattgctggagtaacaagggttagtccaatcccatttaaacctctccatattgcctaattatccatgttatgcgataagtagaagttgcaaaatatatatatatatatatatatatatatatatatatatatatatatatatatatgagtgtgtcttgtgtaattaatcttgttataattctatatttctagggattactatttttttagaagtaattgaaatttacataataaaaaagagaatcattaaatgagatataaaactcataaaaattatgatttttaataaatttcaatcattaataaaaagagaatcattaaatgagatataaaactcataaaaatttatgatttatttcaataataaagagtgtattgaaaagaatgtgtagagaatgttgttaggattttttatttttttttccacaaatattacctaattcattaaatcaaaattaattttgttcgcatattttgtattttattaagtttttacggaaacacaggaagactagtactgtttaatagaatatatttacaatatgtattcattaaaaaattaaggataaaaagttgggattttcctttcaaagcctgtattctcacatggatatgtataattatatgtaacagtttcaagagtgaagatcgcatctgatttgaaaattcttacatgcgatgatgaaaactattcagcttcgtcgataaaaaatattatatacaaggaaaggaaagaagtgtttccaaaaatctaaaaaggtatgtttcttttataattttggtatataatcattcaatatattatgtttgttggcttgattcattaaagaaataaataccctggcaacactgggtcaggagaggacaaaatgttgaaagagaggcgaggagatggcaacaaagaatgtggcagcggcccaaagaaaagcaccgagagctatgacatgcgcacgattgtgacgcgtggcgaggtatgcggcgagagggtaacatagagattgaacaattgttctgaagaaagtgagtgcgtccagagcagcaccaacctcttggtacactcctggaagcagagacttgcctgcattctccataatacctgccagattcaccagcactaacgtcaatttctccggtttcatcttcatgttcatttttagattaattactgttctgacatgttcggtgtttaagattcagatccaagaacagaggattttgccccgtctttgactttggagaggagcggagtacaacgtgtgggggagtgtccggttgacttggatgaaataatagtctctgtaagtcagaaatatcatgctcggagtaaaattaaattatgggcacaaactttacacgtcattcttgaaaacaatctattaaaaaaaatcacacatgaaacctggaaatacttgaagagaggaacaaaaaatcatttaaaatttgatttaggttgcagaattagaatagtggtttgcacgtatattgataggcataactattcaataaaaatgtggtttaacacagcaacccgattgggtgtcggtggctaatttttgtgtccgatgggtggaaccaggtttgggtggtactgtgggcgtgcaatctctgtctggtgttcatttgttagtggcgcgcaatctcaaaagatgattagattctgaacgtttatattaatcgtttgataatttggatctattaaacaaattgtagtggctatacacacatgcagaaagtattaggtaatttcaggaaaaagtattagataatttcagattttttttaaaaaaaaatagtgctagtacttaatatttatcatgtaaatattaataggcatcataacaatctaaaactatttaataatttttccaaatttcagtgaagcaatcttgaatcggtgaacatgaaatcttgatatcttccattcttcattcagcatcactttccctttttttctcattcgttagaacactgtttagtttccatttctatgtttaatcacgcaaaaaccaaaacaaaaataaaatacatccaataagaagaccgtacccaacaaattaagctgagaaaaaaataagacagagaaggaagacttcatggtttaattgaagtgttagccatgtttttttttttcatcatccaatcaccgctacagcaataagatacatatcccaatcccatatatccaatgctcctaatcgttaattaaccaatattctccaattaatgaaattaatattgcttgaatttggtatcgcattgctgtgacaagactcgagtgtcgttcccgagaccgctgaccgtaaactcacacgccacattggacctcatggcccacgtttcgagtcccgcggttcttatcctcatcgcaagtttcatctccaatttcaaatccacggctgcgtccccaccatgcattcgcccgggcaacgctccactggatccggtcagttcaaccgtaacctcactcgcctcacctcgcccttgctccaacgtcggaaacttcccctcggcaaccttaatcttatcgaacaacagcgacacgtccccatcctggtactcaatcgccaacttctcgttcggattcttcgccctcaacgaaacctcgtactgcggcgccgccggagagttcttgttcctattaaccgccacatgggagacagtaaacttgggacccgaggggttgaaaataaagtacaaagtggccagcgtgatgccaacgacggcaacgattgccacaacgataagagcggcggttaggaagacacgacggctgcaacagcaacaacaaccgccgcgtctttttttcgttgttgccgggttgcggtactgttccgcgatcaacgcgttctcgcgcggcggcacgcggtacacttggtccttcgggaactgcacgatgtacgtgtcggcgccgtggcggccaggaggaggcggcaatgcggcggagacgtcggcgtgcccctccattggcaaacacgcaatcgcacgccggcacgcgcgcgcgcagtgggaagaagaatgactacgcggcttcttcttggacgaattaacgattgcttgcattcgaagagaattagtttgggggcttaggggttgtgacagcgtggaaaacacaaacgcacagcgcatgcatggggatattttgttatttcttgggacttcatacagctttgttatgacgggtgtgtttgtctatattggctctaattcaaggttgttaacttttgattattaagaaccgttatgacatgattagttttctgaactcgtctatttttagtgcgtataagaattatgtctgtttttgtgctttgagtgtaattagcatacttgtaacaagtaataactacaaccaaaaatgatgttgtatatatatgtcaaccacccgtccaactgccaattattaattttcatgttcatgcactttagcaaaatttaaagaaaattacctatttgattttcatgttcaccttatatattttttaccactttatttttattagctttgttctctcttttctcccaaaaacaatctaatatagaaatgttaattaatattaatcattactaaatgatggttattttatttatttatgttaattacgactttatttgccattcaaaaagatctcaaaaatagagtgggtgtaattttcctgaaggaatttaaccgtgcatagtacttatcatatggaagttcaactctaaaagaatcaaattgaaataaaacttttaaaacttaattaaaaaatcaaaacaaaaaaaataaaacataaaagattaaaatgacatttagtcaattaagaaccctaatatgctacaaaacttggatagaggttttcatgacttgaaattagcttgtaatagaggtttttgatatatcattgtctactttgattcttagatagtaatgaagtcgttgtcaattacatccttattataattaacttactgagaacaatccacaacatcatcagtatagaactcatgttcatgtggtgcataagacaaatcaagtagttgatgttttagcttaagtatgatttgtgtctttggtgtgatacaatattttttatgtggctcctaatttcatttctaacgccttgcatgttgatatatgtcttgtattaattttcctataggcttctaagcctattaataaagttttcatttagcgaaagaaaaattaacccacacaagttcatatattggagtcagacaccaaatactgtcatctaaatttattttattttataaaaggtgataaattcaattatataaattgttagttttatttatttttcagcactttctttaaagtagcactttttttcatcagcacattttaacttgcattgttcttcatactcttctttctcaaatttccttttaaattcaattttcttccattttcattgcacatttttacaattttttatttaaattgcttttaattttaaacgacttacttttaatttctctttcctctctgaaactatttagatttctgcatttttcaagttgttttctttttctgaattgacattatgcttttgtgatttgagtcttgatttttcttaaagatatttctcaatattgcatgttatctcacgtaccagatattagaaagtacaaatagtttaaatacgtgtattcaaaaatttaaaattttcaagttataattttgttccgatgtggaataccggaaatgtccgacgagtgtcgccggaagagttgctataggatcggactctcccctgctgatctatggtggtgagaccagcgactgaagagaagatcgcactgacacgggagcaattggggtgctgtgtgtgccgtgcgaatggaaagggagagtcagaaaagtgtaccttgagaatgtctggagggttgtatttatattgaatgatgggccttggacctcagctcacaaaggatctatttacagacacaataatgggaaataatggcaagatatgattactggaattagaattattacatacctggtaaaaaaggatccgattaccaatcagatatccgaattgattgagatagattctttcctttccgtaacagatgccccccagctcggttgattagcattctgatctgccgagctgtactaattacttactttcctgagacgggcgaatgaatcgtttttgttggttaatgtggccgaggtgcatgaatcttgttgattgtcgtaatcgaggtgaatgaatcgcttgagttgcaatgaccgagatgagtgaattacttcggagtttgtaatggccgagatgaccgtttggtgtcgggacctcggaccttgtgaagcactgagtttcgacttcgtatagggccgacctcgtatagggccgatcacgtggggaactgatcttgttggacccgaccttgtgcgaaaccgacctcgtctcggtcctccagtattcttgatgaccgggatgtacaatggtttgatcagtcctttaactggtctcctatgattgagactttcggcccgaccttgtatgagcaagatcgacctcgtgtcgagccgacttcgtataaggccgacctcgtatagggccgaccacgtgtgggggatccgagccgaggtagtcgatatccgaggtaaggtttgtttttgccccttgccgaggtaatcattgttgaggtgcgacttttgcttttatctttttgccgaggtggttggtgtctgagttcgcttttgccccttttctcattgtatctcattctggtgcttttatttgttctttgcttctgcgtctttttcattctctttctcttttgcgtatcgtggctccaattgtcgagcgtctatttggccgggaccaatggtcgggctctaaacatagttggccgggatcactggtcgggctctaaacattttggccgggaccactagtcggactcgaaacatagttggccgggaccattggtcaggctctaaacatagttctgggatctttttcccgacttagcaactgttagcgtatttgtaacatcattataagtgtaattctttcggccgacccgatgattcacccatgatagttacgtcggcttgattaggaccgagataatacgaaacaacgactaagcattcaaatctgtgcacagtaattttcctttaatcaaggattttattaaatttcttcgaagattacatgattttcatgatctcaacgactgatcacacgggttgtaccttcccgaattatataatcagctaaagagaaacacatgatccatcagttataaagtcctcccatgaccccaatggcgggcttgacagccaactaaaggggaacacatggtaaggcactaatccatgatccctatgacgggctcctcggccaattaaagggaaactcatggtgtccacgattccgatgacgggcttgcagccaactaaagggaaacacacagtgaagttctgtgatcccagtgaccgactaaaagccaactaaaggaaaacacatggactttctcggctgcgtccgtttgacttgcttgtcgtccgatgtcttcattaagtatgctctttgcccatgattttggacaacccagtgcggttctttctggcctgctgctaactttccttgcaccttggtcggtctcttaccaatattacttgaggtatttcttccgttggttggttgtcgcctccttctcctattcctcccatgatgacgttgcattcgaactcgggctctgagaattctttgtcttccttgctcctcttatcatctcgttgtttattctcttgctgggcttttctcttcccgttgtgtccttgagttcggatcacgtactgtcgcagtttgccttctcgcacaaatttttctatagcatcttggagctcccagcactggtcggttgtatggcccggtccattgtgaaaatcacaataccgggaatagtccagtccttctttccttaccatcggaggaggtcggttggcgctcctcatgttagtgaaggcgacctccttccatatttggccacgcgggacggtcaacggagcgtaattgtgatatttcaactcgtacccctcgggcctggagtgagggtcgggactgctccgtggtggtcggcctacttgggcatttgctggatgtcggctggacggtccgaccttgtaattcttctgtcgttggttccaaggtgaggaaggttctttgtttttccctggtgctgagtttgcgatctccatttgttctaactccaaatattttttagctcggatcctgaactcattcagggatttgaccgggtccttgtagatcgacttggcgaggcgggacgttcctttgagcccggcggaaatgagatggacgtgtactttctcctccaggccttgtacttgtagtgcggcttccttgaaccgatccaggtaactttgcaatgtttcttcgggctgctggcatatcttgcctagagtgaattctgacttcggctgtttcttgctggtcgcaaaattcagcaagaacttctggccgaaatcttcaaagctgtgaatggacctcggtggtagggagtgaaaccatgtctgggcggcccctgttagcgtggtggcgaagattctcgaaatgataggttcgtcaatgcctcgaacacacatctgcatgtcaaattcgtcaatgtggacctgtgggtcctgatttccatcatacttggacaggaatgacccgtcaaagtcttccaagaactgagcgttaactatttggtcgatgaacgggctattgttttgatgaccccggcggtactttctccgatatgtgccatcgccttgatcaagtcggcagatggcctctattggtccccttgcagcgcgttctgttatcgtagtcgagacagcacagaatgccccttgctgaggacgtgatccctgcaatggggtggaatggtacgtcggttccctattgccggtctcggcagctcgggtcggtgttccgggcctttgtcttcttgcattatgctcctggtggtcggtattttgccgacgttcttcctctcttctcttgttactgcgttcttccaactgggcgatgaggtgctgcctatcttcttgccgctgaagctcataccgtttctccagattctccatccgggccaacaaagattgtaaggcgttttggataaaacgttgggaggtctctgggtcgtcttgtgctgccggtggtgtattggccggcacatgcgctgctgatctcgtacgggaggaatcggtgtgggacaatgcaccctcttccaccccattctccgaattcggattcctgggtggttcttcacgtctggcgagctggtgtcttctggtattagccattgatagttggtgggattcgaaatttatcgtccccacagacggcgccaatgttccgatgtggaataccgaaaatgtccgacgagtgtcgccggaagagttgctataggatcggactctcccctgctgatctatggtggtgagaccagcgactgaagagaagatcgcactgacacgggagcaattggggtgctgtgtgtgccgtgcgaatggaaagggagagtcagaaaagtgtaccttgagaatgtctggagggttgtatttatattgaatgatgggccttggacctcagctcacaaaggatctatttacagacacaataatgggaaataatggcaagatatgattactggaattagaattattacatacctggtaaaaaaggatccgattaccaatcagatatccgaattgattgaaatagattctttcctttccgtaacaaatttcaaattcttttaatagattccttcaatttaagcaaccatcatagatatttctaataatatactaaaagtagctagggactcattcagagatttcgataacgtgaaatcgtgcaaatgtgtcattttatattctaagaaatttttttgtgtgagcgcgtgtgaaatgtgttattttattattctaagatgaaacatgttgtatggttggtacttggtatacatccagaaacctattaaacagggattacatttttttcttacttaattgtttaaatttataacttttgataaataatattttttaaattactatttttatatataaaattaaagctaatttttattttaaataataataaccttaatcatcataaaaacaataaatacataattatattttatttatcatctaaatcagtatgataataataacaaacactattaattttatgttaactacattaatcattattaaaagtattataataataacatagataattaattttacacaaatttacattaactaagttaaatctatatacatgagaaatgtcaagagggggctgggcccttcccgccctcctcttcttcggttcatattggtaaataacattatttttttaaacatataattatggattcaatccttgattgatgtgtataaaaaaagcatccataaaaaaattaatcctttaaatgaatctcaatatattaataattacattttaacttttgattgaaaacacttaattaacaccaaagaaatatagaaatctagtaacaaaaatatagaatatacaaattagacatgcatatataaagatacgcgtgtctcggaagacttcaaatgttaatttaatttcataatccataaataaacactgatttgagcattaaagtaatatataaaaatgttaaaagatttaaattagttaaattataaatatgaaaaattacactttggttttataagacatgtttaaacttagttgattgatcacagaacttacatttttatgatatatattttaatttttttaaagaataagtttttgttcctttgtgactcaaccttattctaaagtcgttttcaatttatactaataacactttaataataaaaaaaaagatatttgttgtctcaaaactaattgtagaattctttaagggatgatttggttgtggagaagaagttattattcaaggaaaattaattttaaaaataaaatagatctcattttttttctttctattttaatttaaatatttttcctatttctgttttctttttctttttcataaaacgaaacctagcataaatcttgatgtattaattttgttttctaaaacaatattcaaagttagttgatgttaaaagtaggactagaatattagatgaaaaaaaataaaaaagttgaccggttgttaaaaaaattatggagcaaaataataaataaataaataaattaaagaagaaaaacatatttgattgttttgattagtatgtgtaattttgttaggtgtcttgcgttaacgacttgttttggtaagtccggtatagaaatttgtatatttagaatgcaaatctgatactaattaatttaataatttgcttgaggagaatgatgaatcatgtgtccctcgctggctcgctctatttatcaatacctatggcactgccctcatcaccacttggactcaaaaatggcatctgcaacacagagtctctctctcctccttctgttctcactctgcatcgccgcaaccgttagatcggtaagaactcgctgttctccctccgatcctctccttctactaactcataacaaaaacatcattattcatacttttcaggatctcgttaatttcataatttgtgcttactactaagctttgaaatccaatataatgcagagcgacagcgaccaggattgtgtctacacggcctacgttagaaccggttcggtgttgaaggggggaacggactcgaagatcgggctgaagctgtacgacaagtacggctactacatctacattaaaaacctcgaagcatggggcggcttgatgggcaagggccacagctacttcgagcgcggcaacctcgatatcttcagcggaaggggaccctgtcttaacggacccgtctgtgccgttaatgttacttcagacgggtcgggttcgcatcacggctggtaccttaactacgtcgaggtcacctccactgggccccacctctcatgcgctcaggagcagtacgaggtggagcagtggctcgctctcgacacttcaccttaccagctttgggccgttaggaaccactgccgctacagcttggatcaggcccgccccgtttcggagcgacccggatccggatcctcgttctctattttgaatgcacgtgcttgagtgtatttatcaatattgagaaacagatccagatcaccatagtacttgaattggcatcgggtttgtgggttagcaacccgttttgtctttctagtcttgaataataatcggtgatctggatgagagtacgcatcttttccaaacaggttaaataatttattttatcttttattttaatttttttaatttagtttttatcttttgaaaaatttattttaattttttatattttaaaaattgattaaaatagtccttttatcagtatcattaataaaataattattttaaaaataatttaaactatgatttgtgcttaaattagtcacgttaaacttaacattatattggttgttcaatgataaacagtaattcttgtcatcaagattacatatagtgccgttggaaataattagcgagcaaaattacacataaacgttcacaagagaaacaatggatataacttcatattcatataatcatgtgtttgattttttttttttttttgaaattcataaaacgttagatattagtactttttctgtttacatacgggatttctcattagtggaaaactaaacagtaaacacactctaatgagaacgtgtcacgagagtaaatatagttgcccgtataatttattcatttacttaagtggcccccagtttgctagcgctacattgaagaatacaagaaacaagggaagtggctttccccggacactgaaaaagaaacttgtatgtgtaagcacaagctggattattattcaaaagttacaaataaaaatattttctaataatttacatgtgaatatataaaaagaaatgctttagcgtaagtttgtgtaaatatctttatttcaatgtcattccaacatgcgaattaacaaaccaacgtaaattttggagtttttttccactgttttgagaatcgaatctgacatgttgattcgatgaatcggtcaattgtttgataaaaaattgatacatccttacatcggctaaaaaccattgaatcaatcaaaaatcactaaaaaatgataaagtcattgggttaactagttttgtttaatttttttaaaaataaaactttcaaaacgacattgttttgattttaaaaaaattattataacttatgatactttaaagtgaagtttactttctatttttattattatcaatttatgtatattatgttattttttttcaatattactatgatattatattaaaatattaaaaaatatatatttcattaaaatggttcaaatcttattgaaccgttgactctggaaccagtgtttttcaaatattgatttttttagaatcatgagcccaggaaaagtttctttctaaaagggaaaagagagagaaagatgaaaacaaatgcctacaagctctattctttatttttagagatgaaatatatttattaatatatcttctcttaaatatttatgtttgtttaaaatcattttatttatggcataatatgagatgttatcaaactatctccgaccatttaatttatacttcaatctcaatataaaataagtaaatttgtaccttcacttgatggattcaagttcaactttagaaataattcattgatactttatgctgcacctttcccttgtcaacgggcccgcagttttcctcctcaacaacgtgttttatcctttttctacaaaggatttgagtattgatcattgacaagtgtgcttttctgtcatccttgacaaacaggcacattagggccctttttcctgttctcacctttgtttgtcacgcttcatttttcatatcttcgccaaactctgtctctaaactatctttatataagtgataagtccattactttatgagtgttgaccttcattcacctcgctgttggataaaatgctcttggcctccaacgaagtccttcttaattcctcatcctccggtgtctcttcaagcaatatttcattgaagtttcccatcttttcaactacattcatatcataaacataatacacaaattaagcacataaaaatgttaaaagtgcattgcattatgtaagtaaatgaaggaactttctttaagtgtttttctgtttttaccttggcattacaatctgctcttctcagcctagccttgctgtaagatggacgcaagctaagagcagcattgcaatcttccagggccttctcaagttggcctgttttggatctacatgcagctcagttgcatcacaaaaccgagttatatggatcattctctaaccatgtccatgggcggatgcaggtgtaagattgggggggcagtgcccccccttaaattctcaagaatagataatttttttataataataaaataaagtaaaataaaaaaatagtttaaacgtttgtacgagaggagaaattgaaaagtatagaaaaagaataataaaaaagataaaaaataagagagaagtgagtgtggatatgtatgtttgtaatttttataaatatagtggccacactcttgttatttttaaggaccggtaacacgctaattttgtcaattttttctcttttgaattgtacatttttcatacttttgttataatgatttgttcctttaattttctttacaaaaaaattttcgggggcgctgcccccgagcccccgccactagtgccccccttacatttttttctggatccgcccctgaccatgtccatagacaacacatgcttcggagaatttcaatgccttgaaaagctcgtttccgtttgatcgagcagtggccacagctctagcctacctaatcacctccttaatctcattattatttggatcaagcctagatgctcgctgaattgcaaccaaggcatcttcaaatctggtatattattgtgtgaatagacagagattaagaaacatattctgcttttcaattagaaacgaaacattaacctgccagcagccaaaagaacccgagcctaagtcaccaatgtatttgcattgcaaataggtccaaagaatttggtgcaatgatccacatcaaaattagatcccttcaacattgcttcttctgcatgttggtgcctacggagcataaaaaatgcctcggtttgcaacgcaaatatcttcaagtaaagccacaatcagagtcatatcagcatgattgaaatgcatgtgcatgtgatcgatcgcgggtaagatctaattcagagttcaatgtgtaataggagaaattattacatgattcaagactaccatatgtctatggtctcaatcaatatttacattacatataactcaggttttccatgaatgaaaaagttagtaaagctgtgttacttgtggagattgatcgagaccaaaatgactctagatcatgtaataatttctcgtgtaatagaggctagtagctaacctgtggagcagaatctgcaccaaatgaaatagtatagttggtctccttaatcaacttgttccaatctcctagcctacgtgcatttgttcaaatggacctgaatttttttgactttagcaatctggtctgtgtcagcctctggtcctgcttgtttataatgataaagagccttatccatttctcctaatctgtagggaaacagaaactaccaattagtgacaacaccattaagaaagaaagaaaaaaaatagaagagttggaaggagtatattctgcaatcaccatctttttcttgtgtgagattactcatgttcaagtttcccaatcggtaatgagctctttgataacgaggctctatttgaaaagcttctctgcattcaaacacagcctccagaagcctccctagagccgttaatgctgcaattttgttgctcctgtaggaagctttattagggtcaattgcaattgcagcagcatgtaaagagccaatgcttcttgaaatcttccattcttataatcctcattgggggttcattctagtggacacggccctgaaatagagaacccggttgttccttgcttcctttacttacattctccaccgtttggtttgagtatcttccactagtaacagggttctgagaataggtgtttgtgttagaataggtatctgtgttccctccttgcctgaggttacctaaattaccaaacatcatcacgttgctagaagaagcacgaacaacggtgctgcttcccttttgacgatcggtgatcatgctttcaagttcaccagaaataccaattgcttctttagggacccttcttccattgttgacatagccctccgtaggtgacactttgggatggttcctttggtgggttcggttaacaacagggtttggcttgtggagaggcttggagccagaacgagttgaagagttattagatgaagctgttacggagaaagttatatcttcacagccaccttgatctttttttttgtcaggggcgtttgatgacttttcaaagttgttggcattgttgttgttgttgttgggaggagaacgtcagaatactccatttatgaaaccaccacaaccacattttccctgtggggagttgtttcccatgttccaatggtttggattgtttgtctttttgcttatgttaaaggatgcttcactaagatgatgataaaggactactatatttctaagggagattagattttaatagattggttggctggttgaatctcttagtatattacatgcccagaaatcagaattcaaggaaaacgaagaattgtacaaataaagattgattctataaaatgatgacttcaaacatctccaaccaaaccatgtgaaatcgaacattgaaacacagcaccaacttcgatcctagatcctggagggactccttggaaacaaaatttcttgcagttggaaaggtcatatgaaattgcatcatctagaagggacacagagtactgatacacaaatgagttagtttttttattgttttgtttcagatgcttgtttgattatggcaggaacccagagacccacccggtcatgggcacgaaccctcacgatagattatgagtattaatattatgttgttatatgtaattaacttgctgcatggtttgagtcgctacatcgacccttaaacaaactgtagtgtttccattttttaattggtattttgataaatctttggagatggtggacatatttattcagaaaaatattaacatcatgtgtcaaataagttggagaagaagctgagataggcacttaatagtatttaaactttggtatacaagaaaaactagaggaaagaacatgcatgttaatgtcaacaagtaagatatattaaagatgaaaagggggaaaataagaaaaatgagaactaatattttttaagtttttcattgataaacaacgattgagacgatggattcaagaagacaaataaaattcgacttgtaatcacaaaactaaagctgaaaaggtaacagaaacccttaaaaagagattaagaacattagagcaaattattagaagaattttcattataaaatatctctaaaaaaatcagttcttaactgagtccaattacatcacatcctataatccatgccattgactaaacctaatagaataagaatataaatatacaattttatattcttattatacattgtattacgggttaatgaaactatcttaacaatacaattttatataaatattttaagattaaaatgttgcataaccatttacaatatcacaactttattttctacttttacataggatttaatggtcaaatttacatctatagatctcatgcgattgtagttttcataattaactagtttaaacttctaataggtggcatataagaaacgaagtccaggaataggactagcaaacttacacgtgacagtatgaagtcatgaactaaaaccaaagtgcttgttagacgaaggtggatgtgaaaacattcaagtataaaacatccatctaagatgtaagccaaaaactaaatgcccgcgaaacttaaaatgaagctcagattgtcactacaattttctgcaagtctagttgaaaataaagcagagctaaatccaatcctctaaaagtaaaacttaatttgtcgaatgtaaatgattctgtgatccaattaaaagaaaaagaaaaacagaagcgtgggtaaaaaataatatcaggctgcatcgaaagtatcaagaggggtttctgttcagctctttccctatcgcttctgacaactcctctgcattatactcgacaccaaagcatctcgtaacctccattttaggattcagcaaatacctaattgttttaacatagtttatatccatgtttaaatgcaaccatacagagctacagaaggatgaataagggtagaacaagtgcttacatgttgtgggaacagtcaacaagataatcactgccatcctcttctacctttttaaagtaaacacgatattcttgagccatctgcctaatagctgcaacaggtccagttaatcctatgattcttgagtcaaactctgcaacacaacagagggaaagatagacaagaaacgttagtagggcaaagccaaaagggtagaacattttggaaaggtgaactaaggaatggcaatgaggtaggacatcccaactatgttggcaccccctatctcagctatcataagcacacctgaatatcaagcataaagcataattgaccaaagctaaaatttgaagtaattaaaagtgaagttttgccagcaagacaatctaacctttaaggtaggcacgaagttgtgagggcgtatcacgttgaggatcaatggaaacaaatactggaagaatcttaagattctgttttgattctttatccaaataaaatacataatattaaggttaacccagagaaagaaacttataacacagtaaactgagattgaagtgccaaacctaatatatcaattgcctgggccataatttggacttgctctggcccaagatcgggggatgaggtatagccaaagtagagcaagacccaattcccaagaaaattatgttctgtaattgcttgtttctctgtattaattagtgtaaatggacccccaattatgggtccattggcaacatttctgaggccaccaccctgatgacctgatccaagaaataaagaaattaggataatggaaataaaacatactttaaaacttatattgggatgacactaatgtaatccgataacttgctaaactttgatgactaaacctggaaattgacaacttcaaaatgaaaatgaaaccatctcacccagaagtcacaagtgattctatgaataatcttggataagagcaaggtaaacatttagtcgagtgtgtgtaattcttacaaagtattgacctggtcaactcaactgcatgctttacatttgcaagtcacgggtcaggttagacaataaaaatccaaccaattaagtcataaagcaatgggactaggatctatcccaagctccagtaacaagtcccaacaattgcctactttgcaaaacagaaacctttgcaaagaagagattatacagttttaacacaacaaaaaatggatcttcattaagaattaagaagtagcaaattatgatgtcattaccacttcctttatgtattggaataatcttgcaaaaatgtaacagattatatatccaccctacattctgatgtaatgaattgttcttgataatttaccatatattctcatcaaagcatatgtagctcactgatacatatgaagaacaaatagaaacattttattattgagacataaattagaatattcaggaagtgagttagacaaaaagagaagaaacttgggcaaaaaaaagaagtaacttggacaaaaagaaacaaagtgacttacacaaatgttttttgtcaataacttcagaccaatcaattgaatattgattaatatgtaatcgatcaaacactacttgaaaacggctattctgctcagaaatgaaatagttccaatgttcctggaaattcttactcccattggaccatttgtatctatatgcattaggatcccgattcatggatctctccctttgagaaataaaaataagaggatcgaaccatttcttttgactgtttttcaaattggattcatcaacagaaagaaaccaagttggattaaactaagaggaactgagcatctaatcaaatgtgtttgtctggcaattaagcgaagcctgtccccaaatacatatacacattcacatgcctaatcattaaatggcactaaaagcgacttggtagatgtagatttggcacaatgctgcgataaaaaacttaatgatataagtaaataactaagcaaaaaatgagcaaaaggtgcatagctcgtcatttttagacactgatgttactcagtgtatgtcatgtcaaaattttgaccatggaaagtttcccatttgcaaaatgcttgcatgttcataaattgcatcaacggatttaacagagtgccataaagccaaaaccatcaggtcatatttcaaaaattaattctaacatatacttagaccttactccatagttcatgaaacaccactgaaactttataaccagtacgccagatcactgatatacttagaccctctgacctcctttatcataaccatatttgacactatcaatccgaaacctgtaagaatttcctttcggtgtaaactggactcaagataacatgcgtagcaacaaaatataagaaaggaataaaagattgcaaatatttctcatgatgaaagggcataataattaaagaagtgtacagataaaaagaaacacttgtcaccaaataattgaactccaaactcttcaaagcagatatcaattgagaataccagattgcaaatacctttgggaaccgctctcctctcatcattatagtgaaaaaaagctgcaagcccggcaaatcctagaacagcagctggctgcagttaaatggaataaaacgcagaattcaatttacttgaaatgaggtaaacaatcacgcggatgttgaatagcaatgcaacaataagagacaaaaagtggagtaagggaacatacaacaacataggcaccccatgagcgagaaacctgggaagtggaggtggattctgggtggaatacaggatgaagatcgtgttttgttttaccatgttttgttgattttgtatatctaacagattgagttatcctagagggaacacacctataaacataacaaatgcctatgatgcaattcgtcaaaattaattaaactaagtgggaaaacaaaatccccaattacatataaaagtggggattttagagagtgacctttgaagaacagcgagggccgcagcagtggagcgatgctgggaagaaaacagcataaacctaggaatgggcatgactgagactaactattattatgcactaataatggtggaaagggtttttggtggcaaaaactgaaacccatgacgtgcacctatttctgctataaaacatccaaatactgccttgctttccaagcttattcttcctccaggggctgctttgaatggattggatccaattcctatatgcaaaagaaatggcttgtcatctaaattagtcattagtcaatagtcataactcaacatacattttattaaataggattaaatcttttttttgagtgtttaataaaacaaaattaaatttttttcatcatccttctagaattctagtatgtattggtccttagtaacactctagttacactttttttttttgttttttatacactttttttttaagaaaacaccacaataaaagtgtaattctgctgtgttttgttttatttagaaaaacatcatgacgaaactaagattttattgtgttattggatgaataatataatgaaattgtatttttgttatgatgtttttaaaacaaagaaaaaacctacaacaaaaatataattttattgtgttattggataagtaacataatagagtcaattttttgtcgtacaataaagagtgaaagtaaaataatacaatagaatcttaatttcgttatattattttggagtaaaatcaaataacacaacaaaaataagattttattgtacaatttttcaagcgacaattgtgggatgactaaagtgttagggccaatagcaatacccattggacattgagagtgctgttttgttggcccaatatgctttcgttttattattattcttttattatttattttgttgcatatcttgtattgggctcagctatggaatgatccaattttagcaattaagagtaatttatttatttcatgttagaaaataaatattaagaaaagcggacaaaattgggtgttgacatatgtgtctgtatttaaaattttactttgataatcttgttagaattataatatatacaaaaatatatattttatataatacttattattatatatatatagttaatatttactaagcatttatttttctttaaacaaaattacactcatgagagtaaaccttgcaactaaatttttcctccttaatatatgacataattattgtattgattctaacaaaaaaaaatttatcgttaaacttgtacattaataaatattatatatttatccattgatataatgaaaatagttgtgcatattattagcgtacatcatctgtaacatcctagaaaaataaataaatatatatataaaataaataaataaataaatgcataactaattattatacttttaacttctatttaataattgtaataacttcaattatataattataatataaaattataaaaatagaataggtaatattattaaaaaaaataaaaataattttcaacaaacattaatgtaaactctagcattagttctcagccacgtgaggaattacaagttaaatccaaatccttaggaaatcttccaggtggcaaaaccccctcagctaagctctcagctgttccacgtaaatgcacgcattaatgagaggaataatagtaatgatgaatgagataaggaagcttagatattttatcataaccagcaatataaaaatagcttggcagcttacaaaatttctgccccaaaatctctcagttttctcacctcacacttctctctctcacgtaaaattactccagcagctctcaaagcaactcaccaaaattatcataggtaggctgggcttcgatctcaaaatttgaaactaaaatttacgattaagttatgtatttatgaggccatggttaaccgttaattagttaaagattgaagttttaccataaataggatattgtgaatttttagcaagatgcggcaacctagaatatatatatatatatatatatatatatgtgtgtgtgtgtgtgtgtgtgtgtgaaggaaacttacgaagggtatctcggcacacttatgataatagtttagatatctctattcatgcatctcggtctgtagatactgtagtaattattctttagggtatttatacacatagatcttgactcataaggaataaatagaatccaacagccctgaccacgtgcatgtagtttagccagccttacatttagaagcacctttgtacctatgccataccatgcttatatatatatacatatatatatatatatatggattccagcagcctgtaagctttacttccacgtaatgcttcctccttatatatccatatttaccttggcccttctaagtaagcagctatagtacttaagaatttatttaatgtcttatatatatatataactataatacataaatagttatcttatatatatagttatagtacttaagtaattatttaatgtctttatatatatatatatatatactgtaaatacatatatatagacatatataaatatatatatatatataataaacctggttaaaccacaagtaaacctaataggctttaagtaatacaagtacaattattctgagtactatattttgctataactagctgtgttttaatatatatatatatatatatatatatatatatatattattctcattgtttcaccaacccgatttttggctacaattattataccactaaaaatcgacatcccgtagaggttaaatagatttattttagttggtgaaattttacgtgaacaaggtatgaactattaactaccttgcttaggaacgaagaatattgaattattaactaccttgctttttgtaagaataggaatattttccttatcttatgaattttgtggtatgaatgagaatgattcgggtttccagaacggacctatgaatttatgagattgacccgagttttgaagaccggacctatgctactaccaaagatcaggtgttaatacatgaaaattcatgcatgattagcataagaagaccgcaacattcctacataatgtacatatgtagaggccatgtgcacctgtgaccattgcatttcattctatgcattcatacattcattttacacattcgctcagatatattaatttatttactactctattaaattatttgatgaattagttttgtcttatttcataacctactaacctatttagtggtttagatttgcctactgagaaatttatttctcactagatttatttttattttagatggcttcgatcatagtatttcttgatgcactggatatctggtatgtggatgaagtcagaaactattatgtagtaactatgcatcatgtactgcgtgctcatatttacttcggcgcccattttccaattttggtgtttagtgaagagtttgacccaaccaatccgttctctcagtttgctccgatgtatccaaactcggttaccaaccccatcatcgtactcagtgacgaaaacagtaccaaagactatatttgaatactgactgaaaaactttgtacttaaataaaaaatgtttgaagtattatgacatatggaatgtcaaatatagttagtatgaatatgacaatataaaatagactaaacatgtaatatggtgtatgtttatatttcgttccttttgttaacttcttttgtgtctactgaaatttcattttattttatttagtttaaaagataaaagaataaaataaaaatataacataaaataaaatagttaagaaattaaataaatgaactttagacgttacatcatctactaatgtaaacatataataactgtattagaaaattaattttctctaaaaagactcttttttttttgttagaaataacgttttacttacataaaaggaaaaaagaaaacattttttagtgctacacattaaaactaccatgaccatacccaaatggttggaccacatgaccccaccacacccactacgtagacttgtaatgtggctttgacgcagtcctacctccaacctttttgctttgctctttcagtttccaccacttaactttccttttatatttctgtcaattacaatttattatctaacactaaaatttccaaaaatctcgagtgcctccttaatacagcgtttgaatcaaataaattaggaatagtttaatgtaccccaaaagaaagggctaataaggtttacgggaaggagaaaaaaagaatatggaaaattgttaggtggcattggacttgtcaaaatggcgactggtatcaactgctccaaatgtcagtcgcattcccaaattgaaaattatatatgtttatctattcatatcactatcttcatatcaaatctataaatcaagaaaatggctgttacctctcgtgcatcatcattaaggtatctcttccatcatcctccgcacaagctagagggagagggtctcacttgtactcttctttttttgtgtttccgaattttacgacttttccaaaaggaatatactaacacttttaaatgcacttagggacaaaaggacttggaggaatcacagaaaattcaacagttaagaaccctctcggctattgtttttacgataacacatgtgattagattaattcttagtacaatgaataatcaatacatgcaatgccttctctaagaaaggttttgttccctcagaagtatttgttgattttcttaatctcaatgtatagagattatgcaatttcatataacaaaaatacaaatagattccacaacccaaagtatattaaatttctagctcgtacggctgtattttttcttcttcttaattaagatgaaaccgtgggtttgtaagttgacactttgcttgaccagcatgtatgtttttcttctaagtttattgatcatttagctagcctgtgaacgtgcaagttacaactgagtgacttataacagtaatgttaattgctattattaattttaaatgtaattaataagttttttttaaaaaaaattaaactgcaaaacaatactaaaaaaattagtaaatgatatagttagtgctgtcttatcacgcgtttgaagcatcttaaatttcaaattgtttccgtggttaggttaggtaaaagcatcatatattaataaggaaatttggcttgatctctaaatatttgtggtgtgcatcacctgtgacagagtttccttctcgggaacaaagcgaaaacaaaattgaacaaaaacaaaagaagaaattcaagtgaggaaattgaaaaattatcttccatacataatatgatataattaatttcaaatagtagtacgggaatattcgaataattgcattatcgcctcgtatggttgttctacgtacctttctacattcgtccaatttggctttagcagtttacgtacagcatggtcacaccttagaaaacaacacaaaaataaataaacataaaaaattgaccaaatatttgtttcttcttcttttctttcttcggggattacttttcaaattttcttaacctttgattagtctcgtttttctcatcgatcatccacacacactcatacatatctttttcagctattcgggtatccatctatttagttgttttgattgattgttgacagatggtggaaaataatagcagagaagaaaaccaccgaaaagggacgagaggcaagaaaatattcgcgtacgtgttgctaaaaactaaacagtgaaaaggcatggcgatttggggaatatatcggggtaattggaatgtgatttctctcttcctttaatcaattattaactcaccatcatgcactaattaaagctatatagaatccccgttatatatttcttttatgctatattatcaatctaaaatttatacatcattgaatatgtagaccgaattgttcttaccagcggatagtgattttaaatttaagtcttgtcttaaatccaaaaatttaactttctaaaaatattgtaccaattaattagatattttaaatataaattttaaaatagtcaatttaaaattaaaaatcaattgatgaatatataataatataaaacaatttattattatgttatatagcataataataaattgtttttatattattataattaaattcattaaaaatggtatctaaaatattcaatactgtaattttacatatgtcgtcatcgatttaattatttatatttatagtttatattgtcaatccattctaattaaatttattaagatttaataattcaattttacatatttcttcaccagttttattgttttatattcgtggtttattgatgataatcgaatgtgttgtgtacatgaaattggtaaataaatgcgttttctcttttctttttcataggagtgttttcggacaaattttttaggttatgaatatctttttaaggaaattgatgaattatattatatatgtactgaagttggtatatatgaatgtattttcttaccatactaacttaattagttagtgtcgcatgactagcacaaatattatatttatattttataattataggagtaattttttatattattttgaatttttaatatactattaattatttaatttaaattttaataaatatatgttagttgatatgtcaataaatattatatttttacatacaaaaatattccaaaaaaattattattactaagggtgttatccttattaacaatgaaagtaatcagttatagaacttaaaatcattaattataattacatgtaataatatgtccttggtatataactatattttcttacaatattttatatcaaaattaaataaattttacgaagtttaggaaaacatcaccatcacacgcatgcatcaacgggcacggtattatttttaattataataaaattctcattttaattaaatcagtactagaaatatttaaaatattgtaattagggtgtgtgtttgatagaggagaatggagaaaaatagaaaaaaataagatgaattcagtgaatcttatacatgtatattttttacattttattttaattcaaatatatattttatttgcattctcgaccaaacacaatattaagtttttttattttatttttcttctatttcgttagaagagatgagtgataaatatgttcatcagggatcaacaagtgaatcgaacggccagcatcatcatcagacaacaatgggtatgtccacgactccaattactgtccatttgacaataatgtacattagattagaggtcccatcaatatcatttccgaaacctttcttagattcatcgcttatccttgtagatggaggggacggtgacatatccagtaatacacattaaagtagttttacatgttcaagcaacataaaccagacacaattagttcaacagtttggggcagattaatgcatatttatactcaaaccaataaacaaacccatctacagttctatttgtaattattttggacctttggagcgatgtgtagtgtttcaatattgttgttgaaaaatacttttggggaaggaaactgcacaatctcggtatctaacacaatattaaataaaagcaaacagaataaagaagaaaataaaatagaagtagcgtagtatgaccgtatggcatctgctttatatacttacggttcttacttctttcatattggactaatcatagtgatagaatataagataatcccattgatgtggctctttggcggcattctattactcaacttcctgaaagtttaattacaataaataattttgataaaaatattgagttttaaattttagataaaaaggacgattagtaggcccatgttgtccccgttaaggaaaaccaagtatacatactcacacggtgacgcacatattgccatatattgagccttatttacatacattattaccgagatattactgctatgcgatgtatatgaccaggaatgttcacaattttttcacagtaaagacatggataaactatcatattataaagttaagatgaaattccaacctaagttttagatgacaggtgaaacaattagcaagaaaaacgatttaaattgttgtaggcagggaatcgattacaaacatattatatgtacaacctagtaaactttcgaaatatagtgtacatgtttttgcttaatagacttggtattgttcgggggcaaacttaggtacgcagagcatataggtatatcgcaaagttaaaagggtataaatgtttcacacgtagaaactatacgaacagctatgtacgtatactatggaccaagttaattattttgaggattattaatattagatggtcatttgattgttgaacagcttccccttcccaaaatcacacactcacaaaagaaaagaaaaaaaaaaggaatacttttgttgattttggtcacaagtttcgttggttggaaccaacatgcatgttgttgaactgattcacccatctatcctttgagaacctggtaataaaattggaattatttttacacatgcatatgcttctaaattggtggtattagcaactaacacagacgaatcataagaagaagaagaagaaagagttaacaggaaaaaataatgtaaaattactaaaatacaagatattaggtatacttgataaatatcatgatttctcttctacgtctttattttagaagaagaaggctgtggaagattctctcagattttatttcagatttcccccctattaataatttataaataacaatttccgactgggtcaaagctactggaaacaaataagtcacatttcttcattttttaataattaatatcaataacaaaaagatataaaaattgtttcttgtgtttaccgtcaaaacaatctttactcaactttttgggcataattttttttaagggaggcataaatttattttatacaataataacatatggacgtatatttagtcgtttcttgacgcaacttggaaagccaaatatggttgatctcttacctttatgtaattcaacaaccatcactctagtaaggttgcttgcacacctcattattccgcaaaatgtaagatatgaacagtaagaaaataatgttctaaataaataatacataaccttttcaattcttctatattatgtctttcctccatttcagtctctaaatcaaaaccacaaatctcacatactttgacagtttgaccactaagagcctgccatcacaaagcctctctctctatcttaattcctatagctaccccactccgatattttgctggtgaaaccacatatctaccagaagcagcccctctctctctctctctctctctctctctctctctctctctctttataggagaaaaggctagagaactatccttttcttttcccttatctctcctccttttcgctttcacttgaaaccctaatacttgatcctttttaaaatctgtagtagtaagtaatccaaaacccaggacaaagaaagaggcaagagacatagcaaagacttctcctaccctcccaagtcccaaacagagtaacttgtattcacaatctctctgcaccaagtatattaaatgcatgatcatccgtgggctgtttattcccttgtttacgtaacactacccttttgcacaaacacagattaagtaaaagtgatccaagcactctgtctgtgtggcagttgcagtctcgcagagagcccttaaagacgtgggtggaaggaagcactttctcaagaaaactagcttgtctttccacaaccagaaaaaaattctctctctttttgtctcgctcccatacctcattctgtagctaccatagcaccctcttaaatgcacacttgttctatgtgcaagtaatcagaatctctctactctttgtatccctcacgtctttccattttctgctctcatggagtcggccaacactagcgggagcttgcaatcctcaagcggcgccgatgaagagtacgattcacgcgccgaatcatcaccactctctgcgttcttaaccaaccaaccacaaccaccaccaccatgccaagttgctcgctttattccaccatcacaacaacaacagcaccatctccaaaacacccacatgttcgaccctttatcaaactacttggatcccatcacacaaagttcaaaaccactgttaaaccttgacgtgatgtggtccaaaacaggtagatcccaaccaaaccaaaccgaccttgttgggttgataccttgttcatcatcatcagtaccctcgccacataaccaagcttttgtgtcaagtcaaacaggagggaacaatagtggtgcttttcctaccttgcctccagaaagtggttcccgaggactaatgctttcagtgtcagccgccaacaatgatcaaattcaaacccataacaacaacaacaactccaacgtggttcgaaacccgaagaaacggtcaagagcttctaggcgtgcacctaccactgtgctaaccacagacaccaccaatttccgagccatggttcaggaattcactggcatcccagcaccacccttcacatcctcgtctttcccgagaacaaggttggatctctttgcttccaccgcaacaccaactttgagatccaacgttaacgttaaccctttggaccctccaacacaacctccttaccttcttcgcccctttgcacaaaaactccaacttcgaagtcttcacccgtttcctccctccttttccaacactttactaccaccttcaactaactcttctactaattcaacttccattaactaccaacaacaacaacaactatctgagcatttcggccttgtgaaacagcctctcaactttaacaacaccaccccagacactagtactctcgaggcatatcatcattccaaatacactcttggtaactcttcttctgttcttgtctccagaacacaacaacaacactccttggaaattccggcgaatctcaaaatggggttgtatgaggaactgggactgagacacgaccatgttaacactgacctcggatgtcttcatcagaacatggtttcgtcaacatcagttggagtgggagcattgtcaagtggcaacgacaacaacttgagtaatgctaccaattcttcaacggaatgggcccagagaatgggcaccattaccaacaatgattgcgatcacggaggaggaggaggaggagctctcggtggcactgttaactacagtgacattggggagggagctgttgtcactaatggcaaagtacactactcagcttcttcatcggattttcatggagagaagggaccagacttcactgtaactactgcagccagaactcaaggtatggtggagtcctggattaattgttcttctgattaaagcatatgggccagcaaacagaataagaagaagaagaaaaaaaaaaggattgatgtttgtgatttcataaagtttaaagcaattaatggtgctatatgctagtataattctaatgcatgaaagagagaatcttatttggtatcctcagcttaactatgaccatcgaattaattaagtaaacattatttttcaattatttcttctttttttcttttcatggtgttttggttcccctcaaattatgtgtaaataagtagcagctaattaacttctctttctctctctgtctctctctctctctcaattattgttcccccctcaaattatcttgagttgtgcttttaatcatatatacaaaaggatcctggtggtttcaaagtgtttatcatatcactttatgtattgtgtctctactatgtcaattggagttagattataatatatggatcttggttttgacttgggagagtttaagagaaatactactattgtataatctgctgcgttgattgaacaggattaaaaaaaccgaatgtgtgtgtctccctctctcttcttgtttttgaacgccttcaattcatttggcatctaatgtacgttctgcagtgtaaagatctccttctctctcttttcagtcgttaatttaacgccgattataaagttgtgggttctaggagtaattggtggcgacatttggggaattcttagccgccgcattcttgttttatcgaaatcaaagacatcttcatatgtttccaatttaaagattatgacaataacatataaaaaacacattacacatgggcatgtatccatgagtccatacattcccgtcttccacttattgttgtttttaaatttaaaacaaaagaaattcaataattgacgcaaacatttcacgcctgtgcattttaacggctaaatcatttttctttcttttgtcgatcatcttttttttttcagaatttaggaatagtcacattagaggcttatcttatatgtgtacgtcaccactcaaaattggctcacatagtttccaccggcgaatatgtagccatgatgtgtaataataagatttcaatagtagtgaccagttgagccaattatcttggtacgtatgtatatataaaatcattatacactgaaaaaatggaaaaggaaaaagtgtctgtctgatttgaatcatgaaattatctctccactactttttattttaatttcgcgcaaaattattgtttttatttcctctgaagagaaaataaagaaagtgctgcgggggcatgcatgttctagtacgcccataaatgagactcaccttgatggatttaacaaaagtggggtctcggaagtcggtgatatggttgagaagtgttgttaatggaataacgaaaaccacatgttcacaaacattccaggatcaagaagtgttgtaagatattagttcctagcatgattcatgcatgacatcttcaagaagtgtacccgataccgataccaaaactatttggaagtctttatggttcattgcactttgctggtgtgttttgtttgtgtgaataggaactccgtactacaatacaacagtataagatttttttttatgaaaattaaaataatgcaaattaggtatcaaatctgaagaaacacgattgcggctaaatgtcttggtgtatcaattaatatatggtcctcctagtcccgtaccccgagccagattaggacaatggaaaattccaattcaaataattaatctgaattttcatgacagtatttgctatgtctatacgactaaaatcaaataatttaagtgttccgcatagacaacaatttttgacattttgttgcttttatgtgtacggttagtcaaggaaacgcgggaaaaagttaaagagaccaaaaggaattacaaagggttaggatcagaggaatagtatatcttacaattgataaattattggagtgcgcaatcaccttttgttggaggagtggaaattttttaggtgattcaagatatattattattagttgtttcttgtaaactgaaaaaaattgagtgtatatatatatatatatatatatatatatatataatgtaaagtagccaaaactatagacatgtaataatctcatactttttaataatttctcgaggaagtataaattgttaaaaagtaaatatttgacattatcatcatgctttagtttgctagcatgcgttatctgtgtattgaataatttatattaagatttttaaaagatttatttaaatgaaaaattcaatttttataccattgattttctttaaatctgaagttcacataattatactttatcatttcactttgttttagcctatgatatactatttaaaatataaatagcaactattttttacaaatgataattacaataacatcacgtgattcagtgaataacttgataaaatttatttatgatacaatattaccaaatatatcatttattaagtttgatacagttgatgtcatttgatttttatctttatttaataacaatactatcattattatattcaatactctataaagtattgatttttatatttatttgtttatttaaaattttaaatatcttaacctactaaaaaggcttaggacatttatagaggtagaaatgttggcctatttaaaaaatttaactacagaatggacaattagatatactcttaatactaagtccaactttgaaaaaaattgcatcagactccaaataaaaagacatgagttaaataaataatttaaaccttaaatttaagatcgactcaagttaaatctataataaaacctaatttaacctagtatatttctaccgttatttccaagggctgcttcccatgtgtgttgccaatgcaggcacgtccagatcttaatgctttaatgaagtatggtgggatccaattatgcggttctaattacataataattaaacttcttacctagtggctatatctaaaggaaaaattggcaatatcgaattaactagtatatatgccgcagtgaagtataatataaggttcaattaacatacctaatttatgaccgaaaaaataatttacctaatttctgaagtacttgcccaaaagggaaccgtagaattataattgattatttattcacttaccgattaaaattatgataataaaacccaataataagaaaggaggaaagaacatcagcttcaagcacttctgagctggaatgattataatttaatttgtcaaagttgtttgtcttttgcatgaaatgtccggggatacagtccactccaaaacttaaaactctttttgatttcattcatttatagatcatgatcttttttcatctcacttttgtatttagaaggatgagagggagatatagatgtggatgaatttcaaaagtttttgaatattattttttgtaaagaaagacatgctcatgaatcataaaaaaaaatatcataggggtactttccaaaagataagcagctttcacattaattacttttacaaactagtaaagattatagtgtatcaaatatgaaataaaattgaaatgattacaggtgtgggattttgggagatttgttaggagagggcttccgtgaaaatggatgccctctatctttgacatttcatttaacatgatgcatggtggcccattgccagtaaacaaggcttcgcttttttgcactttaacagtgatggctttatgcctttctctcccatcccacccctacagtgccctataattttgagcctaaacttgaaaaagatgaacaacttttccactcctcatgaaaaaaggctgcccctccttcgcttcaattcatttcttcactcgggaaagcatcaattcaagtacctgatgccagaaaaagacaaagctatatcagttgagttgaatgaaacttttttttttttaattaattgccttaaaatgtatgtatgggtcatcactttagtcttatttttttgtttaaagaggtctttattagaaaaaaaattcaataaagcgataactttttatgatttaaaaataaatagtaaattttatagtaatgaaaggctaaattaataccaagagtttttttttaacccataatataagtacaaaatatttattaactttattgataactaaaagaacccgactaatcatgatgaaaccaaaaataaaataaatattaaaagagaagaaaatttaacatataaaaaataggagtgtttaggaaaactataacattaaacttaaaatgctaaaggttaattatatatatatataattaaagggtcacaaaataataaatagatcttacttttttattctattataattgttgtgtgagaaaaaaatgttttaaaataattattattttaattttttaatataatattaattactttttttatttatatctcatataatattaatagtgaataataaaatctataaataaattaataattatataaaattaatttataaaaattatttatttattattttttaatctgtgtaaaataatctaagataattattgttttgagatagaccaaacaaaaagaaatcctttggtgatgcactgttttaaggctccccgcacaaagttgagtggttataaagaagtttacacataaatgaataaattgtttctcatagcttatatttagaatgtcaccagtatgaaagtatagggaattaaaatgtgaaagcaaatgctttggagtgaataatatccacggtcacaagccttgacttcagatcgattttaattggtgtgttgtctcaggcaagcagatttaattattaaagtaatattagaagggggcaaaagaaaattttatatgtaaatattataatgtttatgtattacagggggcggatgcccttgttggcctgtacacctaattttgccttagagatccaaattgaatcaacaaaaaaattaaaagatgaacaaattaatttaaccaaaactaaaatctcataattaaaactattgatagcttgattaacaaataaaatcaatataaagatatttatatttataaaacaatcttaatcttttcgtaccctattttatacacctacattatttttttcgatttttttatattttcatattactcatcatatatatatatatatagattatttcccctctcaagaggatataaattatacaaccacatgagtggtaaatagaggactaaggcccagtgtggagccaccaagcctctttcctctggattgcattggttattaccgcaagttttgattgcctactagagcctataaataccatattctctcattgtggtgttatgttcattcttttttctttcatcgtcttcttttgcagttatgcgcaattatgtattgattgaatggtcagactagcactgaccatgagctttatagctatttttactcatgcatccgggtaaattcgtgaacgctaataactgaactgaaatgaaattaagaaatcaatttggttgctatcgagtacttaggtgattgaaactagataatatgttcatacggtgaagatgtgaggttagtctgatgattatagaagagagacttaagaagaagagagaaaaggaaaatataagtagcatatttaaatatctttaactaatattttttaataaattaataaattaatatttgttaataagaaaatatgttcgtatgattcagtcacatgttctaagtataattaattcgatcaaaattgacgtaatacaaaattttcatatttcaaaattagtttcattatgcataagaaatagtgatatataattgaatgacacttcaaactgctatatgatatttttcctagaaaaaaattacaataaatgaaaaattgtgttttataccgtgagttaatagcttattttattttttttatttttgaaatagtattgatataattttaaaaataattattataaaaattaataaatttatctttgtgttaggtattgagtaaagattttggattcaagatttaatctttagtaaatctcctaggaggtgaatatgattccaacatggaaaatgagtttttgtaaaagaacactcaagatctgtatatttttaaaaaaaattctctcttcctaagatttcaaaatgagttttatcattaaagaaaaaaatgggagaaatcttgaaagatattcaattttacataatgcttatgggatcaccaaaaagtgatctaagatgacaatttgaaatttaccattaaaatattcttaaaaaattcattccattcaagcacttttgccgctcgttacgcttattttaaagggttggttttgcttctcagtttacacccgttttctaaatgaagatggtgttcatcatggccaatgcagaaccatgagtggcaagtctcaacggtggaggtcgtgatcttcgtcaaaacatcgaagggctgtgaaataatcgcctctgccaaaggaggaagatcccgacagaaatagcaattagtggagaatccaaaagtggctgagaggaggaaagggactcgtagacatggttttcataaaatttactttacacagaaattcaatcaacattatacttacttagcgtctgtttgtttccgcagacacaaataatttgcgcggatcgaattgggagagtctcgtttgatacagctaatggagggaagaaataatcttaaaaattggtgggattaattgtataatttttcgctatttttttatctctctataattttctttttatcttttctttatttctcttaagttaaacttttttacttttcactttattcctcttctattttcactttctctttttatttttatatattttatttctctcatctataccaaacacactcatcatgtacattaaaatttaagatcaaattacaaattcatcttacatcaatcattacaattttcaattactttctgatagataatgctatctaaaaatttgtcattgattaaaagtttattttacataatcaataaatataatttaactggttgaataaaatgtataaattattataaaaaaaattctaagataattataaatcaaaatcaatataatatatacttctagaatatacaagtatgtgttggataatttccattttttgacactttccatttttatttgattctgtttttatttgattgaccaaatcaaataatatttgatggcttaggcctagtccattgtaaacctaattcatcctataaatagatgagaaagggtggaagcaaagacacacaaattgagagcctcaagtgatagtcatgagtgtcatatttgagcaagccaccgtgcctgcatatttgagagcttagagtgaaacactgtgagcgtttgagtgaccaccattgttggagaggttgagtgtaccaccacattggtgtgtttttgattcattgtaaccgattattgttatattggattttgatactagactaggtcccgtgagtttttccttttctcacattgagtaaggttttctcacgtaaaacaaattctgattgtttttctctctctctctctctctccccctttgattttttgatttccgcttccgcaatttgatttaatttgacatttgagggtccgagatacccaacaatggtatcagagcccgggttcgacgggttctgaaggagacgagatggagaccagtggcataactcacgacggagatatgttcaagttgactgcagataacttcaactattggaggtcgatgatggaggatcatcgtatctgcaaggatccatatgatcccatagttttggaggagaagtcgactggcaagtcggacagggactgggagatcctgagtcgtaaggcggtggccacgatccggaaatacattgacaaaagcctctttgagcacgtgtccgagttcacgaacgcgtacgagttgtggaacaaattggagtccatgattcagaagaagactcccaggaacaaagcacacctggtccgccgccttgtgaagcttgaatacaaggatgacatgagtatgatcgagcacctcaacacctacaaaggtattgtgaatcaactacccaaagctaatatgaaaattgatgatgagatgcatgctttgttgttgctgagttcgttaccggaaagttgggatactttggtggtgactttgagcaactcggttccagaaggaaaattgacgatggatgccgtgacaaacaacctactgaatgaagaagccagaagaagagaacaaggtgtatctagcacgtttgaggctaacgttgctgggaacagaggaaagagcaactcccagggtcgtggcaagagccgggatcgaggtggatgagataggttcagaggccggtcaaggccaaagcatgacttgaagtgcttctattgtgggaaggtaggacacaagaagccagactgcaggactctgcagaataatgaacaaaacggctgtgtgaagccggatcaaattgttcccaaaagaagcagtgatcagagcaccacagcggtggctgccaacccgaatgccgagatattcctcctcagtgaggaaatgttgaatatagcccatgatgactgcacctggattgttgactccggtgcctcgttccacatcaacccatatgagggattcttctctgcctacaataagggagattatggtgtcgtaaagatggaaaatcaggtgactagtaggattgttggtattggtgatgtaacctttaccatagacacaggatgtcgggttacgctgaaggatgtgaggcatgtacctgacatgcgtttgaatttgatctcggttggaaaactagatgatgccgggtcagtaaattactttagagaaagtagatggaagctgaccaagggaagcttagtcgtagcctgaggaaaaaaagaaggctcattgtatgtcatgcaaggaaagaccagtggcggagaagccaattctgtccgagatggaccaaacttggagctgtggcacaagcgcctcggccacatgagcgagaaaggactccaaattttggagaagaaagagctattgaccgggttgaagggtcaagtgctggagagttgctcgcactgcctagctagaaagcagcaccaggtatcgtttgtgagaccggatcaacccaggagacggaggtgcatccttgacctcgtccatactgacgtttgctccatgtccgagagatcactcggtagagctcagtactttgtctctttcattgatgaccattgatcgcggccgtacacaaccaaattaattcagtttaaaatgtagtactaggaaagtgactcctaggtcgtctctcaaggatcaattgtcaatgtttaagggattgaaaacgtgttggggggatttttggcagaatgcgaaaactaaattaaacagaaataataattaattgcagtgattaaaaacaagtcagacccttagaacagattgcgcatctaatatccttggttcacgaaagataaattgtcctactcaattctcatcagtccagattaatcaactaagcgaagattaacctaaaacgtcattacacgaattaagcaaacgtgaacctcgttagggaaaactctcagaattaagcaaactgagaatactgaatcaatcaatatcaaaatcattaagcatgactctaattcgaaaaatacagaacagaaacccaaacaaggaagaacaagcagaaaacgaattagaagaacaagaacctccattaaaggtctgcaatctgtcctagggtccaaccctaggtttagccttccattaattcgaaattaacaacagaaacataaattgaattgaaacgaaacattaaacgaaattaagaacagaaacgaaattgaaattgagaagatgaagcagaaagcgaaaacaatactgaaactgaagcagaaaacaaaaatattaaaactaaaggaaaactgaactaaaattgtattgtaggttgtatgttcttgtctgtctgttgtgtgttgtgttggctcttgtgttgtatctgagttgtctgttgtttgcatgggcacagaaccctcaatatatagtaactgcctaacctaaaagaatgaaccttttcctaacaattttggcccaaaatcactaaagataagataagataaaataaaataaaaacgaaatccatattctgatatggaaaatattaagcataaataaaaacgaaatctataatttgatatgggaaatattaagctgatgctgacgtggcgcactaatcttcagtccataaattaattccaagcccaattaattattaatctgccctgaaaaatcaaattagaaataattaacttaaaataatccaaattaattaaaattcgaattattggtctaattaaatcctaaatgagaaacaatgcaaaatataaacaattaagcacaagttagggattaaaatgagtacagaaagatgagtaaatagtgataaatagtgactcatcaaaaccccccatacttagccttttgcactcctgggcaaaatcaaaaagtagagtagagcaaggaaaaattctaaagacattaaagaaagtgacacaccgtaaaataaacagttctacacaatccttaatgaaaactgggaaagagaaaagaattgacaatttccaacacacaaagagtcagagaaactgcacacttatgaaattcatccaagcattcaaaacttatcaaaacaatcaatccgctcaagaggtgaattaaaagcaatagaacctcactagatgcactgtatcacacactgtatctctcaagtgtttagtcaactgtatactctcaaaacactcatgaaaacaagcaaaagatagacttggcaagcctctataatcaacacccaataaacatgcacataaggatcaaaaggtcttttcagggttgtaatgtggccaaggacatgggtaggataaaatatgggataagtagctgcaaaccagagggactagaggagcaatggggaataagtaagaagtaagcacgaaaacaaacccaaaaatctctaatcagcctctaacaccattccttttcctttgcttcaaacacaacaacttttcttcaatttattatttttttctttcatttctatatttttctctttttcttttcttttcttcttttatatatatatatatatatatatggtactgactgatatatgcatagaaacatgaagaataagttgaacatcagagtaaaccaacaggccagagatatcatctaaaacaatatatacatgcaccccccttacttattcccaaaacaattccaaagctccaaaattccctaaggttaaggtaaataattgtttttcacttaaggcttgtaatgagcttcaaacaaaagaaaggaaattaggctcaacagggttgtcaaaggaattaaattcagggtaagcttatttggccagaggcttatcagaacaaaaatgccttaatcatatccaaacatgcatgagaaccaagaaatatcaaacagagtcaagacaaggcaactgtgcaagcaatcaagaggtatagcacacatgaaagaacagatagtggctcaaatcctcacacagggtatatctgtcacagttaaatcaacctttcaaacttcataatcatctttccaagtagagaaaaacatgaatttcaaaccatacagtatgaagcaactcttatctaagcatgaagtaggtgtcaacacttattcaaaatccagaaatcaaaaagaaacatgcaaaactattcgcaaaaataagacttaaaacaaacaaaacaagacaataaaactaatagaacaaaacaaaacaaaactaacaaacaaaacaaaacaaaaattacaataaaactaatagaacaaaacaaaacaaaactaacaaacaaaacaaaacaaaaattaacagtctctccccccccccacacttaaaattacacattgtcctcaatgtggcacaaataaaagttcagaacaatcagaataatgcaataaatatggacaagtgtgataaaaataaaggaggagaaagaaaagaaaattctaaggtgtagtgtaagatggaagggaggtagggtcaatcagagatatttcttccacaactgcatctagcaaagaaggattgctgagatggtctgctaccaaattctgaactccactccgatcacggatatccaaatcaaattattgaagcaagagcatccatctgatcagtctaggcttggagtcagtctttttcaacaggtactttagagctgcatggtcagtataaacaataacaggagaaccaagcaaatatgatctaaatttatcaagagcaaacacaatggcaagaagctctttctcagttgtggtgtagtttgcttgggcagcatccaaagtcctggaagcataatatatcactctaggcagcttatcaactttctgtgccaggacagctcccaatgcataatttgatgcatcacacattaattcaaatgggactgtccagtcaggtgcctggaggataggagtagtggtcaacgcttccttaaggtgatcaaacgccttcttacagctatcatcaaagttgaaatccacatctttttgcagcaaattggatagcggaagggccttcttgctgaaatctctgataaagcgcctgtagaaacctgcatggccaaggaaagaacgaacctctcgctcgcaagaggggtaaggcagatgtgaaataacagatacctttgcaggatctacctctatgcccttactagaaatgacatgccctataactattccatgttctaccatgaaatgacatttttcaaaatttaagacaaggttagtttcaatgcatctattcagcaccttatccagactgtctaaacacatgtcaaaagaggatccatatacagtaaaatcgtccataaacacctctatgcaattttcaagaaaatcagagaatatgctaagcatgcaccgctggaaggtaccaggggcattacacaggccaaaaggcatccccctataggcaaaagtgccaaaggggcaggtgaatgtggtcttctcctgatcctcaggagcaatatggatttgaaaataaccagaaaaaccatcaagaaaacagtagtgagatttacctgccagacgctcaagcatctggtcaatgaatggcagcggaaaatgatctttccgtgttgcttggtttagccttcggtaatcaatgcagactctccaactgttttgtactctggttgggataagctcatccttgtcattctttacaacagtgaggcctgtcttctttggaactacctggactggactcacccactgactgtcagagataggataaatgatcccagcctgaagaagcttggtcacctccttcttcactacatccagaatcaccgagttgagtctcctttgtggttgtctcacgggtttagctccatcctccaatgatattctgtgcatgcaagtggatgggctaataccagatatatctgccagggtccatccgatggctttcttacgctttttcagaacttgcaacagcttgtcctcttgatcagcatcaagggaagtggaaatgatcactggcaacctctcatcattatccaagtaggcatacttgaggttttccggtaaaggttttaattctggaatgggattgggctgatcagaagaaggaaccaaagaaggaagaaggatgggttccacagcctatacctcaacctgcaagtcagattcttatgtttttcctaaaacatggttagtgcattctgactctaaagaattaatatccagacccaatacctcagaattaatttcagaactagcatcaaaatgggacatatgttcatattgaaaatcaaggcaagattcattatcagattcatattcagattcagattccatgcatgcaagagaattgtataggttggatagaaaacactgtttcgtatgattggaagaataaaaatcggaaacatattcatcaaccacatcatcaagaatctcagcacggaaaacagaatgattttcagatggatgtttcatggcatcaagaatattaaaatgaacaacaatatcaccaaattccatagataatgtaccagcataaacatcgatcttagttcgggctgttttcataaatggtctgcctaaaatgagtggaacagaactattggagaatccctcctccatatcaagcacatagaaatcagcaggaaaaattaattcaccaaccctaactaagacatcctcaataaaacctttaggataggcaacacttctatttgtcaactgtattactacaccggtaggttgtaaaggaccaagaaacataaatttaaaaatagacagaggcataacatttatagaagcacctaaatcaagcatgactttatcaaatttattattaccaataacacaaggtatgcagaaagtacctgggtcctcacatttttcaggcatatctggaatagtattacctgtcatagaagaaacatttctgcccatgctgactctctcaattccagtcatcttcctcttcctcttgttagtgcacagctccttcaagaatttagcatatttcgggatgtgcttgatggcatccagcagaggtatattgacttctactttcttgaaaatctccaatatctccttatccacatcttccatcttttggtgattgatctagcggaaagggatagaggctgcgtgcacatcagaact

SEQ ID NO: 39 - DNA, 744080 bp, Glycine tomentella
gttttattaagggatatgttattgacactaccacaattgctaatgacactatccacatggttgtcatttacttgtatgtcatttacttgtattccaaaattacccactggatagaaacacaacgaaatcctatttccattattatttgggagtgcaaaaaaaaacaacaaaaatacgattttgttgtatagtgtacagtggaattgtacttttgttgcactcacaaagggtgaaaaaataaatgcaatggaaatacaattatgttgtactatacatcaacgaaatcatatttatgttctttttttgttttgtttttttctaaacggaaatgtattttcgttgtacactcctcccattcccttttcccttttcttcccttcctctacaaacacaaatgaatattgaccactgacaacaacatgaatctcgatgggtggcaagtttggatctcaatgtgatcgaggaagtgtgacgcagatcttgaaagtgggtgtgcgtgactgtgttggaggacgacattggggtgtgtgcactagacaaagatgaagatgggataccaactaaggagtgaggaagaagtctgagaaaaaggatggggaggttattggcactactaaatgagtgagtaaacaaagaattatgcatgtgttggtagtgccaatagcaaatttggtagcaaccataacaacagtcattcttgaggagacttgaatcctacactcccacaagtgtattctgcacccccctatttcgtttgaaattaccccactacccttaatgaattggcacatccctccccaaccctaacatctttctcctcaaaagcctaacacctccctccaacaacgcatctcttacctacgactcacctccttcccgtgaaggttgcttccttcctccttcatcttgaagttgtgcatcctttcctctttcattcctccttcatcattgaaggtaaggttctttctttctagtgtgggtttgggttttggtgggattggggtttgtttcttttttacgagttgggtttttgtaggagataggttttggtgagggttgggttttggtttggaataggcttctggaatggttactctgtaaaagccatctgtaatagccattgactattccggaatggctattctggaatggctgttccagaatagtcatttcggaagcctttgcctgttctagaatgcttgttctggaatgcatagaagacaggctatttaaatcttgtttgaaaatgaatttgagttgttgattatagtgatgttaaagctaattatcattaaattatcacaactgaattcctatgactaaaaatgatcaaggatcagcacaactttgttagcagttgattaggcattactcccaggattgtttctttgaattccctacattcaaactagtttagaaaatgtcatcgttgcctatttgaattttttattattagtgtaaaaattagaaaatatattctattgtttacagctaattatttcaaaggaatgtctctctctttttcttaatttacaatttattttctcatttatctatataacttataagtgctcaattgtttccatatcccttgttagtaatattttttcttcttgcaatttacttaaaaaaaaattaataatagcagttaatagaacaagttaatgtctttttcttttattatatattattagtgtgatcccctatagaccaaagttaagattatattatttatgttagtaaatttaatttgatttgtaccccctacaatttattcttagtagtttatttatgtgtagtttagttgtaatatgtaacaccccgtaggcctccgacgtgttatcattcataatatcagtttaacgtttaaaacatagtttataaaactcagcggaagctcagaatcgcttttcttgatacattatgtatgaaatcacacaaaatcacataaggcatacccctgctgatccagtttctcatagcataacccatacagacagataactaacagagttaggcagattcatcaaagatacaacagctatactcaggagaactcgtctcatatacataacatatctagttctgtacaaatatacatcagtactcacaccacatcgtttgacacaaaagaatatcatccctcgcaggggtatacagaactatactaatcatcaggagtacacacactccatccctgctctagggtacaaaatgtaatcaaaacaatccaaaaatgagcctatcagctccatctgctgccatcagccaagcaggaaagtctctactcgggcctcctgccctgagactgctctcttcgtccggaagagtcacctgaaaagcataatcccccacacggggtgagataacaaatctcagtaagctcagggtccatggaggcttctcctccaccctggcccactttcatagcacatatatcaggcaatcacaagcaaatggcccaccggcctggcccactggccctcataacaacataagcatagcatacaaacatggcggagctgcctcaacgcctggcggagctacctcaacgcctaaatcagtgggagtccggaactcgcacctgtgccatcccattgggtgctaacccttcgcatggatgcacaacatatggcacctccgagaaaagaaggagctacctcaacttctaatcccctggcctgtgggaatcaatcccctgggagctacctcaaccaagagccagccatgctagaaggaaaaccatctcctagggaggtccatatctatctattggccaacagatctatcacagtcatatcacaacacaaactcaagcacatatgcatacatacatcattatgaggatgcaattaccaatgcatgcatcatgaaatgaccaccactcccctggagtgtggtgtggcacacaagatgggaattcatcccccagagacactgaacttacctggtaaggtctcagtcagcaattccttcccaggtctgtggctcccgccaacaatagtctcacaatcaatgcctaaccaaggcatatgcaatttcacatcaaaatcagaccacagacatgaaattcacaatatatatatacatatatacagaaatcccctatcctagggttcaaaccaactcagcctacactaggctgctctaagaccattcaaggtccatcaggatggaacacaatccatctgagtcattctagactcgccacacatatacataatctaaactttactcagcctcacaattcaattgttatcagaaaggggctgagatcctctcaaagccctgttctactagcctcttagctcagagcatcacaatcaaggctctagcctatcagagaaccatcaacaagtgactctacataagccacataggcatatacagagccaagattcaaagttatcagaatcgaaaactgaaagttaatccttcatctattcaaagccctgaacaactttctcaactggaccctgggctaattctagccccagctcatatgggtcactattcacagggacccccagaatcaaaattaaacggtgaaacttgcgtttcttacctcagtggcgactccaatagcttcagaacagcttctcctagcttttatgttccaattacgctgtggttctgcgccaagctcgagttctctgagcttttccctctgaggttcctcttctcactcaatctggggtttttaaggaaattgatgaaggattcaagctttctactcggctcaaacaagtttctaaggctcaggaaggtgtttaggctgagaaatcaagtcctaggaagctcaaggacttcaacaatggaggttggctcaagggaggaagaagaaatggaatttcttccattttctcacgttttggcctttaaaaactggtctgccgacgttcccacgcgactcacttgacatcccacgcgtttcacttgagatggcagacagaaatgccctttctgagccacttcccacgcgactcgcgtcgtttcccacgcgactcgcgccatacattcgggccttccacgcgacacgcgtgggactcgcgtggagttccagtgcaaaatcatgctttctgggtcacttgccacgcgactcgcgtggatcttcaagtgactcgcgtgacatggcagagccatctgccctgtaaaacacatatggcgcgtgtcgcgccacacttcaagtgggtcgcgccatatgccagagccaccttaaaatttacattttaaacacctttccaaggattctaaagctataacctttggcgccatcaacgccaatcttggcgccaccggcgccgcacccttagtagggttttctgacctgaatccccgcgctatcgcgcggggttaagcgccgaaaataaaagtccttacataatatcttatgttagtaaattaatttttagatggatcgtacaaaaagggttagttttgatggtgatgatggcaatggcagatgtgttagacctataatatcaaaacgaaggcgatgtgtaggagctccaatgatggaccctttggaccaacttgccaagtagaggctttggggcatgttcagcctatggagcctgttgacaaccatgagctagaagcacctattgtattccctggtggccctgaggacacgtcacaactgacttcatatgttgatcatgtggcttggaaattatggagtggcatggtaaactactaatactaagtttgtttcaatatttataattgattaactattgtaagattcttttttggaacttatttagtaattatctatgttcttgcaggaacgtagtgagctatagttagtatcacgtgggagaaagtttcagtcagatattgtcctacatgaccagatacaggatgtggtcaaggggttcattttattttcgttgacaacatgcagttatcacaccatagacaagggactcttgtctgcttttttcgagagatgacatatagacacaaacaccttccattttcctgggggagagatggtgataaacctagatgatatgacgtcattgctttacattcccattacaagaaaattttgaacatatggataaggaagtggcaattcccgtgcttgttcacttacttggagtttaatatgatacttcatttgatgagacaaagaaaacaagcgatggacaagatcttacaatgcatccacaacgagatgtgtctacaccaacaaattgtattctatgaacctcatctgcaatatgattcaatgcataccttggagcaaatccacgcaatctcttatacaattgtacattaaaagtcaacaacgtgaatgctatgttcaaatgaggctttaatttgattatgttgcataatgatcatgttgttcattgcatcccaacatttacacaagtctcccatgctagtatggagcaatagcttcaatgccctataggcagacttaaccctacaaaacaagtttgagaaaagcgtcccaataaaatgaacattgtctacaaatactagtttaatgaaattattgtttgaaacttaaacataaaaatggagaagcttaagaaatgatgatgaatgacgccacgatccgtaacggagcgataagtcagaggaggattcgccacaaaggatccttgataagaatcaatttggtttcactcaagaaccaacaagaggcaaagctctcaatgcaagcaaaatgcttaatttcattaatcaaagttgtccaaaaatagcatattctgagtacttatagagctaaagtctctaataatgtcataaaaatgtatgtttagaactatttttggtaatattaaagcccagtacaaaaacaaaacgattataaccgaatgtaatcgattaatacgacctgtaatcgattaaaacagagtgttccaatgttgtgtaatctattacagaaagatggtaatcgattacaacaaacagaacttgcttagtaatctattacaaatagatggtaatctattacaacaaacaagacttcttttgtgtttgcactgagttggtgtgcttcttcatgcttgtccacaagatacaagttagttttgatgtggttttgaagaagcttcggtttggaccttgtctttggaccttgtcattggacccttcaattcatggagtacttctagaacttcatgatctttggatagtcctctatcagctctccttgagtctaacaaaatggacaggtgaatgtggtcttgtgttggtcctctggtgcaatatgaatctgcgtgtaacctaaaaaaccatcaagaaagcgataatgtgatttacctagcaacctctccagaacctaatcaatgaaggagaaagggaaatggtccttgtgagttgtctggttaagtctcctctagtcaatgcaaactcgccaactgttggctactctagtcagaatcaactcattatcctggctttcacaataatgatactcgacttcttagggaccacttggacaggtgaaacccaaatgctatttgaaatgggatagatgatccctgcagctagtaacttcatcacttctttcctcaccacatcaagaatagtggaattcagcctcctctgtggttgccttatcggcctagaatcatcctccaagattatccaattcatgcaaatggaaggatttattccaagaaggttagcaagtgtccatccaatggcctttttgtggcctctcaaaacatccaacaacttctcttcatgcttaagtgacaggatactagatatgatgactggaagcttctgagcatcatctaaatgcatatttaaggagctcaggtagtggcttcagctccaaggaaggttgttcaatggtcgaaggcaaggaaaggttggtggataatggaagggagatagaagaatcagaacttgtatttgtacctacacctgcaacacaatcagagtgaaatgcggaggacatctcctcacaaatactacacgctgtggcagaatcatcacaggtacaattacaagaaccaaaatcaaaatcagaaaaatcagaaagtaaaatatgtacaaatatctacactatctacaacaacatcaaggatataaacaagaaagacaaaatgctcctctacaggacgttaaaggcctaaaaaatgttgaaataaacaacgttatcaccaaactccatggaaagagttcttgcatgcacatcaattttggtcttggttgccatcaagaatggtctccctaagatcaatgtggaaccatggctgaaaaactcattctccatatctaaaatgtaaaaatctcctggaaaaattaaatcattaactcgctctagcacatctttaataagtccaagtggaagtgcaacactcatattggctaagtgaatgacaacaccagtgggttttaaataaccaagatgtagtgatttgtaaactgatgtgagcatgacattaattgaggctctaaggtcaagcatgacatctataaaagtacaacatccaatggtgcaagggacaatgatgaagcaaatggcaacaacagttttgccttgtagaaacatttatgtccatattcacttgctcatctcccttcagcttcctcttgtgggtgcacaaatccttcaataattttacatatttcggaatctgtttgatggcatccaagaggggaatgttgacttccacctttctgaaagtctcaagaacatcagaatcaagctccactttctttgcagaaatggatctagaaggaaaaggtagaggaatctgttttggtatagaatctgttttggcaccataataaacttttgcaccagcatcaattttggcacaaacaattgttgaatttggaagctccgtgccactcctcaagataatagcaatcacattctttggattaataattggttgtgctggaatattaccagaaccttgctgctatatctggttaacagttgtagctaactgtccaatatgagtctggaggtcttggatgttggcgctgacattttgttgatatggaatgttgttggttgccatttgcttcatcaggtcctccaaggaaggtctagaactgttctgcataggttatgcaggtttaggtgcaggctactggaattgtgactgttgtctgaatgggggagcttggtatttgctggtggagggttgatattgttgttgttgaggtctgaatggctattgttgtatctgctattgttgttgtggaccaggaccatacctcaaattcgggtgatctctccaaccaagattataagtgtcggagtacggattatattgttgttgttgagttctgaatggctgtccaggttgtatggcagaaacttcaacagcttgttttgtttcttggaaagtggggcatgtatctgttggatgatcaggtgcataatagataccacacaaccttggttgtttggctgtcatcacattctgttgtcgaccaatggtaagttgtctcacaagggatgtcaattctgatagtttattatccaacctctggttatcagcaaccatagaaacaaaaacatcatttgcagcagccttggatgttgtagtgcctctagtaccaaattgttgataattggctgccatgttagaaattaactgtcttgtagtaagaggagtcttgtccatcaaagtgtctccactgactgcatctatcatactcatgtccatcaacatcacatcttcataaaaatactagatcaataattgctcacttatttgatggtgaggataggtagcacacatcttgttgaatctctcatagtactcatataatgtctctccaggtagttgccttataccacatatttctttacagatggatgttgctttggatgcaaggaagaatttctccaaaaatcctttcttcatatttgtccaagtgttgataggatatggttgaaggtacaaccagtccttagccacatcattcagagagaatggaaatgtcttcatctttacatagtcctcatgaatgtcatgtggtctcatggtgaaacacactacatgaaactctttaagatgcttgtgttgatcttcacttgcaagaccatcaaactttggaagaaaatggatcagtccagattttagctcataactaacatcagtctcaggatattgaatacaacaaggttgataaacaacatcaagtgtagccaattccttaagaattaggttgttataagccattgtataaacaaaaatttcaaaatcaagatgttctgaattagaaacaaaagactcagaaacagaagaatcaaaatacactatattactatctagaactacactatcatgcactacacttttgttatttatgctcaacttgtgaaatgtcctatctatctcaggatcatatgaatgcaagtcacttgatttggaccaagtcatgcatagttccactcatcaatgatagaaatcacaaaaatgtcaaaaataacagacagctactctaccaagacactattcacaatatctactaaaatgaaacaaaaaaaaatggaaaactacccccaaacaattttaaaaaattcaaaaacaccacaataaatgtctaaaaatcatgcttgatttttgtaattttttggtgattttaaaaaatcataaaaacacaaaataaattcaaaagtggcctagatcattgaatttggcaatttggacccacaatgactgtgttcgtccctcacaagtcaacttgatgtattaattttttctacattctggtaaattttcagcccattctgagattgtttgctatgaaatgaccagaatgcccctgtgctaaaactcctacttagaggcggaagggataaactttggacaccaagttgcacagccaaactccacaagaaatatcacttctggaatacacaacacacaactacactacaccactcctctctctactaccatgtttttttcctctgttttttttttcatttttgcaccactacttcacacactacataacaacaacaacatcacacaatgcaaataggcagcaaagtgcaattatgcaacagaatgcaattttttttaatgtcaatttatacctatactagtatctaattatgagtaaattaaagttagcacacaatgaaccgtatccccggtagcggtgccagttttgataactgatgtcgcatcgctttaaaacaaataagttatgctaattctgtaacacaagattaacctaggtcggcttagagatacgatcaatttggttcaaacagtttgtaggcgatgaacaaaaattgtgaaaacacaagctaaaatttaagaaaaaaaatgtggaaactgacagaattaataaaagatgttgtaaacagattcaagaatatcaatccaattcaccaaaccaagcaatacgaattatcatagttatcgtataatgatcttattatgaacattctttcaatgtcattagaagtagttcaatcgaataaactactaaattaattgaaaccacaaaattaattgaaatatcatccaaacaatctgttattaaaattcaaaattaggaaatgaatccataacctaatcctttttcaatcctaaacacattcataatcatgaaaatcgaataaaggattgaagaagaaaatgaccattcccacagaaattgaaatatcaaaccagaactcaaattctccttgcttggattagatccttggattgattgattgtttagccttccatgatcatcatcagtggaagagccacaagatttgtgcaacaaaatagaagaacaaaaatgaaaatgaagaagaaaactaaagaacaatgaagaaaaattgagagaaaaagagaaagaaattttaattctggaaacttctaaaaaaaactacaaattttgtttgtgctaaaatgaagtgtatctctaactaactaattgaactaatataaagtgaatgagtcagtaggaaaggatgggtcgtgattagacttatctaatctaactaattactaattatgctaattcgcagcccaaaactcaagtgcagagattttgaattccaagcctaaaatgaccctcaaaatgacagaattcgcctcgacttatctctgaaaaaattgtaactcttttccttatctttctcaggattactcatatgagccatttgaagttctatggaactctctaggtcctgcacaagggagaaaggtcaagtaagccaaaaaaatctgaaaataagcaataattatcaattaagcgcaattgtttgcctaagacaaaaactgagttagagtgagaaaataaaagtccaagagaagtcaaataaactaagaagaatagaaaaatgttaaactaaatatgcttaatcaagcagctagggcatatttttttgcatcttataggttgcacaatctttgctaacaagagtgacatacatatttgtgtggtatttcttggacgcatttcgtgacctgcagtagtctagagggttttaatgggtagcggttgcactccttcacatgtatgataatctaaattatgcatctcaacaccgtgtattgggaacatgattgaagatgacaactaccatcaaaaccaaccatgtgcctttcgctagaagaatgggaaggcattaccagtgacgacctatcttaagtggttgggtagattgatgacagatgttgtttgttggacaccatacactattcaccatgggttcaaagaatttgagattatttctctattttctggacatatcagatgggattcgtacattgttagacaccaaccagagagggtgttaagacaatttggattttttcagtcaattccccaacttcaaagctctcaattcccatccacataagaggttgatgatagattgctccacttttcacaataccttgcaacgactgaggactttgttatttttcctagtcagggtgttgtcgggtatatggagtggttttatcaaatatttcactcattcatgagtctactacaacttgtggagcctcttagacattctcatatggtacatcatcctttaccagatccaccacatgtgtttcctgatgatacaacacctatgccacctccatctatagtagtgcctgttgatgctgagatgcctcgacttgcagtggtataatatacttatatttctattacataatttttaataaaatattccaaatttattaaaattttgttgtcattgtcttaggttgtatgctaaaagatgtaacaccccaaaatttagggaattgcaattattaagaataaaatgttaatgaaaagcggtagaaaattaggacaaaatgacaagaacgcccctgaacaaattcagaaatgacgattatgtcctaggatgaaaaatgacagttataccccggacattttggaaaaggaccaatatatcctagatattttgataaagatatttttgggagaaaattacaaaaaggcccttgaacaaattggataattaccattattgtaacaccccaaaatttcagtcaatgctagggtaaaatactaatgggaggtagtacagaagaatttaggaaatgccctgaacatttttggaaatgacgattttacccctagagtgagaggtaaaattaccaaaatacccctgggtcaaaactgatcaaaatgattttagaaaattatggaaacctgagaatgggatagaatatttttagacagcacattattaacatgattgggattagaaaatcctaaacaataatttttaggaattttgtaagatattctgaaaagagctcaatctagacaccttcagacatcagaaaatttcagaaagataagagatataatccttggagttttcttgtaattatgggctaaatagactattttattaagatagtttagtaattttattaattagaaattgaccaatataagaacaagattgttatgtgatgaaaccaaaggaaaataattagaagacttgatttaaaagctagagtgccacggtcaatgaagaggaaaaaatctgcacaagccttgaatgcttgaatagcacgtaggataactaagaaacaaggaaacttatgtagcaagcttagggagattttgttagacaaagagaatcttcaattaatgcaatgcaaggaagcaaaattcaatttgacttcctcctcctccaagcatgcaaccgtgcagatttttttggggtcaagaagtcaaggttttaaccaattaaattaaagtaattaggaatcaaaagaaattactaggtcgcatctaaatggttggcacggttaagaagtgggaagaaagaaaaaatcaccaagagcacatgaaagcaagaggtcaagcttctaaccaatgaaatttaagcaagcaagggattatgctagataagaaaaaaaaatctgctgaaccttatctcatgttactccatccgtgcaaaattattgaagcaagaaagaataagtgggccaagggagctaagttctccaccaataggaatcaagccaactatgttataaaaggaatgaaagagaaaaatttgggtcagcacaaggagaaaccgtgcagctactacctcacttccctttgttatgcttttaaattaaaacaccaaaggaagccaagaaagaaaaactgaacgtgcagcccttgtctccctcacttgccttttggttttcaatcttattgactcttaaatattaagccttaaccactccctgctatccttttcataatccaaatcacaacaaaaaataaaacattccaaggagcttaaagagtccacgtgaaggtaggaaaagggagcaagcttcttcaagtttaaggaaacatttgaggtaagggggagttttgttagataaaatttaaatattagcttatctctaaatagattttaagatctttcattacttgaattatgatggagttaagagaaaattttaattagatgaaggaaggaagccacaattaaatacttagtttctatggttaaaataacatggttttaggtagatgatttggacaattgaatctttactatgttagaattaaaactaagttcaaagaaccctaggatagcatgccatggtagaaattttaatgaactaaaattggttacataatggctgttgtagtttaaaggtattgctgtatgtataataagatttttggaattagttgttgtatgtaataaaattaattgatgtagcatttattagttagttgctgtatgaaataaatttaatttttgtagcacaaaatagttagttgttgtacgtaataaatttagttgctgtaacacatttaagttaacgtattttagttgctgtaatgtatgtaaatacttgagtacttcggtatgtaagtatgaaattaatttgtatgctgttgtaggttggggtatttaattagtatgctgttgttaaatcacaactgtatgtggtaattgatgaatctgtatgttttaattaagctgtaaattagtaatttcatatgctgttgttgctgttgttgattgctgtaaattaataattttgtatgctgttgttgctagttgctgtaaaataatcattctgtgtgcgtgctgttgctgtatttaaattgttgcatgctgttgctgtatttaaaacattggttgttgttgctgtatttaaattgttgcttgctgttgctgtattcaaatggttatggtgacaggagtacgtaggtataataatttctaagtacgtaaccaagatttaaggaaagaagtattaattagtgtgatatacttgtgtgatcctggatataggattgaagaaactaaagttcacaacttgatgaaaagagtacaaataatgatgttgtggtaaacaatggagatataatttgatgataaaactgtaaacttgtgatgttgagatgagattgtgatgttgaattgtgatgttgagatgtgatttaaggggtgatcatgtgataatgaggatttgagaatcatgtgatgatgatgatttaaggaaaagagatgaaaagagtatccatacatgattcaagatgatgaaataaaaagtatcatgtgatgatgtgaatttgaaatgaaaatgatgaggaataaaagaagatttaaaaagatgaaaatgaatcattcatacattttcatgtgcatgagatgatcctcgcaagaggtgtaaaaaggtgatcctcgaaagaggtgtaaaaaggtgatcctcgaaagaggtgtttttgtcagataactaaactgagctccatacgtgttttaacttgggggtagttgagacagtggggaaatcacttaaccatgatgatcacatggatgagagtgatgctcctgcgcgacactgggctaccctgacgggatggataagttcgttccactaaggtgagggtggggttatctgacagtggccacaatttttagatgttgctgagatctcagtcatgcatcatataataagatgagcatgcattttctttcatttcataacgagagggtgagaagagaagagatgatacattggaggaaataataatgcttagtaatcatattaaataaatcctctgtattaactttttacgtatatttatatctgttaatatttaaattttgtttatcaagactgaccccattttgtgtcgtgtagttgacacctgtgatgaccccaaattatttgggcgagcagaaaacagtaatatggatgacgtacaagaagagtgaagatcgggtgctatttgtctgctttttgaatgatctgtatttgggatgtaacatggactgtttatatatggaactctggctatgtaataaatgatgaacagtacggtatgtatgaacgttacgactagctaatctaaataacgcgtaaggcacttaaattttctaaacttgttttaaaaaaaaaaaatccacggaatttccatttgaaccttcatttttaattcgttttgaaaattaaccaaggttcatttgaactttcattttttctgttttttgaaaaatttttagcaaataaaaataaatgcgtaataaaaagcgaaatagaagcggttgttacaattataccctaaggtgataaatgaccaaaatgcccttgaagtcaaaactgaccagataaccttagaaatttgtaagaacctcactattggataaaatacttttagataatcatgaatcagtcaggttgggggcgaaaaaccccaagatagaatttctacaaattttggaaattagattaaaaagagcttaattcagactaccctaggtatcagaaaattatgagaagggtatgagtataatctatggaattttctcttaattgtgggaggaaaaggattcttaactaggttagtttagtaattttaataattaaagataatatggaccaataagaattagaagttagctattatgggaaaattggattaatatgaatttctaaactaagccttgaccgtatgatacaagatcaatggaaaaaaaactttaagaaacttcaagaacgcacacatggatagttaagaggcttggaaacatgccattggtccacttgtatggtaaaaatttaatttaagtagatttttatcttgtttccttaggaagaacacgtgggaagctctaaacattgtttcaaagatcccaacggtcaaaagctagatatgttagttaggagtataccattaaaatttaagaagatccaacggttaatgaatccagaaccactattttgctaatacgggttttaagaaaagttaagaataaggaaaagcacaaagtatctttaaaacactagctatgccacaaagttgatggaaattactctccaagctgagcatactcacgtacaaagctaaatagcaagagagaagtgtaattaggacacatggaaggaagggaaacattagccaataaggagaaatcacatgtaaagcaagtaataatcacttaggaagatattttggcacttcaaaatgtaggaaccgaaaatgaactcagccataggggaagtatacgtgcacttaagaaaaggcaaaggaggtgtagaataatgtagaaacaagccacttgtacaaaggaaaatggctagccaatgggagatggaacacatggaaagctagtaggatattttgaataaaaatcaaagaccaacaagccaataaaaaggagcaaaaccgtaagcatgggctggttggagaatatacgtgaaaattactagccttatatcactttgcctttgtccaagcatttttaagaatatcttcaaagcaaaacaagtgcaaaccgtgcaaaacattagcctaaagcctttcatttcattctttcctacttcatcttttaccaaaacacaaaacctagcccttgaaatccacgtgaagactagtcattctaggagtaaggaatcattcaaattcaagaaagaaaaagctgtccaaagcttaaagaaagcaaggaagcaagggttgtccaaattagaaggcaaagcaaggtatgggaagtactttaataaacatgaattaggtagttgattaggataatttaacttctaatcttctaggattaaagctatgtttaaagtaagcatgccatgtgtttgataaaaatcctaaatgaagtaaaatgattaattctattttgtagcctttgtaaattaattatttgatgaatccttgatttaacgtagctgtatgtttttatttcttagtttggtagttgctgtatattttatttcttggctgtattataaatttaaacgattactgtatgttaatttatttgtatttggatactgctgtacttaaatattgttgtaggctaatttccttagttgttgtaaattaactcaataaagctgtatgttgttgtcgtatttaattaaattgatgctgtatgcatgttgttgctgtatttaattgaattgttgtatattatttgttaatgtaagctgtatgatatgcggtatgtggctgtaattaagaattgatgttgctggatgctatattaactaaataatgcggtatgccattttattatgttgctgtaattaatgattactgtatgacactatgattctgtatataagggtgttgtatgtcattagtatgttgctgtaagttgctgcacatataattatgttgctatatttaaggtgctgtatgttgtcttgttatgttgagtgtttccataaagcacaccaagtgtttgataaaagatttcaaagaaataaaataagtatgtgatccttcaaggcatgttgcttggtgatgttatgcttttgatgttgagaaatttataaaggtgggaatccttgtattattaaagatgttgtgattatttatggattccaaatgttgtgataaatcatggctgtatattgagactaatgtgtaaaagttttatgtgataagccatgagttgtaatgatgtttaaaaattggataaaataaatcattcatgcattctcatatgcatacacctggcgggggttaatccgtggagttgtgtgtcagatagttagaggaactgagtatgagcgttcagacagtgaagagtctgagctgggggatgcttcggcagtggggaactcatgccacccatgatgatcacatgtagtgtgggtgactttcctgtgcaccactgtgacatcctgactgatcatgcaagttctggaccagtgattggggctatctgactgtggccactgatgtcgatttttatgagaagctgagatctcagtcatgcatcatttaaataagaaaccatgcatcattcatcatatattggttctataaatgttattttatgataccacatatatccgctgtttaatttaaatctgttatgtatttgatatgttattctgtttcctatcgattatctaattatgtttattaaaatacttacccgagttgtgtctgtggtttgacacctgtgatgaccccaatttatttgggcgagcagaggaacagtgaacgctgagatatgaagaagcttggatgacttgcttgctgtgttttgacttgatgagtggatgatctggtttgatgttgccatttttgtgaattatggaagtcgtactgtactgtatttgtattttattttggatgactgtacacggactgctatatttagttatgcttctcattataaataaatcgtggtgaggataatcgtttatgttacttacaaattataaaattagcaagcaaagcgaaacgaatttttgtgaaaatttttttatactaatctaatttaatacaaagtggacacgtaattttatctaaaatcaaccgagcacgagagagtaacgagaggcattacaaaagatagtagaaagcttgcagcacatgatagatatgaggatggttactgtaacgcctctctttactctctcgtgcttgattgattttaggtgaaatctcgtggccattttgtattagaatcatgttatttataaattttacataaaatttttcgctttgcttgcaagttcttggttcgttcgtaacgtagacgcttatcccccgctacggttcaattatgataaatagatacagttcataatacagtccaaatatacgtccaaaaatatacagactgtctagttttaatacaaattacaaagaaacaaaatacaccaaatacaaaattacaattcatcaatcttccttatcacatctgcttcaatatcatccatagcttatgcttcactgttcccctgctcgcccaaatgagttggggtcatcacaggtgtcaaccacagacacaaataggggtaagtatatgataaacatagtttgaataagacatatataacacagatggataaaaccttaataaaaagatctcaacagatacaatatacagaacatcatacacatacccattatgtgatgcatgagatgcatgctcatctttttatatgatgcatgactgagatctcagagtcttatcaaaaggtaccaaaatcaacatagtttcacccactctagtgacacagtcccacccactccagtgaaacctccctccactccgaggggataaaaagtgtaccataaaatagttccacccactccagtggaacagtcccacccactccagtaaaacctccctccactccgaggggataaatgcaaatggaatatgtaatggcttgtttttttattttttgtttttctccatttattttatttctcaaattctcatatcagataattccacccactccagtggaacacatctcaaagctcagcatacagccatagttcaatatcatcaacatagtacacatctttatttatcatcatcaaactcataaaatcacttaaaattcatatagattcataaagcaccaatcaacatattattcttaccaagatctatagaatcactcaacaacccataagctttgtaaaatcatatacaaccacacagattccaccacatcacacacttttatttctttgaagtattttatcaaacacttggtgtgcgtttatggaaacactcaacaacacatgaaatatcacatcacttttgctaaagcattaaaccatgcaaatataatttaaattcaacaacaataattcagaccaaccacttactagacatattttattcattggaacaaattatcaaacatatggtgtgcaacttaaattcatagaattcctttaaagaaagccacttaaccttaatctttataaagcttcacatacttctaagaataaataaacatgtttccaacataatcaagttcaaagatttagaaaaatacttgtaactttaattccaatcttcaatcaccttctttaataatagtcataatatacataaacctaagtcacttaacatcacttattaagtttagattcaagttattcattcaaaatatcattcaataactaagatcaaatcacttattctaatagtctttttatttagcaatctttaactctttgaggcatttcatcaaacacctagaatacaagacttaatcaaataaagcaaggagtaatattcaaactaagctatcataaactcccccataccttgtttccttaagcttttggacaaccatccttctttgaaattgaatgatccttgctcctaaggttgctagttctacacgtgagatttcaaggtataagcctttgtttggtattctatgtaaatggtggattagaaatgtaacacctcgtaggcctccgacgtgctatcattaataatatcagattagcttataaaaaaaaaaaatcaatttaatcaattcagcggaaacctaggatcgttttcttgatacattaagtatggaaacacataacagaaccataaaatcaagcccctgctgatccagtttatcaatcaaacataatacagacagataacaagttttataggcagagtaaccaaatacatcatatatactcagggaaagttatatatacatatcatacaagttctgtacagacatatgcatcaaagtccacaccacacatgtcgtggtgcttccaaaagaatatcagccctccctgagggtatacagaaccatacaccaaaataaaacaaaaacagagccttcaagctcttcatgccgcttctccctcaagcagcctagtctcaattgggcctcctgccctgagacagatcttctcgaccagacgtgtcacctgaaatcatgcaagcccacatggggtgagataacatatctcagtaagctcagggttcccgggaattcattccccaaaacactgaacttacctggaacaatatcactctgtggtctagtcccagctctgtggctcccgccaccagtaaactcgggatcacggcctaatcaaggcacatgtaatttcatatcaatctcaagaccacagacaggaaattcacaatatatatatcatacagaaatcctttatcctagggttcaagccaactcagcctacactaggctgttctaagaccactcaaaggccatcaggatggaatacaatccatctgagtcattctagactcgctacacatatatataatcgaagctttactcagcctcacaatacaattgttatcagataggggctgagatcctctcaaagccctactctactagcctcccagctcggaacatcacaatcaaggctctagcctatcagagaaccatcagcaagtgactctacataagtcacacaggcatatacagagccaagattcaatgttatcagaatcaaaaactgaaagctaatccttcatctattctaagccctgaacaactttctcaactgggcccggagctaattctagccccagctcatatgggtcactattcacagggacccccaaaaatcaaaatcaaacggtgaaatctaagtttcttacctcagtggcgcacccaacagcctcagaacagcttctcctagcttccacgttccaattacgctgtggttttacgccaagctcgagttctctgagcttttccctctgaggttcctcttctcactcaatctggggttttcaaggaaattgatgaaggattcaagctttctactcggttcaatcaagtttctaaggctcaggaaagtgcttaggctgagaaatcaagtcctaggaagcttaaggacttcaacaatggaggttggggctaagggaggaagaagaaatgctatttacctccatttctcacgttttgggccttaaatcctgatctgccgacgtacccacgcgtttcacttgggttcccacgcgtttcacttggtatggcagacagaaataccatttctaagccacttcccacgcgactcgcgtcatgacaccacgcgactcgcgccacttattcgggccttccacgcgacacgcgtggatcccacgtgactcgcgtggagccccagagaaaaacatgttttctgggtcacttgccacgcgactcgcgtggatcttcaagtgactcgcgtgacatggcagagccatctgccctatattacacatatggcgcgtgtcgcgccacaccccaagtgggtcgcgccatatgccagaacaaccataaacttgcattcatgcttaaactaagcttacgaattcaaactattacatttggcgtcatcagcgccgatcctggtgccaccggcgccgcacccttagcagggttttctgacctgaatccccgcgctatcgcgcggggttaagcgccgaaaataaaggtccttacaagaaaggaataaagtagaagtattttggggctggatgttgcacgtactcttttccctcaccagcctatagtttcggttttgcttccttttatagacttgttggctttgatttttgttacaaaatatcctactagctttctacttggttctttcctattggctagcctttcctttgcctccaagtaccttattctacattcttctccttttctttctcaattgcatgtatcccttccccctttggctgagcttatttcggttcttgctccttggttagtgcaaatatcttactaaattatcattgttaacttttcttatgtttccaccttattggctaacatttctccaccttccaagtgtcccaatttcttgaaacttcgcaataattcccctcctttcttggtttgcacgtggtctagcttgcttaaggtgcatttcctttggtttagggacatttgggtttttcttcattctttattcttaagtttttcttctaaaacccgttttattaaaatactcactctggatttgttaaccgttggatctctttaaaattttaagggtatacttctatcccatatatctaacttttgaccgttgagattttcgaaataatgtctctagatatccacgtattttgccaaaggagacaatataaaatttgcttcaaatatcttttaagcattaattactttctttacatatggaccaatggaaatggctaggcttcttaactctccatgtgtgcattcttgaatgttcctaaggcttttctcccttgattgtgtatcacacggccaaggcttgatcttagataaccaaatcaacaattttccttttattacatgtaataacaaaattctaagttcttattagtccaatttgcttttatttagtaaaattactaaactaactcactaaggatcctattcctcccataattaatagaaaactccatagattatgtctatcctttttcttatatttttctgatacctgaggttgtctagattaagctcttttcaacctatcttccaaaatctgtaaaaattctattttagggttttctgcctcccaccttgctgatacttggttatctaaaagtattttatcctatagtcaggttcccacaaatttatgaagtcatttttgtcatttttgacctaaggatattttggtaattttactactcactctaggggccaaatcgtcattttaaaaaatattcaggatctctctgtaattgtcactctaagggtatctttagtcattccaaaacatctaaggatatttataacattttttccttaaaatgtctttactggacttcctagggcaatttggtcattaataaaatatccaggggtattttggtcatttattgcctcagggacctatctgtcatttctgaaattgtcaaggacatttatgtcattttcaaaggacatgtgtgtcttttttaaaacgttcaagggtattttcgtcatttctcccaaatcttttgtactgcctttaattgactgtgattcccaatttttggggtgttacagttactgctagtacaaatgcatataatataaaagaccagtgtgtaagattagccaggggtgtcactgagcactaaaatgtttatgccggtcaagacgaaggagggatgcacaggggagacatggtggtggacaaggttgaggatgattttattatttcgatgactatatacttatgtatcccaactatttatatatgactattataattgtatgcgtttaatttagatggcacaatgactaatgtatgcgtttaatttagatatgaccaaggttatcaaacttgcgattttacgtaaactcgtggaggtctcttaaacttgattcatagaatcgactcatcaactcataaaagtttactcaatataaaaaatatatagtattcatatatataaaatcataactaaatatttcaaccctaaaataaatcaaaatagcaaactttaacaataattcaataaactaacatagtccacacccaatcaaacataaattcatacaatacaaaacataatatcttaaaataaaagcatttaaaaaacatagaaataattcaaatgtccatcaatcctctaattaaatcatttccaatatcaccactaccaccatcatcttcatctccatcatcttcaagctcttccttggttaaaaaggaatcttcaacattgtcattcaaaaccaaattgtcaatatcagatacatccaaagttggatcacttaaacttcctccaaccaagtcaatattgcttccattaccactttcacctataggctgctcaacttggacattgtcttcatcaaaaatatcatctcattcttttgttatccactcatcatcaaatttcatatcttcaaatggatgagcaacaatttttcttatttgtctatttttcaacttcaagttgtacatcacataaactaagtcattcatcttcttttgatgcatgtagtttctcctctttgtatgaacctataaataacagaagaaattgaagttcataacttaataaagtctagagtctaaactaaacaaaacaaatattaaaaaacacaaaatcgtaaaatcatacgattctaccgagtttggtccgattctaccgagtttactctgagtctaatagaaaatgatttcgggtgcgattcaactcgttggaggtgtgcagactcataaaatcatacaatcttacaatttaaaacttgagtttgacaaccatggatatgacgattgtaattcttttcacaaaaattgtcttcattacgcatgtctaagtaataattcaattcacaaaaattgtcaccattacgcatatgcaacttacaaacatataaacaataacaaaatgttcaatcttctcctagatcaacatgttgtatgcgcaacctcatgaaattagtatattggtgcattcaactaatataaggagtaggccactattttgcttgataatgacaatgtcttgaccataacaaagcagttgacggcataagacatccatctctcagaaaaacctgctacaatgaccagtacgcattcaaatatttattacacgtgttttaatcatggaattaaagtaagaagatcattattatacctgaataaaatgattgttatagacatgaccaacacatagaatgcgatgaacaacactatctctaggtggttggcttctaggagggaaaaacgtcatgttttgttggagagaaagagaaacaaggatgacgttataccttgatgcaatgacataacccatatcgataatattcatccacttatccatcgttacctacacataacaaattgtattagtattataaataaaatatttatccaaggtagtgtgacaacaaaaagttcaccattgataatccatcaacaagtaggcatcgctttaaatgctcaaatctatgtatgccaccaaacaaggctatatactcatcaaaccattgtccaagttctttgagcaaatggttgtgtaccaaagaccatgaatcttcatcataacctaataaggcagcaattacacgatatccacaattaccatcaactttggtcatcaatgaaatcctacatgcatggatgaaattgatccagctttggcatcttccttttcgattttgtttttccaaataatgatgcagacaatttttatgcgaagcaactattttgcacggaatgtaatgcatcacatactcaaagtaagacggatcacgcttcattgatctttgatgtttgttcaattgtttcttttgagcaccttttgttttgaccttttcaggaggagcacacatggaagttaaatcaaggtatgcaagttcccgcaatttactctttacagtcactttgccacacatatcaagatcttcaaaccgcttggaaatggcttccatctcttcgtttatgtggactttgcactcatctataccttggtctgaaaaacttagtctctgccaaaacatatggaatgtgtcaagcagtatgctaccaacaacatatctagctagttcacatgcacacgacagactatgagtagttctcataacgcatccacaactagaactgtcaatgccagcataattgactcacttaaactcaacaaaatttggtttaacgcataccttgacattatgtcaattagtctcttgtacaaggtcactttaaaaacatgttcgaccacatgtgtgcttctctcaaaagatgtctttatttcactgtgttgtaaggtgatcatgttgtacatggaatctcaaacactacatagatcttcaaggctattctattgtagcctctttaaggtccaatgagcattctcaaccctgcacttaaaagggcaaataagtattttcaacaattaatatgttcttcaaaataaaaaaagattaacaattttcatatctgttacaaatatttgtctatggggaatcaaccatgtctatttcacatagtcaacaaacattggcaatggtgagcaaacaatttcaaacttcataagatagacatcatattcttcctcggtaggacagtccacaagactcccccatgcttccatcacatagtctaatgcatttttttgtcccacaagggttttacatttttcctgcacattcttatcaatgtgaaaccaacacaataagttggttgatttagggaacacaattttcaatgcattcatcaatgttgaatccatgtctgtaacaatgacttcagggagtgcataacttttcaaaaaaatacctctaaatcgttaaagagctcacacaacatttttatgcgttcaccctccaaataggcaaatgtaactaaaaatgtcatcccagtaggtgtcacaccaacaatgtcaagcaaagggagtatgtatctgtttgttttatatgtactatttataaggaataccatattacatgagttgcttaattttactacatccagatgtgtccaaaatatatcaagtccaacatcttccttcatccttcagtctatgccaataaatatacatattgcgttcaagtagcttcattagttgttgcatttaagtattactgtatcttatagaaaaatagtatgcatgtcttgcattgtacatttgcttcattattatacaattgttggcattgtgatccttcaaggtgagaagaatattctttagcttcatcatcaactttgtcatatcagcaacaataatattctcatccttagttagtctaccagaatatggatctccagtcaatgacttagccaaagcatgattatgagtctcacatattaacttcaccatccacccttcacctttcagttgatgtgttaaacctcattatcacagctacaaaaccaacatcatactcaatagtacgagctcattgtaatatgtcttcatgataaagaaacacttataaaaaggataatacatgtttaatcttcttaaataattcatttacttactttaacaaatatataatcatatcaatacctcagaagtattgaaggcattagaataatcaattgaacaattactattttcaaacgcagcaggttcttccctgttgtcttcattcatattaatttcttctaacataatattctcatacatccactcatcgttgtctatcttcagaaatcattaaaaaattattcaatgacaaatcatacggataataataatatttacaaaattaacaatttttttaaacctaaagacatttaatacaaaattggcatctatatcttcatacggatgagtgtaaaaaaactaaaacttatcttaacacggtgacgacgacgacaacaaagccaaatcaactaccaaatcacgactagtcaagggagaaagaggttcgccaacaacaacaaatggaggaggtgaccaaggatgaagaagaagcaaaaatgagatgaaaaagaaagtgagaaaagaagaagaagaaacaaaaatattggaattaaaaataaataaatggtgtatgagaaatatgaatggtgtagaaagaaaatgtaaatacttgctccaaagtaaacccactcctccttcaaaattttggtcccttttcacactttctctctctcactcggatcacacacaaacaaacactcccattctctctctctccgacctagcgagaccgagcgatccgaccctaatctagcgatgctccgccgcgcaaccacctccctcctctccgtcacgtctcgccgcagcctctccaccgacgtgccggcgaccccccggcggattcagccttcgcggaggcgtggaagaaagtgagccccaacatcgacccgccgaagacgccgctggcgtacatgaagccccgaccacccactccctcggctctcccttccaagctcacagtcaacttcgtcttgccctactcttctcaattggccgcaaaagaggtcactttttttttttccttttaaaaaaaattctatattttttttttaaatctgtggaagcttttgttttggattttttttttgtgggtttttttgtttctgcatttcaagcgtgctgatctggttgatctggggtttgactcgtttgaggtgaacgaggttggtcttagggttatttgatggaaatgaatatattatatacgctgttgttttttggtttatttatcttttgtttagatcctcgtaattttgaaaatgcgttgatttcccgattgttgagtttctatgtgtgtgtgtgtgtgtgtgtgtggttgtgtgtgtgtgtgtttgtgtctgtatctgtgacaatgttttgaattgaggttgttgtggtctttgatatggtgagaaattgcggcaaatgcatctgaaatgttgattttgccgctgaaatcctactgcggacctttcttaaaccttggtctgtgatgttataaaaatgagggtgttgatgtttttatcatttgaaggggcaattggaaaataatgcagaccattgatgaatggtttacttttgtgattgaaattttaaaaaaaaaaggtgaatttaggattctgttcagtgtttatcagcttgcttgtgagagtgctgcttatttgggatcctatgcttcatttttggttttggtctgttctttgggcacattttcttgctgtttgttatactttgttcagatttcattcacttgtttcgattgattgtgaattgtaattgatctcttttttaatccatttctagtgttttcagggctttatactaagcgaataaaagtaggtatttgattttattttttatgatttttataagcacaataagtggttttggttttttccataatgttgttatgtatgccgtcattgtttgtgtggatcccatttcccttgctgtataatctagaattgaatgtgtgcaaaattcttatgcgggaacagtgttgtttcccgattttaggaattcgtggatcaaataatgctgtagaataatgtgttttccttggaacattcccttgtttatttaataaggagttgctaccaacctagacaacgagatctagcttttttctcatcaccctgtttgatttcaaatgcttttcctttcttcagttatccaaacaaatttataaataaagaagaatgttgcctcagttctaaacaaaatataatcaagcttaacattttctaattaattataagcatacagatgcaaaatttgaatgggtaaccctgtgaattttcacatataatgtgttgatttcaagatctttatatcagtaaatgaatgctgagactatatattattattgcttcttggccttagcagcatctcttcttaggactgaatcttgaaattctatcaagcattgaacatttttttatataaaaccgacatcttgattcaattatgctactcctagctttaatttttcgtttttgaatgtgttttgttttggatacccataaaacttgaaactttgataatgtgctctacaacctgtttcataatatatttccaaaccatctccattttatagcaagaggcctattttaatatttctttttagtgtttttagcattgtttttacctcaaaagaaaaagcatcaaaaagaattttatcaattttttatctcacaaaaaccttcctttttgaatattgcaaagacatgatgcactgtccattttgttgctcttagagtaaattttgtagagtgacagtatcataaaaatattatgccataataacattcgggagcatcattttattgaaggagttgtttgatgatgctgtttcatggcaccatagttttcaagtttgtccttgcaacacaaatttgtattgactgtttgatgcttattcctacaagtttgtccttgcattttttaatacgtgcaaatgtgatcaatagaagcagtcttattccaaaccactctattatttctcgaaaaagatttttgttatcttttgagtgagatgttttgtgatttggatatcaaacagatgcttttaagcgtgtcaactgtgcaagtgaattttgaggtgtctgattaaattgggtgtgactcgtctaattaaattaatggaagcctgccgctttaagacttaagacagccagccatgctgttgaattgagtggttcacattgctgtatgagatagtgttagtagtttgtaatatatgtgatatttaggtgacaacaaaagtgtgcttgcagtggcaatgatagtccaggaagaaaaaaggatcaaataaacagtgaaatcagaattattggtaactgtaattttgcactccaccatgtgcatgtgatttgttggtatctgattataagtgaattaatatgcaagtctcaatttcttatccttgtaactgtcatcataaagcagcaaatttattttgtggagcagaaagctttatatgcacataaaaattattttagtattaaatcatgtgcacatcgattggactgaatatttttatactatagtgccaccatattagaaaagaatgttgatatctatcagaagtggaaacttcaaatttgttgcattgtagttatctccattattgacacatttggttatctggtttatttgcttgtgctgcaacatctccaccctcactgatttcatcctattgaagttatggatattagtaagaaaaactcccttcatctatcttccttgtaaaatgacataatttttgtgcaacaggttgatatggtcattgtaccagcaacaactggacagatgggtgttctcccaggacatgtagcaacaattgcagagttgaaacctggtgtcctatctgtacatgaagggaacgatgtgactaagtactttgtcagcagtggctttgcattcatccatgcaaactctgttgctgatataatagctgttgaggccgtgccagtagaccgaattgatgcgaatctagtccagaagggtcttcaagatttcacccagaagctgaactcagccacaactgatttggagaaagctgaagctcagattggggttgatgtccatagcgctctcaactctgctcttacaggctaaaataagtactgtaatgttgagtctttccttttgtatttgtttatttccctccactgtgtggcattgatttgtctcggtgtaatcaaagttgctaaaagaacattttcaccatgaatttctgtgttgaaagtgacttgataaaataatatttcaacagcttccatctagctcaaggatgttgggcaagaccttgaaattagaaacaaaagtttcatttttgttttggattatattgtatggcaaatactggttaacaaaaaagaccatagcttttattctattcttcaaattcaagagcacgtacgagaatatgctaatctatgaaaggctagtataacattaaatatgtggagaaatattatttagaagagtatagaactagaatcaattattgtattgatttactatttttatttatttaaatcataatttcttagttattttttcatagactactcttataacgttgaaggttttctaaaaatctatggaatccttccaaatattctaaatctataaggtctttttatattttttaaattctaaattataaaatccattacattcctacaatccattagattgtaaattataaaagtctttaaataaaatcttatcttagtcattacattccaaaatatataacttttttttaatatgaaaatagtcttttaaaatctataactttttaatatgaaaatagtcttttaaaatctcaatttaatacaatcttcttagttagggattgattagttgtgctcttactctgttccatccctaaactatcaccaaggcagcaatcacatagcaaggtagtgtgcttaaccttttactcacatagtaacatctttgagacacccttccaatctcatcttagcatctcagtttcttatttgttttctacatttcccactctaaactgttgaatttttcaaatgtgttctatgcatgttttatttatttaattttttctgcacttaattgtctgccggttttgttatgaacagaaagttacattatatagtagctcttacacaggaaaggctttttacaatcttttattcattaagaaattttaattgaataaaaaacctggcttatagagtcagttacccaacaacaataactaatatatagactattatcactattctcaacataattacccaaaaaatatgtaataatctcattgctaattcatcacttgatttaaattaaagggacaaggtgatggagaaatagataagattttaaacattaaagatgtttaaattaagaatacttgcagcaaaaaatattgtgcttgcccagaattcatctctatgtttgtactcatctaaagtcaccaataattacggggattagcaattactttgtgcttctttttctctattgatgaattagtgatagctcacttgtaatgattttatagtgtgttctactttttaaatagggatgtcaaaatgggcttggtccgacaggtcagtccatttagctcactaaaaaaagtgggttggattgacactatcaacctacttatttaaacggggtcggcccaactcgacccactaaaataccgggccaaggtcgggtcagcccaccaagccagttattatttttttttttaaaaagtttgaattgaatgaggagtgagagtgaatgacagatcgtaccaaatctatctcaccctaccacaagcacaatcccacttaactttcctcaaggttcatgactctccatcagtcccactctcctcttcgtccacagttcactctcatcttcgtctactctcctctccgactccctcacttcatcatgaactctcctctctggctccctcacctgatggtcacggcctccttcctaacggccaacatcaaggtgacgacgcaggaggttgacggcttcgttaagttcagccacgaggacatgcccacgtacttgttctattgtttgaccccgatatttacacggatagacagatctccgcttagggaaatgacgaagttatgtttctgcctcaggcggaagaagctaggcccgttacttgagcctagcttgctaaggtcgtcgtgaagcaaagaagaactgaagaggtgcgtttttttcttctttctttcacttttgcctttttttttgttggtggtgtttgtttggatgttttttaagtcaagatgaggatgacgtgtgtttaatttggttggctaaatttatttgtttgttttttctttttgtttactttttttaattgtggctagactggttctagtttttggttaagtttgtcaattgttgaggtttcatttttgtttctgtactagtattgatttggacaagggagtgcatattattatgtgaggtagtttcttgaatatggtaatgtttgaattttaggtgggactatgggagagtgtaagagaatttttttaattttttgtttatttttaggtggactggcccgttgacccaccaacccaccttaaagtaggacgagctagcattgttagtccacttttgcagtgggtcatcccggcccgacccatttttttggtgggctagagccagtccaacccatttttggtgggctggcccactttgccatccatattctcaaatacatgtatggtttgttatcatgtatgtttagagttgtcaatataaatgcagtaaaaaaaaaaaagttctcaatgagtcaaaaccatggtacattccattgggtcatgtaacccactattttcaaagccccttgattaatgagcatctattagcataacaaaaaataaaaatgtgggtcaaggttgtatgtgttaacccacaatctttaaatcattaaaaaaaacccacaattttttttcatacaaatattttccctcacaactttgtcttttaggaagtatcatgagagttttattctacatgcgactaaaatattgtttttgtcttttatatttttagctatttttgttctactcacacattatgctcaatcaactgagttagactcttttagtatattgtaagtttaataataacaaataaaatccattagcaactaatatttaagttcaaaaataacaaataaaatcaattagcaaagaataaaagaaattatgattttcattgaatagtcaaaactgaaaacagtatgaacaacacacaataaccaagagggggggtgaattggttaaccttggtcttttaaaaatctttaaacaatcagagtaatcaagatcgtatcacaaataaaccaagaatgttccaaccaatcaaaacaccacaactgaagaatgtaatctcaaaactttcatttgttgaataagaaatgtagcaccaaagaataatcaattataacagcaagaaaagattagaaagaagtagttaacacagggaattatattggttcaatctcacccttgagaagttacatccagttcttccaaccacaaaggttagtgatggaggtccatggcaagctaaaggtctagaaggagagtttcaaacactttctttggtgagctttaaaggaccaatgacaagagttataactcaagcacttcaagaccacatcaaactaatttggacatgcatgaagaagcacaccaactcaaggataacaaggactggattttgatgtctcaagttcaatttaattccataaatttcagcacttgttagtaacaaaaatagttgcaataaaagacctttagggacatttttgtgaagcatttaggtgcacttgtgtgtaaattgtgtagcaactttgtaagcttgttggttgtaccttaaggattaaaatactacaccttacacgaattaggatcagccaagagtcatttccatttagcttgcattaggctccactagtgtgcactacaagcttcatttgaattgtcatttcatgtgcatttggttgtaatttttgtggcctatataagctggccaaaaactaattgtaactaactttgatgtcattaatgcaaatttgaaaatttgtgtgagagtttctctcaaatttttgtgcaagaacctcttgggtcttatcaatggctcttacatgctattgtggcgattcttcctagaattattggagctcttctccattgtgtcttccatcttcgtctctttccttcttccatattccattgctgcgctttgaagtttttattcaaccttgggctgcacatgaattgtggacaaattgtgttcctggagaaatcttgaagaatgtgtttcattgcaaggtagatttggaaaacttaatggctaatgggctcagtcatacatcatgtggtatcagaacctaatccttgtggaattcttcttcaagttcagtttttagaacttctttaaaggtaaaaattgcaccattcgaaaaatctataaatccacttctattcctagtttcttgttgttttcatgaaaaattatggtggtgttggctttgttgtgtattccgccacctacccttgagtttttcttcaagttttgtgtgaactcatgtcttcatgttcttcatttgttcttgatttttttctaattttctagtcttgattcttgtcaacttttgttagtactgttttttgtgttgtatgaccactggttttgattctaatctcatgcctaaactgaattgagttgttagaagcaaattttacaattgttatacatagttttttagtgattcattgaatttctttaagaattcttgaacttgtacaaaagaaaaacaaaagcttacaaaagtttttgtgaaagaaacaatcaaaggcaaaagaaaaacacattggtatagccaaagacattattgattggtggctggaaaaagtgaaataaaaatagaatttagaagcaaagcaaagttacaaaaactaaaagttcaaatttcctttgaaccacaaaattaagtgaacttgtacgacatgcaaatttggtgaaattttggcttctaacaattgaatttgattggtatatcctccttgtgcagtttggtacaaccaatatatccttgagttgtctcattaaattccaaattgagtttgtgcttttctaaaattttgcttttgttgcttgtctcttcaaaattccaaggttttgtcttagagttttcttgttcttggactcttgagtctagcctagaattgtttcctatttcactatagtaaagaagcttgattggattggaaggttttgcttaagaactatagagaggaacaagagcggaaaaaggcaagagagaacattaaagaaagagcctagataaagagtgcaaacatgagtatgagtggcaaacacttagagagtggtgagaattttcttatatacttgtgtttttgctaaccatttcttttgaaggatgagctcaataggagataaggcttcgtaacctaagacatctaggttgatgaaagccattacaaagcaaatggaagatttataaaccaagatggatgcaagatttgaggagttgcaaagaaggagtagtccaattggaagtgtggatgaagaggctcatggcaataggagggtgagtgagtatacttcctctcatggaggaaattatggagatgaggagaatgagagggaggattggagagaaaataataggagacacaatcctaggagacaaaatagaaatgagaaagattggaggttgaggagagaataaagagaagggaggaatggaagattgagtggagtgaaaataataattccaaagttccttggtgattatgatcccgaagtttactttgagtggaagatgaaagtagaacaaattttctcatgccaacaaattgatgaagaaaagaaagtgattctagcaactctataatttggtggctatgctttggtgtggtggagccaagttcaaatggacatagggaggttgaggagacaaagaataaatggctggaatgacttgaaggtgggcttgagagaaagatttgttctcacttattatgcaagagaagtccacaacaagctccaaagactattccaaggctacaagagtgttggtgacaactataaagagatgaaattgatgatgatgagggataaaactgtggagggtcaagaggcaaccatgactaggtttctttatgtcttgaatagagaaattcaatatgtaatgaagctacattcttatgcaacaataaaggagctagtccacaaagctcaaagagtggatcaacaactaaaaaggagaaaagcttccaagaccaatggggttgccacttccagctggaaattcaagcctaggagggagttttcttaagtgaaaaatgaagaagaaaaggtggaaagctgaaccaaaaaaattgtggaaccaactccaacaagatcaagcaatatcaagtgttttaagtgcttggtaagggtcgtattgcttcccagtgtcctaacaagagaacaatgattttgcttgaggatggagacataaagagtgagtcttcaagtgactcaactagttcttcaagtgaagaagaagaagaagaacatacactagtggaggcagaggagggtgatctcttgatggtaagaagaatgttgagcaatttttgcctaaaaaaagaggagaccaaaaggaaaaatatttttcacacaagatgcttggttgaagacaaagtatgctcacttataattgatggaggcagctgcaccaatgtgactagtacaaggcttgttgagaaattacacttgtcaaccataaaacatccaaagtcatacaagctccaatggcttagtgaaagtggagaagtagtggtaaattctcaagtgctcattcctttttctattaatgcttataatgatcaagttctttgtatattgtacctatggaggttggacatattcttcttggaaggccttggcaatatgatagaaaagtgatacacaatggcatggagaacacttttgagtttgagaacttaaacaagaaaattattttgaggcctttgactcctagacaagtgtgttaggatcaagtgaggatgaaagaaaagagaattcatgagctaacaaaaaatactgcacttgaaaaaaatactgcaaaaaaaagtaaagaaagtgacctaccaaagagaaaaactagtgagaagcaagataaacatcctattgcttattttagtgagaaattaaaggattcatgtttgaactattccacttatgataaataattgtatgcacttgttagagttttgcaacgtagaaacattatcttttatctaagaaatttgtgatccatagtgatcatgagtctcttaaatatttgaaaagtcatggcaaactcaacaagagaaatgctaagtggtacatcaaggcaaatttggggacttgggaggagtgtctacctcaaattgagtttgcttacaataaagtagttcacgagactacttccttatctctttttaaaattgtttatgactttaatcctttaactcctcttgatttattgtcattacctaacacttcttctatgattaatcatgatgctttgtctaaagcttcttacgttaggaaattgcatgaacaagtgaaggcacatgtggagaggaaaatggaacaatatgcaaagcaagccaataagcacaagaagcaagtgatctttaatgaaggagatttggtttggcttcatttgaggaaggatgggtttcctcatgaaaggaaatccaatcttcaacctaaaggagatggacctttcaagattttagaaaggatcaacaacaatgcttacaaacttgagttactgataagtgtcatattttagttaattccaggattataatgttggcacttatcttttgatttcattaaattttcttataaatttgccctaatcctatttgttttgtagttggtatatatataaatgttgttgttacattttggaagattcctccattcaatttaggtgtttcgataggtatcaagtgtatccgggacatccaaagcaagcaagacaaacaaaaagggcaaaaaggacatttctagaagctaaattcgcccaaactcgcctggactaataacctttcttcactattaagcattaactcgcccaggcgaacaaaacatgaagaaataactcgcctaggcgaatggagtccttcagcattaagttttaactagcccaggcgagtgaaacaaggctaaaaaactcgtctgggcatgtggatctgagcagcttccccatgcctataacaagccatccaaatgaagaagttttcatgaattttagaggggaaaacgtaggaacagccatggaggcttagagagaggtgagagaataaagaaaaggagtggaaactctgcagaaacgggctagggatcgccaccttcgtcatgtattttgttgatctcttgctttacaccatgatcggctagtttatccaaaggattggatgtaatcttcgtacccttatgtatctcttttgatattttgatatatgtataaatcttttctactcattctggtgatttcattttgttcttaatgtttgattctacttgatcactagtttcatgaaattagattctaagcttgacaggaaagtgcccttaggatttgaactgaatgattttactatttacattacgttgttaggaatataacataacgttttgattgcaaatagtacgagattatgattataatgctgggttatttacttcatatgcgagggatcgatattcagtaaatatctttaggattctcgaatgcgagggatcgatttggggtgaattaatgtgtgtatcagtaatgctaaaaaatgattcatataggttaatattaattggctactgagggtatgaatgatgaaactaaatcctacgttctcataaattaattaaattcattttactagtttccataatttttcgttatttttgtaaacccatcaaattctgattatacttgttgtacatataactattgaattgttaacttttatttgggaaaactgagtagctcaagttcctgtggagacaatcttttataaattttgtaacctgggaccattggtatgcttgccaaaagtctaacagttgcctagtgagtatgtatgagtaatactttcaatgtttgtgatctttctttgtatgatgtaggtataagtgaggaagcaaacttgaggtcaagttcctaatatatatgaaatttctaatatatatgaacctaatattttttattcaaacttatgatttttaattaaaccatgattttatctaacatgtttttttatctaataatgcatattttataacaatacatttaaaataaaaatcatggtttaattaaaaatcatagttttgaataaaaaatattaggttcatatatattagaaattttaattttatagaatcataggttcatatgctttagaaatttatatatgtaaaaaatatatattattagataaaattaattgttataaaaattattatgtaaatttatgtgtattaaatatgcattaaaatttgtaatgttatatatagcgacagtaattagcttttaacatgaatggcatagtagcttagttcgttagagcgttgtgcttgtacttggacggtcataggtttgacacttgtttgggacattatttcaaaaatcatttaattttttttaactcttatcattttttcttccagagataagctttcataattatgattgtataattctggaaacatatttctagaatacatatacataagtttccatatttacacaatcataattttgaaattttgttttcgaaatgttaatcttacctatataaccaaaagggaccactacatgatagttgtaacaagtttagacatggcaactatttcttggggattcaaggtgtatacttttaaatttattgttttctcaaaacccttgagcaaattatctccatcccatggaccacgtattatgtaataatctctaagattttgaggttacctttgtagtgcgctttcaaactaatgagagttgcttcacaaagtctcgaatgtgactatgcctttagttagtccaaggaagcaagacataagtggggctttggtgctaggcgacaatagtcgggttagggaccttttggcgtgataagtcttttgtcaaataatagtgtatcatgttaggccaagatatcatatatatatatatgtgtgtgtgtgtgtgtgtgtgtgtgtgtgtgtgtgtgtgtgtgtgtgtgttaggatgatgaccaaactcaaagcccttattaggcttgtattgtaatacccgaaaattttcttcttaatttatttttctacacatgtaaaattgcactattaaagactagacaatgaaaattttgcattgtgtaatttaattatatacctaggtaatttaatttattctcaatatgatattaattgtatgatttagtgttagttatattttttagtgtaaatagtttatttagttagttggcaaaattttggaaactacctgaataaaaatttcatctataggaaaattgcaccacgcattgagcggcaatgtaatttaactctgtgagattgttttctgtgtgaggttcaatttggagacacgtattccttgggagattagtgcaaaaacctatgcaattaagataatatttattagttttggtaaaaagcaaaatacccattattgacaaatcctatccctttcatttttttggtagttttgcaaaaagaaaaactacccattagtggaatggagtgacacattcaaaatggcagccaagggggtcattcaagtgtcagaaagccttgtcaatttaatcctacaccatagcttattggtctttgtgagaaaaaaatctattggagccttgatcccttcattttgtacaaattccatcttgagggagtagagttcaactgttcttctttttcttcttccaagcatgttcctagtgttcctgagcctttgagacatcaagcttagctaaatgagctctattcttcatcctatacttgattcctcgtcattctcttattctagcttctctaataatttaaaactatcattttgttttactcatgaagggaagctttcgaaaactgaacattcttcattttccttcaagatttcgtgatttcatcaagaggtaaggggggtcactccaactcttgaatcctatgcttgttgataaacttcattgaacatgatgcttaaaaattttcaagcttgttttcatgtcctgaatttgtgtgttgagctattttccttgattttttatgccaaaaacgagttctttgcatgttaaaacataaagttagtcttaaatttcacctaaatcaaaatttcctagcaaaagttacaaataaaacaagtttaaggacctttagtaaaatgaaaaatctgtcatgaatttgggctgagcttacaatagtatggactattttattaaagttttgacttcaaaaataaaattgttacatttgaaaatatagggcagcatataagatttgcgaaaattcaactcccgaagcatcgagagcactaaaaataagttaggagcaagactttgaaaaattgaacgacaaagtgattttagacagtaaatagcttaacttttgaattcgtgcttccatataaattatcttagaaatatttgttttctggaactgctgatttagtttttattatattgctaagataagtgcaagaccttatgactaatgcatgttctgaaattgtgatgattatctgctgttaaaattactaaaatgcatgcctgtattttgttgttatgattattaaatgataattccgacagagtgtgaactccaacaattatatatgtgacgtgcaaatttattttctattatatacatgtgtctgcatatattcatttttatttgtacgtgttgtggtgtgtgtccaggggtgtttgaccctcggcaaattgtttgttatgtttgcttagatggctataagtacaatcgttatgttgtccaattgtttgtgtgtcttaaggggccacgattgattcccataaagtagtacgcaggcctaaacctcgtctctcttcttgtttgtttgtttgcatgcattcgttgatgtacattgtacgaggattgcacacgcgatgtggtggccagattcaagaggattggacaaagagtaaagagccagtggttttatttctttctatgagaaggtgaggttgtgttgaggaagtggatgatggacaaagatacataggggtgtagtgggagtagaggttcaaagaacctagggggaattagcgagtggtgactactcgacatttgggtgtaggtaactcacaagcctcactttgctactcttgaaaggctctgagactatgttgtttgagttggaagatgagaggtcagtgtacgatgtatctgtatgtagtgatcacttccaactgtcatccacatgatttttgtaagaccattaagacctgagaggattgatgatagtcattgggccctattgtgaattaaatttattcatctactggattatctcactatcactaggtctagatattgccttttaagtaagtgtggttagtcaattcatgtcttcttgactgaaactcatcaaaaaccacttatccactgcatgggaccgtgtatcaagatcccaggcatatgtgcaggtggaggctttctctaaggaggattggtttgggtcacctattgaccttaaatctatcgcatgctctgtgtacttttggtggtaagttgatctcttaaaagaataagaagtagatgtggtgtcaagatatccaatacaaaggcacaaggttatagctaaacaacttatgaattgatataggtgagacagattttggatgagataggatttgctaatacttgtcctatgaaattgtggtgtgacaatcaagttgtcatacatatcacatcaaatttggtctttcatgaaagaacaaagcatattgaggtaaaaaaattgtaacttcaactgagagaaggtgcaatggaaccttatatctatgttttatatatgccaagataggcgacaacctataagatgtgtttacaaaatctttaaatgtggtgcgtatagtgttagagttgcttagttagaataaaagggttttagtatgtatatatatgcatgggcttggcccaactacatgtgtatacttaacctaataatataaatgtgaggcaagctacacattatagaacatccaattatagtttactcatatgccattgtctctttatatgactctttctctcaacatgtgacatggatgcaaagttcaagtttaaaaatgttcatccaagtttaaatattctttggtatgttatctaacaatgaataactaaatattaacttttatatgtatatatccatcaagataaagtagaacgataaaatatcaattaatatattatttacatgaaactttgtagacttgatctagtttaaaaatcttgtagtaagaagacaaaaaaaaatgaaaagaaaaagataatcttggatgagtgattggccatgaaaccattgcccatatatagttttaccattatacatgcgaagaacaacacaaactggatagttcttctgctctcccacatttatcaaagacttcacgtcatgcgcaggtaaggggaagatgcagtcttatttttatatatataaagatgttgtttctagattcgaaccatgaccaacaagtcacaacagaggactccctctcaaaagcttgatacacatgattttgttaatatacatatttctcttttttcatttggagtgcattagcaatttactccaaaattattggacaaaaatattcattcaaattttttactttaattaatttgggacaaggatactgtagtaatttaatttcatatatatatatatatatacatatatatatatatatatatatttctctcgcctgttccatctttctcgtcaagtagctttctgttaggctgttcatctaatttttcaattttctttctctcttttcccctttcaatctcacgtaacatttaacataagctctttcttttctaaacttcgctggagctctttctgaagactaaatcattcgcctagcattctcagttagtatcacttgagcgtagtgatatgaggactattccttttgtttttattattgaattttgcagaatactactcaagcgagatacaatgatttaatcccctttgttttgggagccaagatcaattgtttcttaaagattaaatatactgacagtttactgacattagaaaagaaaaatattcaagaccataggactagaagtagtagtcattgagctatttggcgaatcttttcaatcatggaaggtatgtcttgagtttcttaaaatagtggtcgtggagccatgacagaaaacttcaatcttaaaatctgagggaacaaacagtgtctcattttggtagttattaagtagaagatttggattataaatgagagagtttagtaaatatgcttcttgtttttaagttttatttccctgaaatcttactctgatagttgtaataagcataaaattttatttgaacaatatttatacaagttcatgactaaaagcttcgcgttaacactaaattccatttaagcattatgttgctaccaattattactacttatctaattaattgtcatttggagattaaagcttatcgagttttcaataggttactgttaacacatcttttatttatccatactgttaataattgaatctgactcaatgaaaataagttagagaagacatatattgacatgaactcattcttttccaagaattgaattcacacaatagacagcaaaggaagcaagaatcggggttacaagagaaaggtgtttaggagttttcagagcctctcagaatctgtggtgaatgattcaattgtttccatcttcttgttttattaattgatgtgtggaaatggtggaccttgttattctaattcatcccaacagggtcaactttggttgaatttttgtgtcagaaactgttcaaaagcctcaatcaaacaattgtgttgtaaccgtggccaaaatccaatcagagaatgaataaggagaaaaaaatggaagaagaatgacgaactatatatagaaaagaagacgaacaatcattgagaatgctaggtaaatgatttagtctgccaaagaaggcaccagcgaagtatagaagaaaaaaacccgcaattaagagcttatgtgaacgtgagattttgagaggggaaaggagatggaaagacaaagtagaagaattggaagatgaacaacctcagaatgctagagggatgagagaagagagatattttctttatactttcaagtgaacattaaattactatagcttccttgtcccaaattaaataaagtaaacaattagggagatgatttggaatgatgtgatttcggttatttgagagcatagaaatgatatatcattttctttggtgtggatgttgatcctctcttggttggtgttagggttaaaattttatcttagaagtggtttctgaagagatctaatggtaagttttgtttgttttctgactggtgtattatggaatatgtggtaaaactataattattaaaaaaaatatcaaaaatgtatatagaacttcatcataataaaaatgttacatatatatatatatatgaacgcacaactcaagtgaagatatccttctaaccagaggtggattcaggaaattaatgaagggtaaacactcaatattatgaaccacacaattcacagcagttcatggccttctaaattctagtaccctatgaaatttcacaagatacctttgaggctttgacgtcaccgcagaaagatactatcaaatgagcaaacaaagccaaactagagtgacaaagtagaatgagcaaaatttgatccaagcacagaacaaagcaaaatttgacaaagtagaatataacatagcattatcattcaatgaaagtatacccaattcagaaaaatttaaactctaattaaccattatcaaaagcagaaacctaatcctgggaacataactcgaaatcgaaatatgcttttgataattacaaagcattatcatttatcaacaaaaccagaggcggagccactggtctggagaactctcgaagccttggaccacgcttctgacttctgaggacgccgacgccatagcccgtagctgtgacggactgacggatgtcagcccgcaatgacgccgatcgccggagatggagaacgagagaggaaggggcgaagggcacgatattaccttactattgttgatgcttcttgcaaatgaaagaacgagagaggaagggtctcgtctgtgtggttgtgcctgtgcggtgcccccttctcacaacaagtaggttaattttgtgaaaaatttaaagtaaggatattttgataatttcacttcaaattttaagggtagacacttacctcctcttctacgtggatccacctatgccagagggaattgcactcacccacaaacatcaaaccctacccaaaaaattgatttgactaacactttgcttaatttttagggacacattttcttcctattgctcgctcattcctttagacaggatgtcctacacgaataccatgctaccccaatggtaggccactctggcatcaaaggcacacttgatcgagttgctgcttcattttattgggccgacatgtataaagatgtcaagttcttcatcaccaattgcttacctgccaatagaacaaaacgttaacaaccaaaaagaacgacctcctccaacctcttcttcctgttccaacccaggtttgggaagatataagtatggatttcatcaccaacttaccttcctcccatggccactctgttatctgggtcgtggttgactacttgtcaaaatatgttcatttcatagctctttatggttgtttttcttggttgttaacaaatacaaaaactagtatatcatatatctaacatcaaccaaatagattattacattataaaaaataaaaaactattatcatgttgtttaaaaaaaagctatcatcataaatatttttaaaataatgacacaagtctttaaaacatttactatatttaaaaataaaaaaaaaataccggtctaactgttaagactttaatatatatcacttacatacatttctatatgggcctgtttggataagcttctctagaaatacttctaaaaaaagaaaatatgaagaaaaaaattagatgagattttccataagtaaaaataagctctccattagttaatttttagaagttcaccaatataacttctctaaaagatgagatgacatctacaaattagctaatagaagacttattttaacttatggagaagctcatttcatttttttcttcttatttttctcttctagaagtacttctgggctaaaatttaattattttcatttcgttcacgtctcttcaaactttcaacttccactcagatacccatggaagagtagaagagatgtagattttgtgttatggtgagaatgaccaagaggatatggtgtccccatgcgcttgcaagggatcaatgaaggaaaagatgctcacgcacaattaatgtaggagtttaacattgctttgaacttttcttttatgtttctttcaaattaactataaagaacgagtttcttaattataattagtctttttcggtattatcaaatataaagtctgaaatacataatctttgatacaaattgaacataaatgtatttaatatactatttaatattttttaaattgataaattgtatttatgtacagatactttcttaaaaatatactaaatacaatcataaaaaatatataacttcaaataaattttaattttacaaaaaatatatttaaacattattaattacaaataaaaaataataaaaatgaacactcaaatttaaataattatatattatgtgttcaaatttaatttatatatacattttaaaagttttacttttaatataggtattattcattatcgttactcggagaaagtacaaaatcataatacattttaaaaacttaatattttttcaataaaatgtgttcaattaaaaatatgatcaatcaaatttcttaaatttaatgtaattatatttaatagattattaaatatttaaaaacctgataattttatttatgtggatattttttaaaatatgttaaatacaattttaaaaatatgtatattttcgtgttgatagcctatgagtgctaaatgtgaaaaaaaaaatccatttcattatcataggtattttattaaagataaggaaagataaaagtaattaaaaaaaatgagggaaatttgtttatatatttctacaaacaagaattgtacaattagattttgtacgaacaagaaatcattgtagcgagtggagacactggattgtggtgacatgtacatttacatttcaaaatttctaacttgagaagatcttattaagtcaaaataatttcctattagccgatttatacatttttacatatttgatggtacaaactaaggtgttttgcaataaaacataaatctaaaaatatttgtatcatatcatcatatcatatttgaatgaggtaagtcttgaggatctactacctagtggactaatcttttgggtagggaacttttgtatttaagtcctaataaatagtgttttcgttgaaagtcaggccatgaaaagagctacttataggttaaattaaggtacaaagcgaataagttggatgaagctatccaagggtaaatggctatccctgagtcagtgttgatagagtaaaagttgtcatgaacatcaactcttaaaaaggggaggtaatgttaggaatctaacattaaatataataaactatttgatgtggtacttaaggcttgaggctctcgcacgtaattgtttagtcttttggggtggattccccacttgaattatatttaagatctaacaatttatataagtaaccccttttaattatttaacttgaagtgtattataaatacaaaatttatataacagagggtgtgacacagaaccctttctatttcatttgaccaaattaatgacattcattctaattgtattagattttgatttactaagttaaattaggtagactaatataagagacaaaattttaagaaaaaatccaaaacctttagtgatgtgaactatacacaatatttgataaaatatccgcataaatacattaataatatttattcatatttgttaacattttttaaatattgtcaaaagttcttaacaatatttttactaagtgttaaagaaaaaaaatgttgctaaagattaatgtattgtagtgatgtcatatatatgtattaatataattaaaatatattacttaagtaaataatttatattatatatatactcttctataaaaaaataattatatgtttttctaattttatgactaactaacagagaggagtggaccctaattcaacatattttatactaatttgattcaaaatctatttaagaatattgaactattatatacttttatataaaaatttatgaaattgttgacaaattctttttaagattaggtttcaattatgaaccaatatttcatgttgtttggtgcttcaaattagtacaatatatttgtacctacttaatagcttatttttgtaatgttagatgattatttttgtaatgttgtttatttatggcttaggtttagacgaatcaatgttatgtttgcttattttaatattatgttggatatttttaaggcttaaatatgtttttgattcctaataagtatttgatttttgtgtttattccataataaatttttgttttgtgttgagtccttagttaaaacaacaattttgttttttattcttgaagctttttttagtctctaataacttatagaatttttctttgatgcctcataatttttttatttgtaattagttgggactaaaataaaattcactaatttgttagagagcaaatccaaaattcattaatttatcatggactaaaataaaatatcaaaaaaatctttatttgaaactcaatgcaaataaaatttttattagagaacaaatgtaaaaattaagtatttattaatgataaaaatatatttaaatttatttttaatatcatgtttatattatttaagaataaatttttaatttacttataataattttttgattaatatatttttattaatttattaactttatatataaatcaagtataaatggagataaagatgaaatttgttacctacactcgagaatgaaaacgaaacatttagttctttaaaaagtcaatatctattcaatccaatgctactcattatcatccctttaacaatcacaaataggggtggaaatgggccaggctgtttatcaggagcctttgacctgacctatttaaagtctggcttggcctgccttgtttattataaaggttaggctaaggttttttgaaaagtctatttaaataaaaagatcaggctcaagctttaaaaaaagcgtgttaggcctatcaggctggcctatttaatatatatatatatatatatattaaaacttaaaaataatatatttattttttaaaaaatatttttcttattatgaaagtggatgatcaatcactttaaaaaaatcaccttgaaaatctcataaatgattaagagaaacatatctataacttataggatcatatttgataatttataagaaaaacatatctattatgttattttttatttttaattatttatttttatttaatcagcctttgtatacaggcttccaggccaggccaggcctttatgaaggccaggctcatgccttaataacttatttttaacagataacaggctagatttagacttaatgatagtgatgcgaatcaggctcaggcctatcacagcctagcctggcctgacctatttccaccccacaaggcagcaatgacaaagcaagggagtgcttaacctttaattcacatctttgagacaccgtacgtaccctcccaatctcatcttcgcatcacagtttctcatttgttttctacatttcagacatgccatcccactctaaactgttacacgtttcaaatgtgtcctagcatgttttatttatgttacggaagtaagagttaggcctaattgcaagcccaattatagtagaagtatcatttgtccaattctcagaatgtggatttgacttagtccaaaggggcagttggcaacgtgcggattgaggtcagaaatttcgaaagcagttcgtatgataactgcaaggtaacacgcttataaatacttgatagtggcagcagaaaggtacacacacattctaactccctctctttcaattacacagagcacacaccccacgtcaattggtgtatctctgtgatcttctgcatcaagatatcattctccattgatatccttgaagttgtagagttagagtgatcaaacagcaatcatacagtgctttagtgctgtacatttgtgttctgggaaacctctggaacattggagccgtctgtggggaacgataaagttcgaatctcacgattcagcaatggtgaatacgagaaacagccaatcgataccacgttcagagatgccgaacagagaaatgcttataccggagaatcggaacgtagtgctgcgagaacaggtgcatatcacagaagctgtttctgacgcagcttcttctccagcctagactgatcaacggagggacgttccgtcgagaagaatggtgcaggaggaggagctaggagggcagttcatgcactcaattcaattttgagccgaattgaaagtatagagagaagacagactcttcagagacaggaggatatccgaagcattacacgtcagatggaggaacgaaacgaggaatggagacgtgccgagatgcaacgaatggcacagttggaacagaaaatacaaagaatagtggaacgggtacatgtctcgaatcatgaagaggaagcgccaccttcaatacaagatttgagggtacatttgaatcagttaaggaatgtcaagcaggagggagatcaggcgcgaaaggaagaccaatctcgggaccaaacccgagtatctgggggcaacaggaacgagatcccgcctagccaaatagatgaccacgagggcccgcgcacccgagcagagactgatgtaaacaccacacgccgagtagatgacatggagcccccgcaacaccatcaaaaattgattgaatatgataagacgggcgagccgacttcgcgtgagaatgagggacccgtttatcgtcggaaatatagtcggggtcaacagaacaacaacccgtttgcggacgaaattgtgaatgctcggtacctggatgactttgacgggtcatttttgtcaaaatatgatgggacacaggatccccaagtgcacattgatgagttcgacttacagatgtgtgtccggggcattgatgagcccattatatcaaggattttcgtcactacattgacgggcctggcgcagacatggtttcataccttgccaccaaggtcgattaaaaatttcgaagacttcggacaaaaatatttgttgaattttgcaactagcaagaagcagccaaagtccaagttcactctgggtaaagtcagacagttacccggcgagacgctgcaaagctacctagatagattcaaagaggctgcattgcaggtgcacgggctggaggaaaaagtacatgtatacctgatatctgccggattgaatggttcatcaagattcgccaagtccatttataaagatccagtgaagtctctgatggaattccgtgcccacgcaaagaaatatttagaactggaacaaatggaggtagctaataatccaggacgcgagaaggagcgaagagatagaaggagcccacccccaaaaaatagggggcattcagaaaatcgtcctcgaagtaacgatgtgaagttcaggctgggaaggtacgagaataagtacgacaaatacaccccgctaaacgtctcccgatcacagatttggaagaaggtagcgcttacggagatgaagaaagtagaacggcctcgtcctatctttaacaaggcgggacttgataaatcgcggttttgtgaatttcacgatggacccgaccacaccaccgaccagtgttgggatctacgggatgctatcgagaagtttatccgagaaggaagactaagacaatatgtgatcaaaacacagggaagaaagaataagcgcaagggagacgaatctcaacccgacaggaaaaacgagagaaagaaagcacgagaagaagatgacacgttcccgaaaccctaattcgaatgtaacgcgatcttcggggctacgggaggcggaggcggaggcgataccgccagtcagagaaagaagtatttgaaggaggtactatcaatccgagcacagccacaatttaaagaacgagccggcgaaaaggaacccccactcttgtatttcacgaaacgggatatagaaggggtagtacccggacatgaggatggattggttatcacctgaacggtcggcaactgtcgggtaaaaaagatgttcgtagacaatggaagttctgccgatataattttatggcacgcatttaagaagatgaacctggacatagaagatctggagccatgtaaaactatgctaatcgaatttaatggtggaaatacgaacgtaaagggatcaatacacttacgattaaccttgggaacgagagaggctttcaaaacagaaagagtgaaatttgtggtggcagatttcccttcccaatataatatgattttgggaagacctactattcacagatgggacatcctaatgtccacgaagcatcagaagcttaaatttgtaggcggaaatggacaggtggtgacaatatgtggcgaccagaaagactctcggcagtgttactacgatacagtccgagaaagcaaaaatagatccccaccaacacttcgggatccgaaaaggatccagaaattcgggaagtcaaagaagataacaaccgggcacgctcagtaaacttagtggagctcgacatgtgggaagcaccagacgaatggaggtcggagccggtagaacaggtggagcagatccaaataggagaacaagccggccacactaccaatattgggcgagcaatgaagcccacgcagaaggaaatgctggttcaatgtttaaggaaaaaccgtgatgtcttcgcatggaaggcatcggagatagtcggaatagatcccgaattctgttgccacaagttatctatatatccgggatcgaaaccggtggaacaaaagaagcgtaagttgggacccgagagaacgcaggcgttgcggactcatattgaagaattgctacaggccgggttcatacgggaagtacagtataccacatggctctcaaacgtggtgatggtccgcaaaccaaacgggaaatggagagtatgtacggactacacagatttgaacaagacctgtcctaaggatgcatatcctatgccgaacatagaccagctggaagacaattcatccgggtacaaaatcctgtcctttatggatgctttttccggatacaatcaaattgcaatgcacctggaggatcaggagaaaacagcattcatcggtgacaaagccaattactgttacaatgtaatgccatttgggttaaaaaatgtgggggccacatatcaaaggatgatgaacagggtgttcgaaccacagctcggacgtaacatcgaagtatatatcgacgacatgatagtcaaaactacggaggtcaacaagcatgtcaaagaccttgaagagacatttggccggttacgaaaatttaatatacgattaaatcccctaaagtgcactttcggagtcggagccggcaaattcttgggctttatgctgacgcacagagggatagaagccaatccagataaatgtcgcgctgtgttggacatgtactttccgactagcaagaaggtgtggaaaataaggaacgctcacacttaaccaagaggggggtgaattggttaaccatgggaaatttaaaatttctttgttcaatatcagagttaaaatgccctttggatctttatcacaaaaccaaatgaatatccttatccaagatcaatccaagacttgttatgcttcaaatttaaacacacaaaaacagagtttaacaagaaccaataaagactacagaaattaaatcaagatgcaagatttatactggttcacctcaaacactatgaggctacatccagtttcttctactcaacattagagtagaattccactattgcaaatatgtttcttacaaatttttacaagcttctcttcctcaaccctagaagaagttcagagatctaaaaccctcttagatccttagaagccacacccacactgagaaacctactcagttgtgcatggagaaaccctatctcccttgcaagaaaacccacttacaatataatcaccaaactacaaaattactgcagaaaataaaacacccacaaagaattaggaaagaattcacctgatgatccaagatagaaaatgcatgagaatgaaaaacctcaggttgaatgtaaactaatgatgcagaaagctttcctaagcctttgtgacagaacaagcttgcttcactaacaatcttagtgatccattaatgaatcaatggaagcaagactcaagagcccagatgaagcctttgtaaccccttagaagcctttagaaaaatgctcagaattcgtaaaaatcacttcagtaataatctctttctattagtttcgctcaagaggcaaagggtcttatttatagttgaaatcgtaacggatttaatcgatcaaatgcgctccccacgctcctataatcgattaaaatgattaatgcaggatcaggatttcaactaacgggtgaaataatcgattaacccgatgcgtaatcgattaaaccagtctgggcaaaaatcctgattgtgaagagtaatcgattacattcaattgtaatcgattaatccagacctatgctaaaattgagtttatgaaggataatcgattacatccattggtaatcgattaaggcagtcctatgataaaatcgtgtttgtgaagaataatcgattacatccatttgtaatcgattaaggcagagtgactgagttgtccaaataagtatataatcgattacaacactatggtaatcgattaaaacagtcacaaggccaaattacaaatatgctgagttgcgtgtaatcgattaatccgataaggtaatcgattaaaatgttcatattgattttccagaaagtttatgaacaaaataatcgattatgataagccagtaatcgattatcacgactatatgttgtttacttagctatttcttaagttttaaactaattacttagcttctctatgatgcaatgcttaaatgatacatgaatgctatgtaatcaaggcttggatcatcatgatgctttcaatcctttttacattaaatcacaaactactttttcaaagcttgaaccatgttgaaagccaaaacttccaagtcttgaaccttggttgaatcttcacttgatcttcatccagcttcctctcaaatcaacagaaggaaatacagcagctgaccgggagggtagccgcgctgatgcattttatgccaaagtcgacagaaaaagctctcccattttttaaaatgttgaagaaacaagttgtaatatagtggaactcagaatgcgaagccgcattcgtcgacatgaagaaatccttggcaagcccaccgattttatcaaggccagaggcaggagagattttggtgatgtacttatcggtgggcgaggatgccgttagtgtagtactggtacgagaagttgagaaagttcagaaaccagtatacttcgtaagtcgggccttgcgcgactccgagttacggtatcagaagttagaaaaagtgttatttgcattgtttgtagccgccaagaaattacgcccatatttccaaagtcacacaattataattcggacagatcagcctatccgacaggtgcttcacaagccagatctggccgggagaatgacgaattgggcagttcagttgtccgaatttgacctaaaattcgaggcacgacacgcaatcaaatcccaggtattggcggatttcgtgcgagaactcactcccaacgccccaggaacagaaattggtggacattgtacgtggatgggtcatccaacaagaaaggaagtggcgccggaattataatttagaatccagatggagtagcgatagagttttcactacagctgaatttcccgacgtcaaataatcaagccgagtacgaggcattgattgtcgggttggtgtaagcaagggagcagggagctgagaaggtaaaagtgtacacggattcccaattggtcgcaggccaaattgaaggccgctatcaggtgaagggacccctgttagcaaaatacttaggacgagtaaaagaaattattactaaatttgacgaggtcacggtcaaccatattcccagagaagacaatgccagggccgacatcctgtcaaaattagcaagtatgaagagtcctggaaataatcgaaccgtggtccaacaacaaatatcgcagccttcgtgcataatgatgatcaccacggatcaggactggaggcgtccaatagttgattacttggagaaaggcacattaccagatgacgggctcgaagcccaaaaattaataaaaactgcaactatgttcgcagtggtcgatggcaagttgtataggaaaagcttgcacaatcctttgttggtgtgtgtgaatccggatagagtcaaatatgtcttgtccgaaatacatgaaggtattaacggacaacacatgggggcgagagccttggcaagaaaagcgcttcgggttggatattattggccgacgatgggagcagatgctgccgagcacgtgaagaaatgcgaaaattgtcagaagaatgcatcccgaattttagcgccacctgagacgctgcaatccatcttggcaccttggccatttttcaaatggggcatggatctgttgggaccgttcaaaccagcagagggacaaatgaggtggttaatagttgctgtggattacttcaccaaatggatagaggtggcaccgttggccacgatcacatatgtccgagttcagcgattttttgaaagaaatataatctccaggtttgggattcccggggaggtcgtcactgaaaatggaacgcatttcacagacagagggttccaagaaatgatggccggcttccacatccgacacagatttgcatcggtggaacacccccaatccaacggacaggctgaggccgcaaacaagataatcttagaagctttacgaaaaagaatgcaagatgccggatctagttgggtggagcagctgtactacgcgctttggggtattcgcaccacggtccaagcgtcaacaggggagacttcgtttcggatgacctatggaagcgaagccatgataccggtcgaagtcggtcatcaatcgtggcggcgggcacaggtactacgagaaggagaagatgcaaataacgaagccctgatgatggactcggcgctgctcgacgagatccgagtgaccgcccatgcccgggacctttaggcgaaacaacaaatggcacacgcttacaacaagagggtgattccatgacagttcgagttagctgagctagtcctgtgacgagccgacgtcgggaataagaactctcgagatgggaaatttgcggcaaattgggaaggcccgtatcggataactcataagcttgatagggggcgtatatgctggaaacactagaagagaaaccggtcaaacggacgtggaacgcagataagcttaaaaaatattacagctgaaacttggaagcgtacggcaaaagaatgtggatttctcttttatggagagtatgagcttaggagttgctttatccgagtccatacggttctccttcattgaaaacataactcatcgggagaagcaagtttttctgttatcgagggtacgaatctgaggatgtatatccgggtacgtatggtcctctttcatggaaaaggcaccatccagtcaagtttagactcggaaagatttatttccgagattcaattgtttttcttatattgcatcagtacaagttataccgttgtaaattctaagtgtggaccgaaaatgatagttctactcggttatcaatgaacattgtaatacaatgattaaaagttcaataaagtgttattcactatcatagtgttttatgtaaagtatggatcccgaaaaattttgattcatatggttcttctaaaacgtgatacgattagatttcaaaactttgaatgatacgctaaccggttctgatcaaactctgatataaagtaaatcgtttccattaatagcagtgttataaaaacatatgttccaggcccgtgggcctaacattaacagaaaaataaatacaagtaaaaccggcattccagccctttagttcttttcgatgggaggttgggagtcggcgacagatggttgcgggtcggaaacgggtggctgatcgccagtaggagagtcagtagccggggcagcagagggagtctcgtcgacatgcgcagactcatcagccgccgccacagaagaaggttcggctccggtaggaggaatccactggccatcatcaacataagccatataatgcatcccagaagtagatagtaccactcccgggttcaagtgttgaatttgctcgatggcattggtgaaaccttcttccgcagcggcggcaagagtagtcttcatagccgcaagcttatcctcataagcccgagcttgttcttcataactaatttttaaagaggccacctgctgctcggcaacctccaaagaaccctgagctcgacccaagtcactccgcaaagaagcagcttgggatgcgagtaactcttcctttagctgccggttctccgcagccagttgggcccgaatcttctcgtgcccggccttggtggaaagaagctcttcataaaccttcttcttctcttccaccgctacgccatacctattacgaataaagttagattcatgactaagaatatgcgtaaaagctaaagagtttacagcgatgataaatacctctcccgcactatagcaaatgctctcaccaaagacgcagaccgaaaggcatattcctcgacgcagacgagctcggccagttcttcacccacgggagcaccggggttaagcataggagaaggaggtttcatcaatttgactaagtcctcatttactcccttcttccaaacgttacccgaaaccgcccgagagtcggaacgcccagaatcagtagtgggaccggtacgccgctgggaggtcgccacggtcaggtccacggttgcaaccccgaacgccggagtggacgaagccgggggacggggagtcacagtttgaccaggggccgccggtgcgctcggcaccaccttggcacttttgtcctcaccatccaacatcgtcctgtaggaaggtggagggcgtttgcgcgacttgttcagagcaggaggctgctcggaggctaaccccttacctctgtcctcgacgaccttggggttggaagcagcgtcggatttggttttggtggggggagctggttgtggtctcatgtcggctacaatgaaaaagaaacaacgttagaaacggtacacggtatatttaagtataactaaagaatcagtatagtcttcaaggcaaaccagttcgatggccaacgccaatatagtttgctatgttaggctgaccatgggtatctacatattcggaaatcacaaaaacagacgaagcatcggagtcacacaattcctcctcaatgaatcgataatttgatcgatcctgcttatgatgatcctcagaccaatagagaggaaatgcccactccacgtcagaggattcgaggccggacaagaagaatggttgtcgaccaggctcagtgaccaccttaaagtacttgcccttaaaacccctaaaagagtctgtgaacggtttaaataattttcgtttgctctggcttcgaaaagaaatccaccttttccggttaggaggttccctacctgtcctaggagtatgagggaagtaataatagaaaagagagggacagtgcagggaattcctaagtcttcacaaaacaattcaaaggtatgaataaagccccaactatttggatgaagttgagaagggcctacccggagatgagttaaaactttgatctcgaaggaagaaaagggaaaagtgatgcctatttgggtaatcacgtcctggtaaaagaagaaaaatgggggtcattcccttctcgtcgtgtacaaacaggctcacccgagaggggagcccggatgacaaacccttcttgttttcccaccggggtggatactatgctaggaaggtcaagggtggacagagtttgaaggacttcgtgagtcacccaagtaaatttggatgccaaagccgaagtcactttcgattgggactcagcagagatggattcgtctacagtttccaaagcaacatccattatacctaagtaaacaaagaagaaaaacaaaagttagtaaacgtacctggaggcaatgcatcaaatatagaggaagccgaggccgggacctcgccaccgccaacgcgggtgcgcggcttcgacgggggctttttagtggatgacactatggggttgtgccgacacgaccccaaaatcgaatcggcaacgtcatcagagccgagttgagtataatacatggcgtcggaaacacaatctatgcaagcatcatacttgacctccaatacctcatccgacgacgaggaggaggtctcatccgaagaaaaagataggtcggtcaggggattgaaacgacgacacgggagtggaagttcccttgggctgcaaatgtgtctgggccctgaaatttgggggcccagaatgggaaaagttctagaacgacccagggtcgaagtaggtttgggtgtagaaccgacggagtttgatggaggaggaagaagagcaccggcgggtttagacccacctgggtgatacggtggtgagaaggggttttggccgctaggcgcggcggaaacccgtgatttttgggaagaggaagagccaccggtataaccacgaaggaggcctttttcaagttcctcctccggaagaggaaggccaaaaaccagccacccagtcctaggggggacaatcctctgtaattccgcctcttcctcaggagtcatcttcatgctttccaaagtaaataaaacaatccaacaaaaatggaggagaagaagaaaacaaaacccagaagagataaaagaagataatgtggccctaactaaagtactaattatgaaactatgaaagtagaaatttgcaagaggaaggaaggaaagcacctgttggaagaggaaatcgagaactggaagaaaatgaacgaagaaagtgtctgaagaaaaatgaacgaaacaggagagaaaatgtggagagaaagtagtagaatatgggtgaagtgacaaatgaaagaaagggaaggagatgaaataattagaattgcgggattttaggaggaaatttaaaatttgaaggtaacctacagtaaccgccgaaagaaatgaaacggcctgcaaaaccgtcgccaaggaaactaaacgacataagggcataatggaaaaggcactccaaagtttgggggcatggaggtaaaagcaccaaaagtgcaatgattatctgaaggatgaaacgataggacttttaatgcattaattgacaataaaggcacgaatagtaaccgacggcagtcagaaagtcgatcgtcagctggggcattttacttccccagagaagttctctacacgctgcatgattcggacagacttactcggatatgaataatctctactcggggtactgtctactcggaaggatgttggtgggtaggtatcatcggatataatgttgttccgtgagttctcctggttggattgatgaaaacgctttgtggccggctagttgtggtcggagagtcatatccagaaagtggtggtcgacaatgtggtacaaggaccttacctcgacagctgtattaatttacccggaccagcacgtacggataaagtctacccgggagaacatagaaatataagacaatgcaccccggttaccaagaatgcttgatgaccgggctggggggcaactgttacggaagtaagagttgggcctaattgcaagcccaattatagttgaagtatcatttgtccaattctcagaacgtggatttgacttagtccaaaggggcagttggcaacgtgcggattgaggccggaaatttcgaaagtagttcgtatgataactgcaaggtaacacgcttataaatacttgatagtggcagcagaaaggtacacacacattctaactccctctctttcaattacacagagcacacaccccacgtcaattggtgtatctctgtgatcttctgcatcaagatatcattctccattgatatccttgaagttgtagagttagagtgatcaaacagcaatcatacagtgctttagtgctgtacatttgtgttctgggaaacctctggaacattggagccgtctgtggggaacgataaagttcgaatctcacgattcagcaatggtgaatacgagaaacagccaatcgataccacgttcagagatgccgaacagagaaatgcttataccggagaatcggaacgtagtgctgcgagaacaggtgcatatcacagaagctgtttctgacgcagcttcttctccagcctagactgatcaacggagggacgttccgtcgagaagaatggtgcaggaggaggagctaggagggcagttcatgcactcaattcaattttgagccgaattgaaagtatagagagaagacagactcttcagagacaggaggatatccgaagcattacacgtcagatggaggaacgaaacgaggaatggagacgtgccgagatgcaacgaatggcacagttggaacagaaaatacaaagaatagtggaacgggtacatgtctcgaatcatgaagaggaagcgccaccttcaatacaagatttgagggtacatttgaatcagttaaggaatgtcaagcaggagggagatcaggcgcgaaaggaagaccaatctcgggaccaaacccgagtatctgggggcaacaggaacgagatcccgcctagccaaatagatgaccacgagggcccgcgcacccgagcagagactgatgtaaacaccacacgccgagtagatgacatggagcccccgcaacaccatcaaaaattgattgaatatgataagacgggcgagccgacttcgcgtgagaatgagggacccgtttatcgtcggaaatatagtcggggtcaacagaacaacaacccgtttgcggacgaaattgtgaatgctcggtacctggatgactttgacgggtcatttttgtcaaaatatgatgggacacaggatccccaagtgcacattgatgagttcgacttacagatgtgtgtccggggcattgatgagcccattatatcaaggattttcgtcactacattgacgggcctggcgcagacatggtttcataccttgccaccaaggtcgattaaaaatttcgaagacttcggacaaaaatatttgttgaattttgcaactagcaagaagcagccaaagtccaagttcactctgggtaaagtcagacagttacccggcgagacgctgcaaagctacctagatagattcaaagaggctgcattgcaggtgcacgggctggaggaaaaagtacatgtatacctgatatctgccggattgaatggttcatcaagattcgccaagtccatttataaagatccagtgaagtctctgatggaattccgtgcccacgcaaagaaatatttagaactggaacaaatggaggtagctaataatccaggacgcgagaaggagcgaagagatagaaggagcccacccccaaaaaatagggggcattcagaaaatcgtcctcgaagtaacgatgtgaagttcaggctgggaaggtacgagaataagtacgacaaatacaccccgctaaacgtctcccgatcacagatttggaagaaggtagcgcttacggagatgaagaaagtagaacggcctcgtcctatctttaacaaggcgggacttgataaatcgcggttttgtgaatttcacgatggacccgaccacaccaccgaccagtgttgggatctacgggatgctatcgagaagtttatccgagaaggaagactaagacaatatgtgatcaaaacacagggaagaaagaataagcgcaagggagacgaatctcaacccgacaggaaaaacgagagaaagaaagcacgagaagaagatgacacgttcccgaaaccctaattcgaatgtaacgcgatcttcggggctacgggaggcggaggcggaggcgataccgccagtcagagaaagaagtatttgaaggaggtactatcaatccgagcacagccacaatttaaagaacgagccggcgaaaaggaacccccactcttgtatttcacgaaacgggatatagaaggggtagtacccggacatgaggatggattggttatcacctgaacggtcggcaactgtcgggtaaaaaagatgttcgtagacaatggaagttctgccgatataattttatggcacgcatttaagaagatgaacctggacatagaagatctggagccatgtaaaactatgctaatcgaatttaatggtggaaatacgaacgtaaagggatcaatacacttacgattaaccttgggaacgagagaggctttcaaaacagaaagagtgaaatttgtggtggcagatttcccttcccaatataatatgattttgggaagacctactattcacagatgggacatcctaatgtccacgaagcatcagaagcttaaatttgtaggcggaaatggacaggtggtgacaatatgtggcgaccagaaagactctcggcagtgttactacgatacagtccgagaaagcaaaaatagatccccaccaacacttcgggatccgaaaaggatccagaaattcgggaagtcaaagaagataacaaccgggcacgctcagtaaacttagtggagctcgacatgtgggaagcaccagacgaatggaggtcggagccggtagaacaggtggagcagatccaaataggagaacaagccggccacactaccaatattgggcgagcaatgaagcccacgcagaaggaaatgctggttcaatgtttaaggaaaaccgtgatgtcttcgcatggaaggcatcggagatagtcggaatagatcccgaattctgttgccacaagttatctatatatccgggatcgaaaccggtggaacaaaagaagcgtaagttgggacccgagagaacgcaggcgttgcggactcatattgaagaattgctacaggccgggttcatacgggaagtacagtataccacatggctctcaaacgtggtgatggtccgcaaaccaaacgggaaatggagagtatgtacggactacacagatttgaacaagacctgtcctaaggatgcatatcctatgccgaacatagaccagctggaagacaattcatccgggtacaaaatcctgtcctttatggatgctttttccggatacaatcaaattgcaatgcacctggaggatcaggagaaaacagcattcatcggtgacaaagccaattactgttacaatgtaatgccatttgggttaaaaaatgtgggggccacatatcaaaggatgatgaacagggtgttcgaaccacagctcggacgtaacatcgaagtatatatcgacgacatgatagtcaaaactacggaggtcaacaagcatgtcaaagaccttgaagagacatttggccggttacgaaaatttaatatacgattaaatcccctaaagtgcactttcggagtcggagccggcaaattcttgggctttatgctgacgcacagagggatagaagccaatccagataaatgtcgcgctgtgttggacatgtactttccgactagcaagaaggtgtggaaaataaggaacgctcacacttaaccaagaggggggtgaattggttaaccatgggaaatttaaaatttctttgttcaatatcagagttaaaatgccctttggatctttatcacaaaaccaaatgaatatccttatccaagatcaatccaagacttgttatgcttcaaatttaaacacacaaaaacagagtttaacaagaaccaataaagactacagaaattaaatcaagatgcaagatttatactggttcacctcaaacactatgaggctacatccagtttcttctactcaacattagagtagaattccactattgcaaatatgtttcttacaaatttttacaagcttctcttcctcaaccctagaagaagttcagagatctaaaaccctcttagatccttagaagccacacccacactgagaaacctactcagttgtgcatggagaaaccctatctcccttgcaagaaaacccacttacaatataatcaccaaactacaaaattactgcagaaaataaaacacccacaaagaattaggaaagaattcacctgatgatccaagatagaaaatgcatgagaatgaaaaacctcaggttgaatgtaaactaatgatgcagaaagctttcctaagcctttgtgacagaacaagcttgcttcactaacaatcttagtgatccattaatgaatcaatggaagcaagactcaagagcccagatgaagcctttgtaaccccttagaagcctttagaaaaatgctcagaattcgtaaaaatcacttcagtaataatctctttctattagtttcgctcaagaggcaaagggtcttatttatagttgaaatcgtaacggatttaatcgatcaaatgcgctccccacgctcctataatcgattaaaatgattaatgcaggatcaggatttcaactaacgggtgaaataatcgattaacccgatgcgtaatcgattaaaccagtctgggcaaaaatcctgattgtgaagagtaatcgattacattcaattgtaatcgattaatccagacctatgctaaaattgagtttatgaaggataatcgattacatccattggtaatcgattaaggcagtcctatgataaaatcgtgtttgtgaagaataatcgattacatccatttgtaatcgattaaggcagagtgactgagttgtccaaataagtatataatcgattacaacactatggtaatcgattaaaacagtcacaaggccaaattacaaatatgctgagttgcgtgtaatcgattaatccgataaggtaatcgattaaaatgttcatattgattttccagaaagtttatgaacaaaataatcgattatgataagccagtaatcgattatcacgactatatgttgtttacttagctatttcttaagttttaaactaattacttagcttctctatgatgcaatgcttaaatgatacatgaatgctatgtaatcaaggcttggatcatcatgatgctttcaatcctttttacattaaatcacaaactactttttcaaagcttgaaccatgttgaaagccaaaacttccaagtcttgaaccttggttgaatcttcacttgatcttcatccagcttcctctcaaatcaacagaaggaaatacagcagctgaccgggagggtagccgcgctgatgcattttatgccaaagtcgacagaaaaagctctcccattttttaaaatgttgaagaaacaagttgtaatatagtggaactcagaatgcgaagccgcattcgtcgacatgaagaaatccttggcaagcccaccgattttatcaaggccagaggcaggagagattttggtgatgtacttatcggtgggcgaggatgccgttagtgtagtactggtacgagaagttgagaaagttcagaaaccagtatacttcgtaagtcgggccttgcgcgactccgagttacggtatcagaagttagaaaaagtgttatttgcattgtttgtagccgccaagaaattacgcccatatttccaaagtcacacaattataattcggacagatcagcctatccgacaggtgcttcacaagccagatctggccgggagaatgacgaattgggcagttcagttgtccgaatttgacctaaaattcgaggcacgacacgcaatcaaatcccaggtattggcggatttcgtgcgagaactcactcccaacgccccaggaacagaaattggtggacattgtacgtggatgggtcatccaacaagaaaggaagtggcgccggaattataatttagaatccagatggagtagcgatagagttttcactacagctgaatttcccgacgtcaaataatcaagccgagtacgaggcattgattgtcgggttggtgtaagcaagggagcagggagctgagaaggtaaaagtgtacacggattcccaattggtcgcaggccaaattgaaggccgctatcaggtgaagggacccctgttagcaaaatacttaggacgagtaaaagaaattattactaaatttgacgaggtcacggtcaaccatattcccagagaagacaatgccagggccgacatcctgtcaaaattagcaagtatgaagagtcctggaaataatcgaaccgtggtccaacaacaaatatcgcagccttcgtgcataatgatgatcaccacggatcaggactggaggcgtccaatagttgattacttggagaaaggcacattaccagatgacgggctcgaagcccaaaaattaataaaaactgcaactatgttcgcagtggtcgatggcaagttgtataggaaaagcttgcacaatcctttgttggtgtgtgtgaatccggatagagtcaaatatgtcttgtccgaaatacatgaaggtattaacggacaacacatgggggcgagagccttggcaagaaaagcgcttcgggttggatattattggccgacgatgggagcagatgctgccgagcacgtgaagaaatgcgaaaattgtcagaagaatgcatcccgaattttagcgccacctgagacgctgcaatccatcttggcaccttggccatttttcaaatggggcatggatctgttgggaccgttcaaaccagcagagggacaaatgaggtggttaatagttgctgtggattacttcaccaaatggatagaggtggcaccgttggccacgatcacatatgtccgagttcagcgattttttgaaagaaatataatctccaggtttgggattcccggggaggtcgtcactgaaaatggaacgcatttcacagacagagggttccaagaaatgatggccggcttccacatccgacacagatttgcatcggtggaacacccccaatccaacggacaggctgaggccgcaaacaagataatcttagaagctttacgaaaaagaatgcaagatgccggatctagttgggtggagcagctgtactacgcgctttggggtattcgcaccacggtccaagcgtcaacaggggagacttcgtttcggatgacctatggaagcgaagccatgataccggtcgaagtcggtcatcaatcgtggcggcgggcacaggtactacgagaaggagaagatgcaaataacgaagccctgatgatggactcggcgctgctcgacgagatccgagtgaccgcccatgcccgggacctttaggcgaaacaacaaatggcacacgcttacaacaagagggtgattccatgacagttcgagttagctgagctagtcctgtgacgagccgacgtcgggaataagaactctcgagatgggaaatttgcggcaaattgggaaggcccgtatcggataactcataagcttgatagggggcgtatatgctggaaacactagaagagaaaccggtcaaacggacgtggaacgcagataagcttaaaaaatattacagctgaaacttggaagcgtacggcaaaagaatgtggatttctcttttatggagagtatgagcttaggagttgctttatccgagtccatacggttctccttcattgaaaacataactcatcgggagaagcaagtttttctgttatcgagggtacgaatctgaggatgtatatccgggtacgtatggtcctctttcatggaaaaggcaccatccagtcaagtttagactcgaaaagatttatttccgagattcaattgtttttcttatattgcatcagtacaagttataccgttgtaaattctaagtgtggaccgaaaatgatagttctactcggttatcaatgaacattgtaatacaatgattaaaagttcaataaagtgttattcactatcatagtgttttatgtaaagtatggatcccgaaaaattttgattcatatggttcttctaaaacgtgatacgattagatttcaaaactttgaatgatacgctaaccggttctgatcaaactctgatataaagtaaatcgtttccattaatagcagtgttataaaaacatatgttccaggcccgtgggcctaacattaacagaaaaataaatacaagtaaaaccggcattccagccctttagttcttttcgatgggaggttgggagtcggcgacagatggttgcgggtcggaaacgggtggctgatcgccagtaggagagtcagtagccggggcagcagagggagtctcgtcgacatgcgcagactcatcagccgccgccacagaagaaggttcggctccggtaggaggaatccactggccatcatcaacataagccatataatgcatcccagaagtagatagtaccactcccgggttcaagtgttgaatttgctcgatggcattggtgaaaccttcttccgcagcggcggcaagagtagtcttcatagccgcaagcttatcctcataagcccgagcttgttcttcataactaatttttaaagaggccacctgctgctcggcaacctccaaagaaccctgagctcgacccaagtcactccgcaaagaagcagcttgggatgcgagtaactcttcctttagctgccggttctccgcagccagttgggcccgaatcttctcgtgcccggccttggtggaaagaagctcttcataaaccttcttcttctcttccaccgctacgccatacctattacgaataaagttagattcatgactaagaatatgcgtaaaagctaaagagtttacagcgatgataaatacctctcccgcactatagcaaatgctctcaccaaagacgcagaccgaaaggcatattcctcgacgcagacgagctcggccagttcttcacccacgggagcaccggggttaagcataggagaaggaggtttcatcaatttgactaagtcctcatttactcccttcttccaaacgttacccgaaaccgcccgagagtcggaacgcccagaatcagtagtgggaccggtacgccgctgggaggtcgccacggtcaggtccacggttgcaaccccgaacgccggagtggacgaagccgggggacggggagtcacagtttgaccaggggccgccggtgcgctcggcaccaccttggcacttttgtcctcaccatccaacatcgtcctgtaggaaggtggagggcgtttgcgcgacttgttcagagcaggaggctgctcggaggctaaccccttacctctgtcctcgacgaccttggggttggaagcagcgtcggatttggttttggtggggggagctggttgtggtctcatgtcggctacaatgaaaaagaaacaacgttagaaacggtacacggtatatttaagtataactaaagaatcagtatagtcttcaaggcaaaccagttcgatggccaacgccaatatagtttgctatgttaggctgaccatgggtatctacatattcggaaatcacaaaaacagacgaagcatcggagtcacacaattcctcctcaatgaatcgataatttgatcgatcctgcttatgatgatcctcagaccaatagagaggaaatgcccactccacgtcagaggattcgaggccggacaagaagaatggttgtcgaccaggctcagtgaccactttaaagtacttgcccttaaaacccctaaaagagtctgtgaacggtttaaataattttcgtttgctctggcttcgaaaagaaatccaccttttccggttaggaggttccctacctgtcctaggagtatgagggaagtaataatagaaaaagagagggacagtgcagggaattcctaagtcttcacaaaacaattcaaaggtatgaataaagccccaactatttggatgaagttgagaagggcctacccggagatgagttaaaactttgatctcgaaggaagaaaagggaaaagtgatgcctatttgggtaatcacgtcctggtaaaagaagaaaaatgggggtcattcccttctcgtcgtgtacaaacaggctcacccgagaggggagcccggatgacaaacccttcttgttttcccaccggggtggatactatgctaggaaggtcaagggtggacagagtttgaaggacttcgtgagtcacccaagtaaatttggatgccaaagccgaagtcactttcgattgggactcagcagagatggattcgtctacagtttccaaagcaacatccattatacctaagtaaacaaagaagaaaaacaaaagttagtaaacgtacctggaggcaatgcatcaaatatagaggaagccgaggccgggacctcgccaccgccaacgcgggtgcgcggcttcgacgggggctttttagtggatgacactatggggttgtgccgacacgaccccaaaatcgaatcggcaacgtcatcagagccgagttgagtataatacatggcgtcggaaacacaatctatgcaagcatcatacttgacctccaatacctcatccgacgacgaggaggaggtctcatccgaagaaaaagataggtcggtcaggggattgaaacgacgacacgggagtggaagttcccttgggctgcaaatgtgtctgggccctgaaatttgggggcccagaatgggaaaagttctagaacgacccagggtcgaagtaggtttgggtgtagaaccgacggagtttgatggaggaggaagaagagcaccggcgggtttagacccacctgggtgatacggtggtgagaaggggttttggccgctaggcgcggcggaaacccgtgatttttgggaagaggaagagccaccggtataaccacgaaggaggcctttttcaagttcctcctccggaagaggaaggccaaaaaccagccacccagtcctaggggggacaatcctctgtaattccgcctcttcctcaggagtcatcttcatgctttccaaagtaaataaaacaatccaacaaaaatggaggagaagaagaaaacaaaacccagaagagataaaagaagataatgtggccctaactaaagtactaattatgaaactatgaaagtagaaatttgcaagaggaaggaaggaaagtacctgttggaagaggaaatcgagaactggaagaaaatgaacgaagaaagtgtctgaagaaaaatgaacgaaacaggagagaaaatgtggagagaaagtagtagaatatgggtgaagtgacaaatgaaagaaagggaaggagatgaaataattagaattgcgggattttaggaggaaatttaaaatttgaaggtaacctacagtaaccgccgaaagaaatgaaacggcctgcaaaaccgtcgccaaggaaactaaacgacataagggcataatggaaaaggcactccaaagtttgggggcatggaggtaaaagcaccaaaagtgcaatgattatctgaaggatgaaacgataggacttttaatgcattaattgacaataaaggcacgaatagtaaccgacggcagtcagaaagtcgatcgtcagctggggcattttacttccccagagaagttctctacacgctgcatgattcggacagacttactcggatatgaataatctctactcggggtactgtctactcggaaggatgttggtgggtaggtatcatcggatataatgttgttccgtgagttctcctggttggattgatgaaaacgctttgtggccggctagttgtggtcggagagtcatatccagaaagtggtggtcgacaatgtggtacaaggaccttacctcgacagctgtattaatttacccggaccagcacgtacggataaagtctacccgggagaacatagaaatataagacaatgcaccccggttaccaagaatgcttgatgaccgggctggggggcaactgttacggaagtaagagttgggcctaattgcaagcccaattatagttgaagtatcatttgtccaattctcagaacgtggatttgacttagtccaaaggggcagttggcaacgtgcggattgaggccggaaatttcgaaagtagttcgtatgataactgcaaggtaacatgcttataaatacttgatagtggcagcagaaaggtacacacattctaactccctctctttcaattatacggagcacacaccccacgtcaattggtgtatctctgtgatcttctgcatcaaaatatcattctccattgatgtccttgaagctgtaaagttagagtgatcaaacagcaatcatacagtgctttcgtgctgatgggaaacctccgaaacaatttatttacttttttatctggatttaattttctgccgatgcttctcttttttttactgaaaccgatgttgtgttataaatgttacattgtataacagttcttatatagagaataatttttttagaattattcttgattttaaacatgcgaaaggtgaggatctctttgcacaaaagagagtcccacaaactaacacccacacaaatcttaattgctccagaactcacgatgaaactgaaaatactatttattttatctttcgcgttctgttcatgttttctttatataagaccgcctttaaaaggttattaaaaccattaaaatcaatcagacgcaacgttctaaaaggaatcatatttttaaaagcctcattcaaatcacatatttaaaataattgattagacgttaaatcaaataaaaagcttccgttaattaataaagaaaatgttccaacgtttcaactcactgatgctgctaccctttaatgttttcatgattgaggaacctaacgtgacatcttggtagaatgcacccgcttcaatgaagtcataaccacgaacaatgttggagattgtaacgttgagggagaagtcgtaatagagagtgttgttggtgtagtcaaattatgttaggatagcatcggacacgaccgtgacatcgtatggtttgtctttgtgaagaggatgatgaacgtcatgttctccaagaaccaccgttttaggtcaagattttgagtcatggctgagtactcagagcagtctaagacatcattaagacaagtaagactatatattattttcttttgttggacgcatcaaagagtttaagatttaaatttgaattatcagtaatttttagaattagatctacggatctgtagttttaattttagaattagatttaaacttgttagtttttaagattatggttagtttttgaattttataacttttttatagatagattaacagataaagttagattagttagttttcggatttttgaatcttgtaaattagtctatatatacataacaagtcaataaataaacaatgaaattcttcaattattaattcttctttcttgcttgatttttacatgatatgtatacgtgtccaacatgtgttttttatagaagagacgattgttttgttggggataatattaataggatattgtttattaacgctcttaggacattaattaaaaaataaaaaaaaatatttattatagagataataatagaacgtaaaaaatgtcacaaataatataattttatataccctaataattttttttccttaatttcttaaccaatctcactgattaactttttcatatagtatgcccagaaaatttgtatttatacatttattaaacatgtcccttgctttccactgcttgctatattattgtaataatgttttactgaattaatgaactcgaagaattattgaatgtgacccgaggcacaacagttatatttgatgtagctttaatccttaattagatgtgcgtggcttgtagcaggcacaacaataatttaatgtactactatcagaagttgtattagaaaatgactgccaacggtggtagaatagagccaacaatggaaagataattatatttgttttttactttttcaacaattaaatatttagaaaaattttattgcatgtaataatttaataattaattatataaaactatatagaattttgcaatattaaaatagatagataataatatgaaaattaacaatttaccttacactatagacttcatcaaatattaaagaatgacataacttaatcgatgtggcgatggcttaaaattacactgcgactttaatcagggcagtttagtttattaaaatttaaaaaattattttaaaataaaggcttaaatgttttcttccctataattatattaatttttcgtttgggtttttgaatatatatatatatatatatattgattaagaattctgtaacgtttaaccaataatgtcttgactactttaatgcttattaatcttttataataataaaaaatgcttacgtgagttcgtatgacagaatcatgcaaatatttttgtaatacggtgtcatatgttaacattttggtaatccaactaaaacgcaagattaacatattagaatttagattaaattataattttattctttctaatttctcaaatctataattttaattctttggttttgaattataacatttaatcttccgatttttattaatggagttattaaggtaattataaataattcaaaatcattaattattaaaaattaaataaattattaactctaatcctccacaatattaggctcctccttttctccgcaaacatatctttcatcttcaatgtggcaagcgactccgtcgacaacaacaccatattaggattactaatcttttattaaatttttaatgattactatttttatttaatttaataactctagtaatcacaatgtaaatattaattaataattgatcagaatgaccaaaatcatcaatttataaaactagaaagattagttataattaaaaatcaaagaccaaaatcatgaatttgaaaaattatgaaaccaaaattataatttaacctaaaacttaaaaaaaaaaaaaaaaaaaaaaaagagtaacagggaacacattcatttgggacctatcccattcgggttgcttgctacgtactcagccaaatttgcttttaggtgattttctcaaacacctatcattctaagtacatgtgaagaaagatgaacttggacatgggtttggagactaccataaaatatgaaacactttttatggcttacatgtggaggtagtcttcctactaatgtttatcgttggaggagacatttgtcttcctcttcgctttgttgccggtgcaatggagtggaggacacatgaattcacaggtcgccctaaagctaaattcatttggcatcatctccatattctttcctttcttaatcacttcagctgagatgatgctctatggttgtgccacaatgtcataaggagtaattttcaactcggggactcacgctggatcgtttggaaaacccagaaccattgatgaaaaaattcaatggaattcatggtttactacagttttaatagacctctattacatagacatcttcgatgaaaaaattcattggagttcacttttctgagtgttaatgaagtcacgtgccttaatgttcctcaagctcattaccttgttaattatgatcatgataggtttttttcttatcccgtatgaagtagcaggaatattttggcccatgacatttattattgtgggctcttgcctgtttgtcatccaccagtccatggaatgcttgggatttggaaagctgaaaatgagtattcccttatctgaaatacaagaaaaaaatacgatgcattaattaaagttagttaattatatgtaattacataaaattgaattaaaaagaaacttttaaagcttatttttcattgaaatttgatattaaagataaaaaagagtcattataactaacatctcaattaaaaagtattttaaagataataacattaaataatataaagttagtaaaaaaatatatatttgatatcaagaaaaatatatatttttccttacatttgagaccatatggagtattaatctggtcttaaatataagaaaaaaattaaccacatttaattatatcaatctcaaataaacattattttttctccaatttatcttttattgaaatttggtattagacataaaaaagagtcattggaattaagatatcacttaaataaagtataatttagagataatatcattaaataagacaaagttagttaaaaaaaattatatttgagacaaaaaaagagtatttgtttctcttcttatttatatttgagatcagcgagtgtatctaaaattattttacaaatattttataggctgttggaagatggtggacttattatgacacgatgatgcattagtatgtatttgcgggtttagtgtttacatgcgagtatgcacgcgagagaattgaatatatcggctcaaataaatcatgttaaatgggccatacacccagcagattgcaacgggcaatccaagcccaaataatccccacatgccatgggattaacttcctacacctgccttttttctagtacacccagcatgtacagtataataccgattttgcccttctcataatccataaattttatacggattgtcaatccatatgaacctttatggattcacacacccatagccttacagattcataatccgtaaggtttttacggattcgtaatccatatgagttaactcacggattcacaatccataagaaccatacggattcgcaatccgtaagagtctaacaatgtatattttatgtattattagataaaaatatatattattagataaaatgatggtttaattataaaatatatgcattattagaacaataaatttaaaataaaaatcatggtttgattaaaaatcataggattgaataaaaaatattaggttcatatattagaaattttaattttagaaaaaaaggttcatatactttagaaatttatatatgtaaaaaaatattattagataaaaattaattgttataaaaattattatgtaaatttatgtgtaataaatatgtattaaaatttgtaatgttacatatacaaatattaattagcttttaacatgattggtcaagtaatttagttggttagagcattgtatttgtaatcggaaggtcacaagttcaacacttgcttgggccattattttgaaaatcattttaaaaattttaactcacaaattaactcatacggattatgaatcaataagagtcttacggattgttaacttatggattatgagaagggcaaaattggtattacactgtgtatgctgggtgtattagaaaaagcgctagtgtaggaagttaatcccacatgccattctttaaagaaagaagaaaataaagacttactatccacacctcctaaatgactattcaaaccaccatctttttcaaaaatatgttatttcataaagaaaataatactctaatgtttgacaccttcacaacacaacataaacaagtttttattcagtatatgatgaagatacatgacgaaaacttgtttttattatctcaaccatctacacaacaaaaaattatttatgatgtgttacaaaattgaaatacacaacaaaaataaaaataagtttttgttgtatttctaataaagatatttgttatgtattttgatcaaatataaaatagaaacttgtttcattatgtaggaaattattttctatgttattaactatttaaatttgtttttaaaggagtttaattaaaatagttaatgattaaacatttaatttaataaatataaataaggcaaaaatatagaagaagaaaaaaaattcgcatacgtgcacaaaaccaggttcaacaagaaaacacaaaacataaaatcatttaggcttcttcctcctttgatgtgtgcatcttgctaaagtgcttgcttcaatattcattccatatcctcataggtgccagtgtcaaatgctacttttcgcaaatccaccatggcttaaaaatcatgagctctcaaacaatgcctacataaaaaaatattaataagtacagagtagtcatctatataagaagatataaagatatctaagtgacaatcatgctaatcatttacttgtgtttggatagctagttgcagcagcatgttgataaggcatacttgaagagcctttagctagaggcatgatgtgtatatatatatatatatcatttacttgtgtttggatagctagttgcagcagcatgttgataaggcatacttgaagagcctttagctagaggcatgatgtgtatatatatatatatatatatatatatagcatgttttgtttctgtaattagacctttctcttctcatccactccctctcatcccgatggcttgccgcccttgagagtataactttagatttatgcattaaataaatttattttgttatgttctgatagctatgtgatttccgtattctattcttgcttctcatttatgttgtttgttgtatagtcgctttccccgtcctcgcttccaccccatatggtatcagagcctgatggggaagtaggaatatatggctagatctgagttgtcttttacttttctgagttatcatccagatgtctgtatattctttccctttgtttgtattatgttttcttaaatgaattaaagtacttttatcttttgactggttagcatgataaacggagaaagtttagatctggtattgctggggtagtaagtcccgctgagtttagggcagtaaatcctacaagatattgtaatatgagatctgaacttttgtctgaaaattcattggctatagttgaaagataaacggttaaaaaaaaaaaagaagtctggaatatagctcagaatgtaattttcaacttggatctatcttaatatttttacagaaccaaaggatggcaatgatatcaagggatttattttatgatatttttgtcatgtctctctttcgctccttttcctctcgtttttcgttcaaatcttcccaaccctcatcttcttctttcaatccttcccaagcagaaaatgctttaatcaaatcaaaccgtaatattttcaaagaggaagtttcttttgaagatattaatcaagatctgaatgactggaagatccccaggattccagaaaatgaactttataaacctgaaggaaattatttccgtaaatctgatttcattattcggactgttgagactaacatacgtcttaaatctgattttgatgaaataaaacttctttcaaacggatctttaaaactgcataaacaaaaatatggttttctgcatattggatgtgttcaagttgcagccaaacccttagggatagaaggattaaacacctcaattcttttgtgccttcgagactcccgtcacaatcagtttaccgatttcattctaggcaccgtagaaaccagccttagtaatggaccaatctacttcaactgttatcctgataggaccatcagccttcaggatgccaacatcttagatgttctaaccttagatgtccagctttatggtcttgatatgaaggctggatccatcccagttaatatcatctatcgagttcaatacaaggtaatgaactcgtgtatgtctagagtcctcaaacctaggaagactggagaaactactttgtttctcacagacacaaccaaagctaaggttgtgattccgaaagtcatcaagtgggaagacattaatttccctcagacttgggccatggataaggtagcccctgccaagcctcaaaccacacctagctttgagtctatcaagcaatttgactccggaagggtagagatcaccttcaataggtcaaactccttcaatacggctagatcatcctttactagagattctagatctaagatgtttggatctgtcttttctaggaaatcctgttctactgctcctagtaccagtagtagaatcaagcttcagggagtagaaacctcttcgtccattcctcagcctgtttatcaacaggaaaccaacgaggaagagtctaggtctattccttctccaaccttttcatctatgcaagattatgaagttatccatgattaataaggcctgcatagattataaagcccttaagctagatttcgactctgaggaaatgactcctcaaagagagtggtttcttagccattatagggatgattgtaaagatcaggttagggaagaatattattcctttcttaatcttgttgagtctcaaatcttcttctttgattggtttaagtcttatgcagcttaccataagatagattatcctttcttagagccaaacaccattagtgttatcactaagtatgaccttaaggatggccagatagttagatctgagttccctccgtcgaccaagtttatacttcctaatgtcaggaatgaaaagcatggtcatatttatgcctcacccttcaaatctagggatgaatctgaacccataactcccaaggatatcaagaatcttatggagcaatctaattataccaacagatacctccagtccataggagaaaaattaggagaaaaacctagccatagtctagaagccagtacctctgctcctaaaaccattcaaacccctatcttcaaaccctttagaatgactgataagcttaggaaagagtttgccaaactccgagcttttaatcaaccacctgaagaacctaaggacaagcttgaaggattgacgtctattatcattcaagatactcctcagacatcccaagaagctcattctaggccaacccttactagagccagatctaggcatgaagcccaaaaggacaaagataaggaaatcaatgtccttagccaggcgtctgaaaatggaaactctgactcagatagatctgtccgaatcaaccctattaggaatcagcccaactggaagcaaccttctaagctgtattaccatagggcaaccgctcctgatcttcttttggaggaacggaaaaactccaaatccttcaatgccaaccatgtctatgaatggaatatagatggcaaaacagagtaccagatcctcaatctcctccagcagatgaccatggttgctacagcctatgatacatcccttaactgcacggaagcaattattgtaaatattttagtttccggatttactggacaactaaaaggctggtgggataactacctttctgaggaacacaagattaccatccagaatgctgtcaaaatggaaaatgatggcacaatcctgacccaagatggtaaaccaatccctgactctgtcaaccagctaatcttcaccatagttcagcatttcataggtgattccagcctttggaaagatagatctgccgaactcctttctaatcttaggtgtaagaccttagctgactttagatggtataaggataccttccttacgagagtcttcacccgtgaagacagccaagaatctttctggaaagaaaaatttcttgctggtcttcctaagtccttaggagataaggttagggataagatccgtagtcagcaccctaacaatgagattccctacaagcaattaagttatgatcagcttattgcttacatccagaaggtagccttgaagatttgtcaagatgataagattcaatatcagcttgccaaagaaaaggctcaaaatcacagagatttgagaaatttctgtgaacagtttggcctcccttgctccaaacccaggaagcctaggaagcatacccataattctgataaacagaaaccaagaaaatctgtttatcatcgccataagtctggtaccccacctagaaagcttaggagagaattccagacaaaacctccctttgacaaggtcaacattcctaaaaaacccatagtctgttggacttgtggcaaacccggccataagagtcagtactgtaggcttaagaggaagcttaggaaccttaaccttgaaccctctgttgaataacagattaatcagctcttagtagaatcctcctctgaagaagaatctgataaggatacttctgaaggtcactcttcaaaaaatctgaatcaaattcaagaggatgatttatcttcgactgatgaagactgtccttcttcttcccaggtcaatgtccttacccgagagcaagatcttctttttgaggtgattaattctgtttctgatcccgaagaaaagaaaaatcttttgtttaaacttaaaaaatctttggatgaaccatcttcttcgtcttctaaaactaataatttgttaatcaataataaatttaatcttaaagaaactcttaagaagtttgataaaagtattgttaaaccagtaaccctccaggaccttcagcatgaagttaatcaactgaaagctgagattcgccttattaaggaacaacaaagtgttcatcagaatattttgagtgttctgcaatatggtgatccaactgatgaggaagaacctgttcagaataaccaaccttctgataatgattctccgatgatctagttaatcctgacattcctcccaagatttttgaattaataaaccagttaacaattcaaaaattttatatcaaggtcaagattattgttggaacctttatccttgaaactgaagctctgtttgatacaggggcagattcaaactgcattcaggaaggattaattccaacaaaatattttgaaaaaacttttgagcgacttagtactgctagtagatctaagcttcgcgttaatttcaaactttctgacgctttcatagacaatgatgattttaaagttaaaacctcttttcttttagtcaaaaatcttaaaaattcgattattttggggacaccttttatcaaatccatcttccctataaccatttcagataaaggtatttctacaacttatctgaataaatccattactttcaagtttttaaaagatcatattgttagaaacttgaatcaaatcttttttaagcaaaaccaaattaattatcttaaggaagaaatttcttataagaaaattgatgatttgcttaatcaacccgtcatccagcatcgtatccagtccttgtccaaccaaatccaaaactctatctgtgctgatcttccaaacgctttttggcaaagaaaacagcacattgttgatcttccttatgaaaaagatttcaatgatcgacaaatccctactaaggccagacccatccagatgagtcaggaactcctcgtccattgccagaaggaaatccaagacctcctacaaaacggattaatcagaaaaagcaagagtccttggtcttgttctgctttttatgtcaacaaaccagctaaaattgagtggggatctcctcgtttggtcatcaactacaaacagctcaaccaagcgcttcagtggatccgttatccgattccgaacaaaaaggatcttctcaattgtcatttttccactaaaatcttttcaaaatttgatatgaaatctggattttggcaaattcaaatcagtgaaagggattgttataaaacggcttttacggtcccttttggacaatatgagtggagagtcatgccttttggattaaaaaatgctccttcagaattccagaaaattatgaatgacatttttaatccttacacttccttcatcattgtctatatagatgatgtccttgttttctctcaatctgttgatcaacatttcaaacatattaacatttttatccaggtaatcaagaaaaatggtcttgctttatctaaaactaaaattaatctttttcaaacaaaaattcgctttcttggtcacaacatctatcagggcacaatcacttctattaatcgtgcgatagagttttcatccaagttcccagatcaaataatcgaaaagtcccaactccaacgttttcttggttgtttaaattatgtggctgatttctttcctcagttaagtaatctagccaaacccctctatgaccgtctcaagaaaactcctcctccgtggactaatgttcacactgatctggtcaaacaaattaaatctcaggtcaaaaatcttccgtgtctttaccttcccaatccttcagctaaaaagattgttgaaactgatgcctctgacattggttatggtggcattcttaagcagtctgttaatggcaaagaacaaataattgcattcacttcaaaacattggaatcctgctcagcagaattattccacagttaaaaaggaagttttagcaattgttttgtgcatatcaaaatttcaatctgatttgcttaatcaaaggtttttagtttgtgttgattgtaagtctgcaaaagagattttacaaaaggatgttaaaaaccttgcatcaaaataaatttttgccagatggcaagctattttgagtatctttgattttgatatagaattcctcaaaggtaccttaaactctctacctgattatctcactcgtgaatatttacaggggagaaaccagcagtagtagtcccatgccaagatccgaaaaatcatcttcctcctcacgaggaagaggaaaaggcagaaccaccaccaaaccaaggctagctgtggctggcttaatcgcccatgcagggcatggatcttcagttaaacaagaagaagactccaacaaacaatcaaaatctgggtcatctacccagtctgggtcattaacccggaaactacctcaatctattactgggtcatccacccagaaatctgaaccccaaactgtttctggaccatccactcagaagcctaaacctctctctcaaataagagaagactatgccatgccaatccaagtccttttggaccttcaagaacagggtcttacccacctcccaaaaggcctcccatctagaacatgggcagacatcacctctgaagaagaagaaggagaaagatgggtggcaaccttaatcaaaaacatggcagagacccccctagtcctccatcaaccaaaaggcaaagccatagttcaatagcctgaacccttggcaacccagaggcctaaatcccaaacacaatacgtcccaaaaacaagtatcaggatgtcattcagatggagcctgagttttgggactcaaaaccaaccaaagtcctccagaaaatctttcccaaagatattcagggtaatcaataccatttcaaacctgcctccttgctcaagactagacatttttatgagtttatcctggtagacaccaactcagtccagattaagcatcataagaataaagactctgagcaaattgcttattcaactctgcaaatccttaaggttatgacaccaaaagaatttggagaattgaataaaattaaaaaattttctcaaaactatgatcccatgggtttttcttattgggattatcaatctgcctggtataatgtctttaatttccaaaataaagactttatgcattcgtggctcatctatttcaaacaaaatgtccagtacaagtttccccagtggtttttgcaatggtggaatttctatggaccaatccttgagatacttccttctgaggtagtatctggtctcacaatctttacgaagaagttcgagcaccccgacagtgatccatttccggtagacctccacttcttcagcaaactgtctctcgcctggatcttccaatggcgatatgtctacagcaacgtttcagtcaaaggacaactgccaatgcttcgcaggcaagctcttgtcaagtggtggccccagtttgaccattcaagagctaatcccgaacaggtatcactctggttcaaacaacacccgaccctaaccagagcagcagacccggaagcatgcaagttcctcaaccagagatcacaggtcatagcagccttggcatcctccacatccaaggagaagttcaaggaaaacatgaagatgatcatcaatctgttggaaaaggagaatgaagatgcctgctcctcctccaagaagcaatctaaggagcccgccgaagactcttcagaatcgtcggacgatttctacaggaatgaagacgactgtttcggcatcaaccttgatgatgactaaatctagctaggtcaccatcctaaacagcaaagcagaagggtaagtggagaaagctccttttgcttaaatcagcatgacatcagcatttcctgcggcagactactgttcagtattgttcactgtagcggtaggttttccggtttttgtcaccggaactatagaaacaggaaaatgttgtatctatttaagggctgcgtcccgcaatccgtaaacatgtttttctttcctagttttctttcctcagagtgttcttcctaggtacacctctgagcccagagttcaattatctaatctttctgtaatctttttgagtaaataaaatctttatttcgtcatattgcatgttttgtttctgtaattagacctttctcttctcatccactccctctcatcccgatggcttgccgcgcttgagagtataactttagatttatgcattaaataaatttattttgttatgttctgatagccatgtgaattccgtattctattcctgcttctcatttatgttgtttgttgtatattcgctttccccgtcctcgcttccaccccatatggtatatatatatacaaaaatataaattttttatacatgttttaaaatatttaaaaaaaatcacaaattaatataatttcataaataattagatatcaaaatgtaaaaaaaaaaaaatcattatccaagttcaaacaaataagtaacaaagatcataaacataagctaaataagtttaagtttaacatatgttcctaaacaagttcaacacttcaagtgttttacggccaaggggcataaactaaaaacacaaaaatagtggatgtcccgtaatgtggaagcatcctgttaaggcaacaaaagccccacaaaaaaaacaagtgaatgcaacgtgacgcgattgttctgctcagacgaacaaggtgtaagcgttgcggacgaacaagacggaaggagctcagatgaaggttgcacaaaattggaaggaactttggaactgctaggcacagttgaagagagtcaggtaattttgaaaacctagtggagaaacgatgttgttcatgtgtctatagcgttttttataatagcgacccggtccggttgacgagtcgtcggtttgaccaccgatccagtctggatttattgacagacttgacccaatccagccatcgagtctcggtccgaccagtttgacctgatgggtcgatccagtttttaaaacaccactcatagggaacccttaggcgcaagcggtactcgaagcagaggagtaatgtagtcaggctagtactactactagaattgagcaaacaggctttggggtccatagttcatttgcaaactcgtatatataagtgtccttttagaattaatttaaaatgcaagcattttagcccagtttattcactcgcatgttaaacaggttttacttgtaggctttttaaaatttaatatacaatatataaactaataaataaggggcataaattgagaaaaaaatatttttaaaaaaatatagaatttaagtactatatatatgattcaatgataaatgatgataattttgatttagtatagacttatagattaaataaatatgatatagaaaaatactttttaggtggcttaagatacaaattatattatcattttggataaataattttttttatttgataattcataattagtttttaaaattgtttaaaatggatccaactttacattttaaaatttaattttttactttttattttttttctaatgtgggttagcctgctaatcccgtggactatgtagggtaagtacgagcttgctaaaattgagtatgtttggaatgcagacttcgcatgacaggcttcgtggttacaggttttataggcggacttagccatgcccaactctagttattagtatcatagttataaaactcggttcagaacggtcaatcagatcgatctaaccgggatctggtgatacaatcgaatcgagtacaccatcaaatcgctcaagcaagtgacccgggataactataatgaccctgaggcctgacgcggatagcgcgggtttcgcgtggatagcgccagggttcttctacaaaaaaatccagtgcagaggtgtggcgctggtagcgctggtgtggcgcgatcagcgccatgctcactgggttgtggcacggatggcgccaagatggcgcgagaggcgctagacctactggaggatgacgccagtggcgccatggtggcgcgggtagcaccacaggttctgaaggtcaacgcttgtagggccaaagtggcgctggtggcgccagaaaactctggagacctgtccatccctggaggttggcgcgggtggcgccgtggtggcgcggttggcgctgtggtggcgtggttggcaccatagtttctggaggttggcgctgttggcgtgggattggcgcagatggcgccatggtttttggcagctggcgcgatcgacgcgatagctctgacaggaccactataaaagggggaagtcgcgattttggagagaaaaaccttcctttctcctttccccagtgccccacctccattgttgaagctccaagcttcatttcttcaccatagttcaccaaatcacttccttaatacaccaatcttgctagaaacacttggtgagcttgaatccttcatcaaattccccttagaaaccccaaatttgagaatccctttctcaaggaaagttcatagaactcgagttcgtcgaggaacggcggcgattcgtggacacccgagcttggggaagtcgtccttgggccttccttgtcatcattgaggtaagaaactcgagattcaccagttgatttgtgagttggggttttgggtgaatagtgacccacttgtgatagagctagtattaggcttgggtcctttagaaacatgtgtttagaatgttgtgaggatgaaggattagctctcaaatgttaatttggtgaactttgcttcttggctctatataatgcatgtttagttggtatgctgagttgcttggctatgttgtgacatgcaagagccttggtatatggtttttgatatgctcaaaaggcttttggaacggtgtcttgtgtgtgaaaagaaccgttcaagccatatgtgaatccttgagcctttggtccgtatagagcttcgagctcttaatgttggcttgaaccgagttctgtgatgactcaagtgcattgtgggcatgagatagaccactaagggtccatgagatggcttgtgagtgatgagccttgatgaaccttaagttagaggacttagaggttttggaaaagaatgaggtacctttctttgagacggttgagaaccgtgttattatgcttatgccttgtgtggttgaattggctttgatatgagcttgtgtgccttgtatagggcgtgacaccgagggtgtcagtagtgtaaaccacagagcagggaaagaactgtagagctcagctttgctagataagttcttggtcccttggggatgtttcccacttgttgtgttccaccacactctgagggagtgatggttgcattcatgatgcattcattaatggttgttgcatcctcataatgatatgtatgcttgtatctatgcttgtatatgtatgatgcctgttgatagatcttctggccagttagatagatatggacctccctaggagaagagtgcacctcctagtttggtttgctcatggttgatgatatcccagggtgatgatgatccccttaaaaccaagagataggtggtcccgtcgcggttgaagcctattctcggaggtaccatatacgtgcgtccatgcgtaaggggtagctcccgatgggatggcacgggtgtgagttccgatctcacactgaggttggtgttgatgtttatccaccgtacatagagcaagatgacttgcttgtattgttatgagggccgggtggccagtatgtatgtgatgcctggtgacttgtgtcatggaaagtgagccatggtggaggagatgcctccaaggaccctgagcttactgggatgtatatctcaccccgtgtggggcttatgttgtttcagctgactcttctggcagagaggagcggtcttagggcgggaggccctagtagagataggatctgcttggctgtgtggcagcagagagagctgggaggctcagtgatgttttgatgttgttttgtacccctgtagagggaagacgtgtgtgtgtgtgtacacatgtattccttttgtatttgtatatgttatgtatgccctcgtgtgaggaaggatcttagagatcaaaagcactcggatgcttattcttttgtatagacacttcgagtgtcagatggtgtatatgtacataaccagcttatgttatgtaatgatgtttcctcctatttctatctattgagacatttatgtttatctgcctttggttttgtgaatctggatcagcaggggcttgtcttgttttgtgatgagatgttttatgttccatacataatataatcaagaaatatggttttcgattatgcttccacaaagtttttaattaaagtgattaagcgctattctgataaataataatgttaatactccgggtgcacacggggtgttataataacccgatcaaacccgatcggttttgatgaaaaccggtgacctttccgatttttaaaacctgaattgggttgtgccaccgttgaattgtgaggtaacttgccgcgtcggcctcgcctctgataacgcggacgaagaggaagcgaaagaaaggaagaggaagaccaagcatagaagtggaagaggcggtcagagggtgttgttacgttaaggtaatggaccgcttgctcttgttcatcaaaaggcaggctaagacggtaaaaagacattcgttcttccctcttttccgacccatgttgcttatttgacattccatacataggcgaaaggaacttgcagtgatgccttttgggttgtggtgtaagtcaattgctttttgggcatttagaccaagcattgaagtggaagatgaaaattgcaaagtgaggcatagccgcagtgccgcaacaacgagagaaatgaggttgaaatggaagagagggttatataggattagggtttttcattttgggccaccagattcataaagggcataaacagatttgcttcctgcactcctttattgcttactgcactccttctggctttttaattaaaaactaaacttgtattttaatttaagtagttgctatttacaatcttttttattaatacactttacttgtgttatcaactttaatacttcaattattattttgaatcttttagtatacttttcttaatcaaataatattagttatatacttatatataatataattttaaaatttttgatatagatcgaaccaaattatattaattactgacccaccaattgaaccactgactcactacttcaatcgggttaataatttggccgaattttataagtatgattaatattcatcaactgccatgttaaagggcacatgccctgccataaaatgaaggtatcaaggaatcccctatatgtgaccaaattgacatacgactatctggtagatatgcacaaaagtggggaacagtgcccaaagtgccacgttttttttaaaaaaaaacccataatgccacgcctacaatagtgtttgccaaaatgccacatggcataattcatggctctgcacgcgaaattggtgggctgacgtggcgttacgctattaggacacgtaattcgctatacgtatcagcgaattatgtggtctggacaggcgaatttcgggcaggacacgtgtcagggagggagtagtttgcttggtaggctagcaaattacgtgggttctgacaaagcatgacacgtggcaagtttgaggcacaatgtgtataaacttcgaacggtcataacttttgactggaatgtccgatggaggcatatgatatgtcaaaacgctcaaaattcagtcctttagccttgggcaaattccaaaggagattttgtcaaatattttttccaaaaaaggcctctaagtgcctgaaaattaggatttaggattcaatcatctaaaaatttccaaatcgtctacttttttaattatttaattagttaatttaatgcaattttatatttttttaattacttctctcaattacgatcgttttgacataaagtacgtctccatcgaacattcctaacaaaaaaatatcattgttcgaagtttatattcactatcaattttacaagcgaggtagggttaaaggagaggggggtttatatagcggtggaccagttgtacctaattcgttgggctcactagcgaattacctatttcgctgctgctccttgtgaaatttgccacctgtgttgaccgctttgcccgtccaatagaagcatgccacgtcacgtcacgtactttgcccacgtgcgcaacaaaatatgtcgcgtggcattttggaaaattgttttttggacgtgacattttggacaaattttttttaaattgtggcactttggccattgttcccaaaagtagttgccaagtcaaaggaagccagaaaagtatgacatctcgtgaaacacatacaactatttatgatcctcaaatgacgtcaaatgacatcatctagttggagagagtacacgatctccctcgaggactcaaaatgtccaaatcccttgacttccatctttgtgttcagtgtatgttttgtctgcctcattgcctatcgacagtagaaaaatcctcaaactcctatgcgtactaagcatattaacataaatatctatagtaaaacaaaacaaaaaactagaattgcgaaacaaaataatgtacaaaatttttacttgaataagggctatacatctaaaaattggtgagtgtttgcatgctagtatcacttagctgcttgtacattaaacatagggttgattttgtttttcaattggcaaacgttaatgttaatttttatcagtgaaaatgattgaactttcgacttttccttctttttttcttcttaatcatctatcccaccttttatatcctacattaaacagaaggtagtaaccccctatgcatatcagctacacatcagctaagatcttaaatgaccaacaagtggcaagtaccgactaatgcataggatgagctcctctagctaatatcaagcaacaaacagctatacaaggtaagcatgtgttgcatagatcgtctctcctactaccaactgctactcatataagttgctcagttaggagaaggttgcacgtaagccgcccttggaggtagctgactctaattaatgattataacatcttattacattttatgattattattgttattacattttattcacaatttttctcgcaataagaaatacataaaaagatagaggatgttacaatgactatagacactcgtagatataaccatatatcgataagttttgtaggtatatgcttaagaaataccaatggcaagtatgagataaacataggacacatttttatcttaaagggtgggtgatttgggactactacttgtacgtgtcccacctcattatgatccttattactatttttagacataatatttttggaaatataattcctaagaactcaatattaaatatttaaaaatctctctctaaaaacaatcagataataataatatatatatatatatatatatataaaagtaaaattcttgccaaaagaagcaactactcaaatattaataatttgaatgatagtttgtgatgatattgataagatgaaaattaacaaatgaagaaaagattaaacattctaaaattgattaaaataaaaattaattaaagattaaaaattgcaatttcagtttttggggactaaaatcaaagaataaaaattgaaaggtgaaaatcttgtaggcattaaaacctaaattttaaaatttattatataaaaactaaaaaatatttcaaaaaattatatcagataatacatttatgtgataatacaatataaaatgaggttgtcatatgacatttatgtcacatgactctcatgtgtcatgttaacatgaatttttatttgacatcaatatttaacaatgttattttaacatcatggattaaaaatactgataaaaagttaacgagggattcaaatttgtcaaactttttcataaagaaaactgtcagtttttttaaaagaacctaaaaatcgaaataatttaacgactaaaagcttatttaatgttataaaaaattatatataaattaaacactttcaaaaccatacctaagaaaaaataaattctttaacgcgttaactcaccagaatcaacaaactacttactgtgccaaagtacatagagtcgtttctgaaagaaatgcatgtgagaccatcatatcatctaaaaatatactttcgtacgtcttcataagtgacaattaatttgaattctgaaagtgtataggtaatataatcaatttaacgataaatggttcgtgttaattatattgaccaaatgcaaacataaagaaatcaaatcaacacatgtaaaagtgatcaaaatgacattatttttaccaatgtgttgtggttcaattgaaacatagatttggatttcttgaataagatttgaagtatgagcctcataattttattttttttataaaaaaacatgcttggaaaggaaaaataaatataaaactttgtatcaataatcttataacaaaattgaaagatatgttgcaacaagaacataataacaccaaaaaaatgaccttaattattttgttttattttcaccgaaatatttatatgattttatatacatacctaatttactttttttttttactaagagtgtttattaattagttggttgaataatatatatgaattattataattttttgtattgtaagttcaatttttatgaataaaaatacattttccttttacttttttctgggtatttactaatgtgagtaactcatgaatgtgatcagactgaacacgtaataccttattcatgtgatcaatctataaaattttaatcggctaacaagttctattatttttaatctgatcaatccataacatataattagatttattattattattgttattattgttattattattattattattaataattattaaatataaaaacattaatttttagctaacatattttattaaattattaaattaaattaatcataatttttttcttttcaagttattatttttatctttattttaattttgtttatcttttctcatatcaataaattattttatttctatctaaaagatattatattaacattgaaatcattaattttattagtcaaatattatcaaaatttaatctcttttaaatataattaattgttatatacttataaaattttatataaaaataaattattattttaaaaaaataattttataaaataaaaaatattctttaaatattcaagtccaattattcaaactcgatccatttcaattattatcaagttaatttgaattaaatctattaataaaataatacaacccaatccaataagtttagcgaaattcaatcggtaaacacctataaattgttttatctttcttatctaaacctaacataccacaccacttcatttctgcctaaacaatcataggagaatatggatgttcatcaaccgatccaaaccgattcaaaccgcggtgaccgaatcgataaccgaaataaccaaaaattgaaaaaacgaaaaccgaaaaaaaattgaaaattttcatcggattggatcggttttcgaattggctggtaaaaatcgatccaatccaaaccgatccaattacctacttaggctttttagtattacatttaagttacgagttcaatttgaaaattagaaaattgtgtttgtttttgtccaatgaacatgtttgcaataaggtttcattgctctttattttgttcaatgaacgtgtttgtctaatgaaaattaaaaaatggtgtttgcttttgtccaataaatgtgtttgtttatgctatatactctttattttgataaaaataagtctctaagttttatttttaaacattttaaaaaactgaaaaccgatccaatccaaaccgaaaaaaattgaattgaattggatcggatttaaaaaaagttcaaatcaaatagatagtcaaatgatcaaattgaagagattggatcgaataattttttattttaaaactgattcaatccaaaccgcaaatagcctagaggagaagacgaaatgtatactagtaccatcaattcaattatcaagttgattttttatatttttgagagccacgttgcaatttgcaatggctgtctgggttcgcaagtgaagggagcgcacgtgcaaggggcagcaggggtagtggctgaccgcgatgcacgggcagctgttgtgggtccgcacgacaaggacaggtgaatagaagcgccagcaagaccatgtgtcaggtgggtcccactttgatggttattgtcgccttctcgttcattgtgggtcccttgccccgtcagctccatgtttgcttttttcaactttttttccttctctctctgtcatcgctatttcatttcattgtataaaaattattattattattcaaaagaaatgaaaaaagtgaatctttttaatataaataaaaatattaggaaaatttttatgcttttcttaatatatatatttattcattaaatcttattttaaaaaataaaactcacaaattaataataaaatgttaaacaatgacctttgtattactaatattcttttaagcacaaattctctttatattgaaggtgaaatgacctttctcatatccacggcttttaaagactctaattaacatttattttgttttaattttgaaaataattaaataaaaggtttatactttatagtgagccgaacattgcatgaaagacattaaattggatacgtaacgagaactatttatcaataataacattaataccttatttgaataaataattgcaatggttagttattcttagcgctataaatgatacttttttgggtatcatttatttatattagggtatcaatactcttagcaactaatgattatatttcttaataaaagcaactaatgattacttaaatacatgacccactaatttgatttaaaaaataaaatttattatatattatattttgatagaaaagcacataatttaatatcataatgttatctatcgaaaaaatgttaatgttttttttataaaagtgttgatagttatcacaaaagagaaagatgacggacgaacttttttaataaaaatattcacttatttagcatattataaaattaaggaaaattataaattagttactttattatttatataaagcatagattatcattttggtatgtaaaaattatattacttttaaacaaaaatctttttatgtaagtagtgcccgtatatttcaatcacaatacaaatctatttatatcaaaaattaaaagtgtttccttttttggaaaattcaccattcccactatcaaatttctcttacattattttataattgttctagaattgtgggaagtgacgggctgggtaaagcaacagccataagtggtagctggggccatgcacagcatacacatcatgagtttgtttgattttgatgcgatgggagtgacacaattacctctatgccctttcacttacatgaatttctgaactttttttgggaagcaaaaacgtttcctataatactagtattataaaacgtcaaaaaaatttcatgcgcattttcatttcaaaatgtatgtaactcctgtattatgcttattgtaattagaaataatatgaatagaagagttaattgataaattatatgttaaaaatacaaattaaaaaaattcaagcatacgtcactttttaaaactccataagattaaaacaatgatacaagaatgtgtttacacgtgaatggatgatatatttaataaaaaattgatatttaattattattattattatttattaaattttattaaaccaataataattatgaaaatgagaatgaaatcaatttttaattcaataaattacaagatccttgtaatctttaatctagaaaaaaaaatacgccatttccttttgaattaaccctctaatataaccatgtgtcatatctagagcatagacctcacatgcaacttgtatcttaggaagacataccaagcaaaagaaagattctcatttcatagttcatgagacatttgctatgacatacaaaatcttaaaatttgatcatcctggttgtggcttttaattacttgacatcgcatcatttcccaagtgccacgttctgttcattccagcaagaacagtatcgacaaatagttaaaaaatgttgaatataaaattaaaaggattcccttgctcaaggaacagtccaagtgaagagaacctggttgaagacatgatttatttatttatctttcttttttggtctttttgccattagtcgagacatgattcaattagagagtgaaaaagcaacccattaaggagtgtagtacaaatcctcaacagggaaatgaccaaattttaaaaaggttattttaaagtggaaaggtctttttgggaaaagtacatgtagtgcaagaaactggtcccaaagatttcgagtttcaacttcatgacgtccaaaaaccaccattgcttttttatatttatttatttttaattaatatgtggcccatcattcaaatgggggctattctggtacaccaattgcacgcgctcggacggtccctaccaatcaagttctctatctaacacatcacacatgattgattttattgtattgatcaaaattatttaacgtgaattgttaatttagttaataataataaaattatgttaattataattttttaaattatttttatcagctaaaatttttcttcttctaataatttatcaatatttttaataaagagtatttatattttaaaaataattaatacaagaaatattataaattaaattttataataaataaataaatatcattttaaatttgagtcttataaataaaattataagaaatattaatttttttagagaatatcaattaaaaagatatcttaaaaataattaaaaaattattgtaatattgtttattatttttaattatatttaatagaatataccacaaagaatatcctgatttataatagatttattttttaaattacttttaattccaaaaaatagaaatattttttttgtcacaatgacattagtgtaagaatatatacctattttattcatgattaatatccgttgacgaatctgagatcatcattaatgaaattttttttcttaatcacattttttatcaacaaaactcaaattcgatatattatttaagaaaatcaagtttaatatcactcaaactaatgacttattggtaaaaaaatagaaataatagttatatttttaaaagaaaaaacatgttaattataataacgtaaactatttataatgacaataaatggtaaaattaagtgaaaacagctatatatatgtaaatggatgaattgtttatctataaaaaataattttgcaaaaaaagaagagagagaacataatttaaaaaaattgacgctcttgtcattttaaaacaacaccaaaatgaaatacctattattaaagcatagaaaataactattaaaaaaattagatgttaaaaatttcttacggaaagctatttctttatactaaaacaaatataagtagataataatataattgaagtaatatttatatttttaaaagaaaaaacttaaaaacagaaaaccctatgaatttagaagtggaccagtatctaaaggttttttttttttgcaacttaaagaaacttcaagaaggttattaacatttctgtaagaacagaaaaatacaaaataggcctaagaagctaaagtataatataattatataaacatagtattaatataatattaaaatctcatgattggtgaagagcaggagcatactctgcaatgtgctctaccttatataatctagtgcatgtgaacttcattatataatagccatttttctaaggttccattccctgcatttttctagctccttcttctctaaacactcatctatgactacctttccctcccctccttcaccatcatcttcttcaattccttctccaagatctagcatgttttactatgctggaagtgaagatcactatgaggagcctcacttcctccaagcttgttttctctgcagaaaactactcggccaaaaccgtgacatcttcatgtacaggtattagctcaattttaattcaattcatatcactcaaaccactttcatctgtttatgagccacctagtggtaccccaggttctgattcttgttgatttgatcaactttttatgttaaaaaataaattacactgaattttcatatggggcataagaagttttgttttctttttgtatgttctataccttagttttttcagatctagaataaagttacataattctttgattagttgaagaattttgttgattttttttctctattattgtctgaattaatttttttaacattttattgttatgaatattcatttattttggttgatgattaactttatagaaaaatttgattaattatttttaatgagattccctcctttcaataacgtttttcttcatttacataactagaaactaaaaccttgtttaaagaaattcggtttagtatcacttgaacttaataccttattggtattgtctagattaaccatgtgtgattcatgtagtctattttatttattcattgtgtgatccatatagtaaatttcaattaatgaaaaagaaagatttattattgtattctggattaattgaaaacttgatctaattgtttagatttctaatttctaataagtattttggaattgttgctatgcagagggaacacaccattttgtagcaaagagtgcagacaggaacaaatagagattgatgagtcaaaggagaaaagttggaagctttcttccaaaaggggtgtgagacaatcagagacaaatcaaaattccacacccaataaggctgtaagaacaggcacagttgcagtggcctaatcaaagaataatccatgacatgatgatgagtgggaaagtgtccaatttttgaagaaaaaaaaagatggaatattggaatggaaaaaattccaaatgaagaagtgcaatcatcaataatccatgaagattctgataacccgggatgaatcttcaattcgccgcctttgtaaagaaaaaagttgggttttccagtgggagagcaaaaaaaaacaaagaattttggctccttttgtttctgtttttgataatattgatttgacctttccttatcactattttactctacctgctttgagtgttctataagaaaacaacatggatattcatattaagatgccgttttgttttcctgaaaatcgaggcaatggaaaaaagtatcaaagacacttcatcgaagatctagatgagtggaaactgttatggtcttccaacatcatgtgttgattatgcaaaaatttgttttcctttcaataaaaatatcccttagtcactaaaaattcattctcatagcaactcaaaatctcaattgaaccaacatgtagttgtccaaataggaagagtttggatccttaaacaggtaggttcagatttttggttacagggtaactttaaattagatttgcaaattgggaattctagcatatgaaaaaaatattaattgaaagtgtgtcaaattttgcatctttattttcaccataaattcttagaaaccaaaatatatctctcaatttagaaattcttgcattcatccaacccaaagctttatattcacaaattgaaaataataagtttgagtttaatatgaatctttatttattcgaaagaaataatttatttaatttatgcttacaaataacttgtttcaaatcattaactccaagtacagaaatcagtgaaggttaggttggattttttttttgttggaaaaaaatgattttagtccctatatttttactttttcttgtttttaattcctaaagtttcgtatcatccaatttagtccttatattttattaaaaacatgtacttttacaataactaaattaaacaatatagaactccagagactaaaatcaagaaaaacggaagtaaacaagaaaaacggaagtataaagacaaaatatatttatcctcttttttttatactttaggtgagtttgggttgaaggaatgaaaaaggtgtgaaaataaattgagatgaaatatttgaattaaagtaaaggtgtgtgactcaccaatttttaaaattttcatctcaaataaatcaaccaaatactaaattaaatactaaaatatttaacttctgacaaataaatatttaataaacaatgaattttataaatttatttattatttttacacataaaactaaaatttatttttattcaaatgatataaggaggaagcagtgtacttataattcatactaatttttatataatgaagtattttaactgacttttatacttaaagttattttaaattataaatatgttacatattatttgtttatttattttcttatttattaatttcatacaaaaaaaataatatgaagtataactagaaaattaattaaatgaatttaataatataaaatatattattgagaactaacaaattaatttggtttctagtcttctatcaactcaaaataagtaatatatacagaagcaaaaaaaaaaaaaaagtgaaggggagaaagcagaaggaaaaaaaacactaaatttttatgtggaaaaccttcatattataagaagataaaatcatgggacctagtctagtaaaaacaattcactatgaaaatagaattacaaaatttgttttgctttcctaagaggatcactaataaatctctccctctttgatggaatacacaaactctcgtgcttctcaccaacaaaagtaaaaatatcactctaattaaaatttttgggatgagatacttaaactcttctcaggccctccctttacatagtgaagggatataactccattaatgaatttaacttttcataagaaagtgaatattaatttttcatcatctaagtacattaaccacctaaattgtagtgcggtcctcaaatattacacatcttggtatacaaatgattaattaccacttgtttatggtactttatcaattaggaaggaattccaacaaatgtcttcattattggcttaatttgtcatgcactactatacaaacatcttgacagtaattttcaaccttcttagtttgcatcgaattagtaattatattagaccaactaaaatttatatgtatctttcttaatcttcaatttctttccatctaatgcttctcatgtccaatgatatctaatgtcaatatgttccaagcattggaagtatgaaacatgaggttcttgtctaaataaatggtattttgattatcgtagatcaccacataatcattttgatgtcctaacacactaaagaagttcttcatcatagtatctcttttcaagcttctgttacaataatatatttcttcaatggttgacaatgtaacacacttttggagtttaagttcccaagaaacaacttccctacaaacctgatgtagactttcttcaatccacatcacttgcaatatctacatatgcacattcaatgagcattaaatttcaattgccaaaacataagatcttttaccagttcttctagaataccttaatatccatttcatagcttccaatgctctttttttgggttctataggaattttttcacaactcttatgacataagcaacaattggccttgtacaagtcattacatatataagactccccatagtagatgaataaggtacctcgttcagttctactttcacttctacattctttggacattgaggcttagtttgaaaggtccaactaatggaacaattgtgcatattggatctttcaagaatttttgtcaatataatcttctgaagatatccacaacattcttctaaaactatgtatctctattgatcttcaatcttagaatcttctttattgcacccaaatctttcttgccaaaaaatttgttgaatgccttttttaaaataattagacttaaatttattttaagtttatgataaattaacaattcttatttaagtccttcataaattatcgtttttcttcctctcccaagtaaacctccatgaccacctctcccccaaacctccataaacactgcacccctcctccacccaacatcaccatcgtccaccgcaaccacccaacgccaattccacattgcaccaaacccaccattatgccaccacccaccaatgtcacacacatcaaaaattaattaatccgtagtatacaaaaatgtagtattgattgaataatttgtatttcatttgtattatagttactcaataaataatacatttgtatgtattattgattgagtaatttgtagtacgcataattttatcctttggcatcgttctcgaccttgacgactacctctccaagctcctctgactcaagtcgatagtcaacttccttatgctcttcaagcacaactgtgaagtcaatgacattgccgacaacaatactagatcacatgttctcgtcgtgtgtttagaccatgcttacttcctttttcgctcctactgagtcctatgttggtgctctcataggacaggctctattcgatgatggtgtcacttgtgatgaagagaaagatggaaagaagaagagagtgtacaacatcagaagggtaaaatggaaactttacaaatttgggggtgcattaaataatttcccaccaaaattcttacttgaaaaccttctcaacttgatcaagaaaaaattgtgggacctaatctagtaaatgagtctattttcttaatttttttttaaaaaaaattgtaagaaatgtcggagccaatatcttttttatatgtctttaataaatgcatctaaaattagattaaataagtaacaactaaaaactaaaccttgatataaacctatcaaaaagcgtgaatatacaaaacaaaataattccccaccaagattaggacgtgataattaataacacattaaaattggatctgaccaactaactcagaaaacgagtcaatgattctatactcaccggatccaggcagagggtgaacgcagttgaaaagaggtggcgttgatttggttgaccaatattatttttaaggatcgttgacccaatttttaatgcgtgcatgtaaatttagcagtagggaacaaaaagaaaaagtgacaggtcatttaattttataaaatgtttttataggtgtcaattattaattcaagttgatgaagctgcttacctaataaatattatagtcaatgaggtatagcgtgtaagcttcttaacgatgaatgcttaacaatggcatagtaagtcacagaaacgtaggaaacaataaattcattttaacttgacatctgttcatatgatagagagatatgatcagtgcccaaatgattaatatattataggaggaagttgtcaatttatcatgaaattgaccgttgatgaaaatacatcatggtttcaaaatctgatcatgtgtttaatcatttattaaactgtagtcagttttggtttcacgttcaattattgttaaataaattttaagaatctaattggaatgtaacctcgacataaaggtttatatttttttttttacaattaaaagcttagattatttttttaggaaataaaagtttaaattattattcgatcatatattaacatgtatgaaaaaaaataatttttaggctaaaatgttgatccatctattttctaaatcctttatttgagtatttctattttttaattgagacattttatttttcattttttaaaaatttacaattttagtatcttattttttaattaaaatattttgtttttcactttaaaaaaattcatgattttaatcctattgcaaatttcaaatattatacgtgtgtttcgtaaaaaaaaaggaaaaggacattcaggatttaatttaattgtatgtaaatataaattaatgaatcctatatatatatatattaataatatgaatattttaagagtttatttgaatacaaggttagaagtatttttaagagtttttttattaattttttttatattttccataaaaaagatttaaaaaatacttataacttatatccaaacatgtcctaaataaaaaataagtttgcaatataaaatgttattcccatttcgctctctctttttgtccaacttggaggaaagataaagttagcaagggatatgaaacttttctttcattaatcgttcctctagtacccggtgaaagaaacaaaccataaattcgttcatctatcaaattactctttaaagttcttcaaataaatactaatttgtcgcgagaattacacgttcaagaatcggcataattcaatttagttaggaactaatatggttaacgttttgactttttttcattgttttttttttaaacactattatatgctcttcaaacttggtcaaaaaaatgatatgctcttcaaacaagtagatctgcccattttgcttatatgcccctggctggattaatcgaacttattctcaacattacaataacaaataaaccgtgtccgtgctagtagttgtgaaatctattgaactgaatgtgatataaagagaacaagttatgatggatcaaatacttttgaaaagaaaaagaaaaaatttttgacaagctatataccatagaatcactttctagtttctatattaacaatacaaaggtcactaatatatttatatctctcattcatatcaaacaaaaatatatggccactcaaaagatcattagcaatgtagtgctgttagtgttctccattctatacatcaaccacatagaactttgcctgctttgtctatccatcatcgttggccgagaatgagagaaattattaaatggtctggaactatgtggtctcgatgaatctatacgtgacatatagccacattcttcaatttatgaaaaaaagttaatagcatatcatgtaaagattgaccaagaccacatagacccatataacaatttctcctaggatggacctagttcacagttagttacaccgaggccaaacgaaattttgctagggatgtaactatgaagacacattggctctctgaaggatcataaatcttcttctactagcactctccacactttcaccaagttttgcaagatgttccatcctctttctccataactctgtagaacctgattgatttgccttatcttcagcttcaactggatcattttcagatacctcgatacttttatcatctgcaggctgctgctcttcatcagaatctaggattatctgcttcaatctctctaccacctgactcattgatggccgatctttcgcactcttacacaggcaatgctctgcaagtttggctattttttgtgctcctttaatggaatattctccttgaagtcgcggatccattatcatgtcaaaccttttgctgtcaggaggatattgcttcacccactccagtagtttcttctccgtttccggcctgtttctttccattgaacacctgccagtaagtatttcatatagcaccaccccaaaactccacacatcactcttggcagtgagatggcctgtctcaatgtaatctggggcagcataaccatatgtccccatcacctatcataaaaataaataaaaaattacattaactcagaataatcttgatgatcatgtatttaaactttaaagttttgtgttttttggattatatttggtaagtcatatgtgtagctacataagatatttggtgtgacatgacattgattgagaaaaaatgacctaaattggttaaggtggttttggacatgcacaaaggtcactagaaacacctgtatggatagtagattgcatggttcttaaacttatgaaaagggggagagaaagatcaaggacatcagagaaaattattaagagggatcttatggtgaataatatctgagaatttaatttttagttgagctcaatgacgttatgtgatccatataactgacttcacctattatgacaaagctttagttgtatatttggttaagtcatatttattagtaaaattaagtttagaatctatgcagaagaatatttatgtagtaaacatgggaagctctgtcaccaacaatagtggtatcaataaagtttgtaatttgaaatgaaattatatccacagaaaaatccaacatgatagtctccagtaccaaaattccctgagatcaaccaataaaatataccaatgcaatatgcaaatgctactgaataaggcgtggcacttacagctgttgaaacatgagtatcaccagctactggtccctcccttgcaagtccgaaatcagaaagctttggcttaaagttttcatccagtaatacatttgaagctttaaaatctcgatatatcacctagagcagtagcatactaattgttagaactagaggaagaaaagtttagaagataaaaacacaaaatagtaaaaaataatgcaaaatccaagagtatgttattactacattgaattgccactgttagttaatcatctaaatttatgtgttgaaattgtagtatatagtttactatattgacaaaatcaaacggacaaactatacaatagctgcttgctcccttttcttaaggagtaatctcatctccaattagtataaagatagtttacacctcgaaaacattaaattcttaagggggttgagacttttatgtatattcaacataagtttgcaccttaattatggcattaagctttaaatgttgagaagtcccacagcgtagtgcagcttatatatttgttgagcaacttcatttcacttaacgccaattggatttaagatggaatctaacacaatgaacattcaaattcttatgttgttgtccatcatcatctaaagaatataagttccagtgttgttgatatgaagttatataagaccctatgaatgctgtaagagcctacatttcaaaggaatgaggtttaaaccaatcatggctaagttggaagagaaccctaagtcagaggtttcatcaacagattaaactactttgttatgtgtgcaacatttcatttattaaaatggatggattatctaagctaataaaagaagcatattaaaattagtggtcctcatcctgcaaaagatattctaaactttatgactccctgcttttcagtacaattaatctaaaaaaacgcaaagaccaacatttgaatagccaaaacacaggccattgactggatcatcatgagacaaagggaaagaaagaaaaaatctgccagtaacacagttgacagatagtaagcatcacttccccaaaagagattttctaaaagctatggaaaagaagcatatattcttgaagtgaaagtttccttctcttatatcagggttattagttaaggaacttaacaatctaatgtctataattgcatgagtattttgtcaaaacttagaagacataacttatgtatttcttttttatgtttatcttgctctttttaaggagcaactcccttaaaagcttaatccattcaatttatgcaacatattaatggttttaatttctaacatgtctcatcatgtgaaatattattgggcttgaaacacgtacaacaaaacgtgccccctaccttgtgctaaaatcataattcaatcagaagaatggggcaatgaggatcatactctagaccatgtggtcatagaggcaccaatataatgttatggaccatctctctatagaacttataatgttaagtgatggcacatgaatgatcatatatatatctaactccagttagtgagagaagcaggaataatatataaacatgttgctaaaaatggaacctgaatttctaattcttcatgcagataagataacccttgagctgctccaagaattatttcaagtcttgttttccaaggaagaggatcatatgctttattgaaaagatgaacttctaagcttttgttcggcatgtattcatacactagtagtctctggatccctctttcatcatccaaagcacaatatccaataagcttgacaagatttgggtgttccacaataccaagaaactgaacttcagtcaaccattgcttatgaccctacatcacagaaggaaacacaatcaaaggaatatcctaatgtcaccatattcaatgcaaaaagcaaaaaaagagaacattttagctcttctaagataaggattacacacaaatatgtgcatgcataaacaacaaaaatgtaatgtaattgatatttcaggatagtaacttagatacatagaaatattttctataacataattaacacattaaagtaaaagatccattaatacatcatagtccctttgtacttttcaataagaataatatatggcttcttcattaatcagtggcaaactacacctaaaaaaattataccagacatgcagaaatccaattatgaagttacattacagtataatgtctgtagatgtaaactatgccttaacacatgaaacattcaattcaatcagataaattttcgagtagaaaatatggctataaagtataaatacatcaggaaaagtatctaattaataattgtaatagaggattagtgtctgaattgcctgtaaaaatcctcagcagaactatatatatagcacataatttcaatctataactactggaagtggaaactagaaaactaggagataagtctggaaaaagtcagaaaatatacaaatcaactaccatttattagcagtaaatatacagctcctaagcgagagatcttttcccctaaaaaggagattatttccaacactcacaatcttatttttgtagctaaggtcaaaggatgaaagaagtaactataatgcatacttatagatgtcattttttaactcgactcacttatttatgcatagaaaacatggaataatgtaatgaggtaccactagtcgtttctgagataactgaacaacagaaaataagtctcgtctcagtctcccagtagccaatatacacgtttttaccaatgttagagagtatatagatagcaaagaggatggcataactctctcttttgggtgaggcaaatttctgatccatgcaggatgaggaatatcagtttagagccagcaaaggatataaaagagttgaccatcctttgcacagctttcagtagattggtatatgaggtaacagagacagcaatatcattaatattgatcttaaagctatctgaaggaaaaagaaaatcacatctgtaatcaaaatgctgatcaaagagccaaggctaggaatactgatgaccaaatacatttagtattggctagtattgcatcaaggatttaacagctaaagactaaataccatagataacctggctttggctcattgctttgctcagatctttagacagaggatacaacattaaagcagaaaagtgaaaactctaatatccacaatagttcaaaagcctaatggataacaaacaatttcttgtttcctcattcctaacactggactaaggtgtgcatggacagtgattgtcaatttgtagaaataccaaaataaaaaagcaataagctaccaaaactaaattttctattttgatccactatttctatcagtgtaactttacaccaacagtgaacaagaaaatgccacaatcactatagtaactaaggttttcaacttgtagtaaaaaatttaggctggttccacctaacacctagtgggataaggcttttgttgtttatgttgtagacttgtagtttagactggttctacgcacatggttcaccaatggtgtagaagtatttgcacagaactaaaccattttttggttattttatctatgtttgacctgatcttataggcacaagaattaaaaatagtatgatacaatcttaacgaatttggaaatttactttttctttttcccattgaccgtacatgcatctttagatcaactttcatatcaattgagaccaaatctctccctaagcaaatcttaaggtaggactcctcatattggcttggtgaatttaaggcaattaattcccctaagtattggcaaaatgttcgagtttgagtagtcaagatagggaatggatcctctcatatatgatatccatatgaccttgtcatgtaaagaccatgcgtctagttttgtgaaaaatccatcaagagatagactgaccaaaatttctgcatgacaaaatcaagtaaaattttacaggaaagagtccattgccatcaagatagagcgcacatctcattaaccgataattgacattgaaaattactaaaataaaatttgaaggtacatcaagtaatggattctgtattcttacctgtgaggattccaagtccatgggctacgaatattgacattgaaaattactaaaataaaatgaaaaactctaaatagtcaagtatgacataaaagctggatgatatttctgtgatggaccacattacatgaataaaaacaacatcaaagaaaatagaggtaacaactaagaaattctaccttaaccattttatctaaactgaatttatgctctttatatttactcatctggaaatggggaccaaggaactctaaatgctctctaaattttaaacataaaaagtttatatgccattttctgacaaattacttctcaaggaatttgttgagtctcatacctgtaatgcattcttgttaagccttttgatggcaactaaaacagaattcccattcccgtcaacaggcttgattgaacctttaaacacacttccaaatccaccttctcctatcttaagaagcatgctgaaatcactcgttgcacgcttgagctctgtgaaggagaagtccctcaaattttgacccttctcctcatacagttcaggtataccgcgaggcgatgcagatgagcacgaagacttggtgacccttccaggtcctgaaaactcgagtttctcttggtctttaagttcaggtgctgacctttgcttactgctcctagatttgtctctgaaatagtaaaagcacttcattgcataaacaatcagctatgattctaatccacagtctctgatcaacctgttatcaattacacaaatcaccaaaaacaatgattgtcaagaataaaaccacatcatataattactacctagaaagaagaaaaacacaaccatgtagtgaatagtaaaagcatttcatagcataaacaattatgctataattcttctgcacagtctctgatcaacctgctattaattcaacaaaaccaatgattgtcaacaataaatctccataatactattaccatctagaaagaagaaaaacacaactatgtagtgaatagtaataccccagatgcatctgcaaactaaagatgcataaagtttcaaaatataaaatttaagcaacccaattgaacaaatagattaagcaacaacagagaaaacccagaaaagaaatcatactacatacaactttgaaggcaaatagcacttgcaaaatgaaccagaatcagctaagcaacacaaataagcctccgaaggaaaaataaaactattcaacaaagagcaaaatggttgaaaaattgaaggtatgtaattgaattgaatcctcacaggcaagaacacagagaagcatggctaggctacagtacacgttcgtgaagcttgaatttttgcaacttcaaatatgttaattttcttttgcttctttctctctctctctcacggatatcgaagatggagatggaagtataataaagaaagttctctgaaagttgtcctttttcattgattggttgaccaaaggccggccagccagcttgctaataagtttctgttttttgaactttgaagagacaaagatgaatgcattgactaagctttggacggatagttttttttttttttttccccttcaaagcatcaaatctcacattcaccgacttatatattcatttaaattttaatagagacaaaaaaagtataataggcatgtattataaaaccatcacagtcttatcataatgagacggattatataaatcacaccagatcatttcacacaattaataatcaagatttcaaaaatatgatttagtttaaaatttacatcacatcatttcacacaattaataatcaagattttagaaatatgatttagtttaaaatttatcttttggtttattttctattaattgactaagttaaaatcatataagatggtccatttatcttatcttcttagaattaatttattgctaatattattagctaatcttatcccttatctttttagcaactaagcccatgttttatgcatatcaaaaacaatctctttgatggaaagagattataaaggagatgtgcatcatggttaaggtcactgtgttttctatctgaaaatctcaatacaacatcagtgagtgatagttaaaacatagaagatcttcaagccaaaaatcatattagtttggatacccataaactgtttacatattatttgactaacagacaattacaaatcatctttagagcaaacaagactagcaatggccgaaggtaattatgatcttaatttttctgcacttgatctaattgcttatattgattgtgtataagcatgattagattatttaatttttcttacatttggcatcagagccagttttgcctctgccttacttttgtttgatagtcatatatgtcaaatattgtttcattgaaatatggatattttatttgaacgttttaattattaagaagccttggaatcatatggaaattgatttctaagctttcgatttcggtattgaaaatgattgagaaaatcattggatttttattttggttgaaactgggtcgagtcaacccatctgaagatcgaagacaatagtatcaatgaaacatgtttcaatttcgtggctttgagttttgtaaaattaacccgtattcaaatcttgatttttgtatcactttgatcttcatgaaccaaataaatgactataaagcattttgaactaatgacatttttatgatgtgttcacattgttatttagatattcagtttatattttttttattccataaagataggaatatttagtttatatcttttattccataaagatattaatgtttagatattcagtttatatcttttattccatacaaatattaatatttagatattcaatttatatcttttatttcataaagataggaatatttaaatatttagtttatatcttttattccataaagataggaatgtttagatattcagattatatcttttttttattccataaagataggaatatttagatattcagtttatattttttttattccataaaaataggaatgtttagatattcagtttatatcttttaggaaaaccttttctgtatgtggtccatttacttcacttactacatgtattaatttgtgtttataagataatattttgtgatatatgttcacatgatttattgttattatgtcattacatgtattaatttatgtttttctatacatgtaatattaagttgattatctgaataattgattatttaattttattatttatggttaattacaataaaattaattttggaaattaaataatatttagtgatctttataatttaattgattaaagcctagccacaataactttaattatttaaattatatattaagagtctctaaatcacataaggtaaataatattaattgtaataaatcataatataatatagtagatattatcccataggaatttctattatatttttgtatgattaattaggataaaatattaaattatatttttttgatttgcccacagggatcaagaaatataacttgatagttttattataatgtttgtgtgaatttaattgaattaaaattttagcccacagacaaattttatgtcgctaaattcataatttaataagcatgacttacattggtaaaacatgatacattatttttatctcaaattttaatgataagcatatatgttgaattattttgcaactatacaacatattaatacaattgttgtcccggaattgagaggagattattttttctatttggaaggaaaagattttgttgacgttaaggtatatgaacattgattatgctatcttgaaagttgagccaccagaaattatagagaacggtgaaccagaggagatggatctgtatgagaaatgggaaagatccaactgactctgtgtgatgttcattaagactaaaatacaggctgatattaagggctcagttggacggtatgacaatgtgaaagtgatcttgaagtacattgataaacaatttgagacttcaaggaaggcattggccaataccttaataatgaaattttcttccatgaagctcaatactctgaggggtgtgcgtgagcacatcatgcatatgagggacattgcagctcaactaaaaactctagagatggacatgtctgactcttttctagtgcattttattatgaattctctcccagcaccatatggtccctttaaaatatctggacaacacataaagataaatggtctattaacgaaatcatgaccatgtgtgttcaggaagaggggaggttgcagttggaacaaggagagagttcttttaggataataagaaagaccacaagaacaagggaagtggtaaaataccaccttatgctggaattaagaaagaatccaggtgtttcttctataaaaggaaggggcacatgaagaaagattgtcctacgttcaaactatgatttggaaaagaaaggtatgcctacctatttaatttgcaaaatgataccacttatgatgctatgcatgttaatgttggcacaaaacgatgtgttatgaatgaggattcctctatgttatgacacctaagattatgacacatctctatcgggataattaagagattggtaaatgaagggatacttagtgctttggattttgctgattttgatatttgtatagattgcattaagggtaagcaaactaaaaagtctaagaagattgcaaagatgatctcaaatctattagaaatcatacatacagatatttgttgtccagacatggacacaagtagttcaaaataatttatcaccttcatagacgattcttcacgatatatgtatctctacttacctcattctaaagatgaaactttagatgtctttaaatacataagttatatcttctaagttttgacaaaatactcatgcaattatagacattagattgttaagttccttaactaataaccctgatataagaaggaaactttcacttcaagaatatatgcttcttttccatagcttttagaaaatctctttggggaagtgatgcttactatctatcaactgtgtcattggcagattttttctttctttccttttgtctcatgatgatccagtcaatggcttgtgtttttggctattcaaatgttgatcaagcaggacaaatgaagtgatgaagaggcaatgcatatggtgaatttgtataggactaattttctgctgaagatagaccttgacaagcaaatactatcttggtattttactatcctgcgtattaggaataatcttgattcttctaactattttgatatttgaaactatcttagactcttagtcacaatggcattggtacatggtatctccttgaaatgatatatgggagtgcactttctcggacttagaggtatcattttgcaaagattaaagatgctgacattgcaataagattggaaaagatgcgtgttgaagaaggtcttgaatatgaacaagttgctttggacttcattgctgatagatcctatggttctctaagggatgttgaaactatgcttgatcaactgagtttgcttggtaaaaaaattactattttcttagtccacgagcttgtaagtgttgtgctttgttttgtgtgttgatgggtcaagagggaccctcaaatcgattgtagaagcgaaacaataaaatgcaagaagagagagatagagaagaacacaatcaatttgtttaacgtggaaaaaccttctcaatgtgaagaagtaaaaatccacaggacattggtctagaatcaaacttccactataataataatggattacaagagtcaaacttccctagcctttcactagagacacaatcaagcatcaccaagtatggtggtattcaaacttctctaaagagatcacactcaaatatctctctagagatttctcaaatgcaaagcacaaggcttgctcaaacgtgctctcaagaatgtcacttgaggctctcaaaatctgtcccctcaatttttcaatctgtcaatctaaaatctctctctctctgctgccttcaccctcaactaaggtatttatagtggtggagtaggtttagggttttagaaccctcaatgggcttgggccaacattggaggaggaagcccaacccaacaattgtccccctccgacttcaatgcagaaggtcaacaacccgaaaccccttccggtttcagtgcgccgggttcacctacaacccgacatcttcacaacaattttcacttcgggttcaccagtaacccgacaccttcacaacagtcttcaaattttcttgttggtaccgatttagtcatcatatcaaaccaattctagtcggtgtgcactttgccaagtgcgagctgtccatcttccaccacatcccggatttaatgatacctcaaatcaatatgcttagtgcggcagtaataggttgatttctttgcaagatgaattgcgctttggttgtcacacttcaactcgtacttatcttgatcatgaccgagttcagagagaaacttcttcatccacaacatttctttgcttgccttaggaacgacaatgtagtcggcttcagttgtcgaaagtgccacacacgtctgcagtcttgattgccaggaggtagctcctcctgctaatgtcataaaatatccagttgttgactttcttgaatcggaatctccccctaaattagcattcgagtagccttgcaacccggcttcaccttctccaaatcggaggcataaattggttgttcctcttaagtacctgaagatccacttcactgcttcccagtgctctttgtcggggttcgatagatatcggctcaccattccaactgcatacgccaagtcggatctagtgcaaaccattgcatacatcaagcttccgacggcagattggtacgtgatcttctgcatctcgtctttatcttcatcagacctcggacactgcttcttattcagattcatgtgcctagctagggggtgctaactgttttggctttgtccatgctaaatctcttcaaaaaaatttcatcatacttctcttgacttagccatagtagcttcttctttctatctcggatgatcttacttctgagaatctgttttgcagggccaaggtccttcatagagaaggacgaattcaacgccttattcagagcagttatcctctctttgctttgccctataatcatgatgtcatcaacatataataacaaaattaggaaatctccagtctcatacctcttcacaaatacacagtggtcagcttcacaaacttgtgcttattcatgaaggatttaaaattcttgtaccactgtccaggtgcttgtttcaagccatagagactcttcttcaaccggcataccatgctttcgcatcctgaagcttggaaccctttaggttgctccatatatatttcttcctctaggtctacgtgaagaaatgcggtcttcacatccatatactctacctcaaggtccattaaagccgccatgactaacacagttcagaccgaggtcatcttaataacaggagagaagatctcctcataatcaattcctttcttctgattgcagcctttcactacaatccgggctttgtatctcttcatgtttgactttgtatacccacttgttcttcagagctcgtcttcctttaggcagctcaatcaattcatgtctgattttcatgaaaggactttatctcgtcctgcattgccttctcccattcttctttttctgagctcattatggcctcatcataactctgaggctcaccgtcttcagcaatgacggtgtattcattagatgggtaccatgtagaagttcttctcactttagtggggtatctcggctgttcttcttcagcagcttgagaacacggttcataattctcatcattaactcagacctcagtaactcggtccttatcagcttgttgctagtcattttcttcattggtttctccctctgcttcagctctaacagaagggacaggttcctcttatcggacagtaacccggactttgggctttgagatgtcatgaatggtatcatcttcatgaaagatcacatcccggcttctcactatcttcttattgattggatcccaaagtctgaaaccaaactcggtttttggtgcttcgagataaatgaatttcttcatctttgcatcaaactttgccctttcatctttaaggatatgtacaaaagctcgacatccaaataccttcagatgatcataggttgctttccgacctgtccagacttcttcagggatttctccttcagtatagatgaggtcaagaatatgcctgcgtcgtctgggttgatccggtctcacaaacgaaacctgatgctgctttccagctaaacagtgcgtgcaactctctagcacttggcctttcaactcggtcaatagctctttcttcttcaaaatctggagctttttctcactcatgtggctgagacgtttgtacaacatctccaagctaggtccaccacggacaaaattggcttctccatcatttatctttccttgcattacatacaaggatccttccttcttacctctagccatcaccaagtttcccttggctaatttccatctacaacttccaaaatagtttactaacccagcatcatctagtttgccaactgagattaggtttaatcacatattatgtacatgccttacatctttcaacacaagtcagcactcgacatccgtggtcagggttacatcaccgacaccaacgattttgctagtcacctgattttccatcttcacaacttcaaagtcgccacttctgtatgatgagaaaaaacttttgtgaggagtaacatgaaaagaggcacctgagtcaacaatccaggcacaatcatcataggcaacattcaaaaaattatcttctccgagtagaaatatctcggcttcaacattggcaaccactgcagtggtgttcttgacttctttcttcttcggaactatttgatctgacttcacaaagtcattatgttcatctttctacagagtccaacaatcagtcttcttgtgttcgggcttccatcatcagttttcctttaggagacagattgctcaatgtcactaccagagtatcccatctttctggcaatgaactcagtagcaataaagcctgcatctcgtcatcaatcttcatattggctctggacaactgattcacaatacctttgtaggtgttaaggtgttcaatcatgctcatgccatccatatattccatcttcacaagtcggcgaaccatgtgtgctttgttcctgggaatcttcttctgaatcatggattccagcttgttccacaactcgtacacgtttgtgaacttggacacgtgttcaaaaagacttttgtcaatatatttcatgatcgtggcaaccaccttacgactcaggatctcccactccttgtcggttttgccagccggtctttcatcaaggacaatgggctcatacagatatttgcagtagagatggtcctccatcatcggtctccaataagtgaagttgttcgcagttagcttgaacgtatctccgtcatgagtaatgccaccgatctccatcttgtctatttcagaacccgtcgaacacaggctctgataccattgatgggtcaagaggaaccctcaaatcgattgcggaagcgaaacaataaaatgcaagaagagagagatagagaagaacacagtcaattcgtttaacatgggaaaaccttctcaatgtgaagaagtaaaaacccacaggacactgttccaaaatcaaacttccattataatataatggttacaagagtcaaacttccctagcctttcactagagatactatcaagcatcaccgagtatggtggtattcaaacttctctaaagagatcacactcaaacatctctctagagatctgttaaatgcaaagcacaaggcttgctcaaacctgttctcaagaatgttacttcaagctctcaaaatctgtcccctcaatttttcaatatgtcaatctaaaatctctctctctgccacctccaccttcaattaaggtatttatagtggtggagtaggtttagggttttagaaccctcaatgggtctaggccagcattggagtaggaagcccaatccaacacgtgtatgtcctcaaaattgtcttcatttctttcttttatgagcattatgtttttccttttgttattctgcagattggggtcatttctgatggtgaattgcttaatttactggacttggctttatcaactgacacttcaaatacagttataagaggctgggatcttgttaggacaaggatagatcttatacaacttatatcacagttggcaaatcttattatgaacattcttgtcgggaatgtaaacttcgtgattatgaaataagaacaagattttgtaatagatactcttgtaagtgttttaaaatatgttatatcctatttagctttgagcatattagccctttttgagtttgcagcctatacttgtgtctgcttttttcttatttctgttgtctgaactttgttattctatatatcatagcggaagcaaacctgtagaaactaagtcatgcatcaatgatactgtctgaaacagagaagcagttaagaattgaaggttgactaatataatattgtctacttgctttagatgtatccttatttcttagtatttgaaattatactcatctttgatatcaatggaaatcaagccttttttttatttactactatcttctgtgactcttccaccggcttgtcttgatcagagtttccttttttgtacactaaaatggcaggacagatggaatctggaaaaatggccattgttattgttgtggcaagaggaattgggcaatttgttgttcaggtacttcataaatcacatgccacttttctcaaccatatatatgcttgtctttttgtttccaagaactatttgttgtaacaaattgattgtttcttgatattttgtagttgtaagcaaacttgttaaaactaaccaatattttgcaaaaaataaatcatcataatttgtatcttttactctattttttcaaggtgttctatatttattattattattatttagtttaatttctatgtgtaacaccccgtgtgcacccggtgtgttatcaccaaaaatactagtgtcacgctaacagcgttaactaggcgcggcgcgaaagcgatagaatcgtttttctcgattacactatgcatgaaatataaaacacatcacacaaaacaacctcaaacccctgttgatccagataaaactaacatacaaaaacacaaaacataggcagatacataaacatctaaacagaggaaatcaggaggaatatataacaacctcatctgtacatatacatgctcaaaaacaagaccagatttggtcatacatcattatatgtacagtacaacggtgtacactcacaccctatcctttaacagatacaagacagagatcaaaactcttccaatcttcatctgcagcccatgaccatctccagcactctcagctagagcctcctgccctgtggttgctcctctcctcaggaagcacctgaaaaccacaacccacaacaggggtgagataaacatctcagtaagctcagggttctgggagaatcctccctcactctagttacccccaaacatacacacagatatacaacataataaacctaggacatggtcctggctatcactcattcccaactctctgggtattcaactgcatgctattactatcagaggtctcacacctcatattggctctcaatccatctcaactcatctcatagagccatgccatcattctggcatccatatactacactggctcttacatacgtctctcagaggtactatcacataagtgtcaatatatctgcaagagactctaggctctcatctcctcgagaaaactctctctagagatacaacatatctgcaagctgcctggtcccgccaagactttcacacataatcaatatccatgtgattccgatggttatcgccatctatcactgatccatgtgatttcgatggttatcgccatctatcactgatccatgtgattccgatggttatcgccatctatcactgatccatgtgattccgatgattatcgccatctatcactgatccatgtgattccgatgattatcgccatctatcattgatccatgtgattccgatggttatcgccatctatcactgatccatgtgattccgatgattatcgccatctatcactgatccatgtgattctgatggttatcgccatctatcactgatccatgtgattccgatgattatcgccatctatcactgatcctcatcctgcggaggcttcatctagatatataggccacatctccacccacggaggatcatctatatactaggaacatctcatggcaggacatcattatatctatcaaaggtcgtccgaatatataggtacaaccacgtctggaggactcctatataacggtacatctctgtaatgaggctcgtccgaatatataggtacaaccacgtctggaggactcctatataacgggtacatctcatgccctatctcatacaatcgcctgaggaggctacatctgtggatataggaacatctccatactaggaggctacctctataccacaggaaacatctcatgtcaggccttactcaaaagtgcctggggaatctctccactcaggacttcacaaacaatgcctgaggaatctctcatctcaggacttcacaaacaatgcctgaggaatatctcgtctcaggactttacaaacaatgcctaaggaatatctcgtctcaggacttcacaaacaatgcctgaggaatatctcgtctcaggacttcacaaacaatgcctgaggaatctttcatcccaggacttccatcgtctctgcctaaggaaacatccatccttaggacattaggcggagagcagtggcacctcccaaggaatctcagctattccagggagtcctcaaactctacctctggctagggaacctcaactagcccgatactagtccagtatcctgtaggttccaatcacagatcattctctgatctgcatatcatcacagaacactcacaccatctcggtgtctatcctggggttcatcatacatacatatctttcagaacggactgagtttaactccaagtaccgttcatccagcccttcggctcacatcatatatctatcatcaaataacggccaccctggccttcctcacctcagcatgcacaatcatatatgtatacatataaacaagcatggcatgcaataatcacctcacttgggtgataaacaagagatagggaataaccccagaacgatgagcttacctggcaagccgtgcctgcacctccagcctctggaacaatggtctgctcctctgacatatcgtgtcaagccctaacaaggcaaccaaacacatatcacagaccattcaggcacataacatatctaagctcatcagacagtcctcaactgtctctgagaaaggaacctcagtcctttctatcaactcaggtcctcaacctaaggtttctcaggctcatcctctgtaagcctatccatagacccttcagtggtctatctcagctacatccatgacctcagagtcaccacagactcattgcagccccattcctcaatttctctggaatggtctcagcctcatccaaggctccattccattagcctctcaggctcaacataagcatagacaaggctctggcatatccaaatacattcacaagtggccattacacaggccacacaagcaacacagagccaaaaaccaaagtcatcagaatcaaaaactgaaagctaatccttcatttattcctcgctctgaacacatctctcaacaggaccctgggctaatcctagccccagcacaaacgggtcactattcataaaacccctcagatccaaaatcaaacggagaaatttatgtttcttacctcagtggcgactccaaaagcctcaggacagcttcctctagcttctatgtcctaatcacgctgtggttctgcgccaagctcaagttctctgagcttttcctctgaggttcctcttctcacttaaaatgggggtttcgaggaaaaggatgaaggatttcagcttcctaatcggttcaatcacagttacaggtcgcgggtaagtgtttagggtcacaaaactggagtttacagagcttgggagtccttcaatggcggaaaaagctttggggaaggagagaggaaggttttcccttccattttcgcgttttgggcctttttataggccctgtcgtgcagcccacgctccaggcgtgacactccagtgaaaatcaactttctggagcacttcccacgctccaggcgtggcctcccacgctccaggcgtggcatgcagaatttagatatgtacccccggtagtacataggcttgttggcgcagtaccttctgttctgcttaatctctgtgatgaatctccttgctgatcgcgcggggtctggcgtcaatcgcgccatgccttagggttatcacactatgtattgtgtaaaaaaattaaactatttttttaacaatacaaaccgtaaggtttgaatttagaattccatgcaaaccatccaatgcaaacaacaataagatcaattataatgagtttaaatattgtatataccattagtgtatatttcatccactattttataaatgatctatggctacgcaacatgaatcacggagttgactagttggggtattgtacttttcagagtattgatttttatctctaaagtgagcaatgacatgtaacgaaagactttctttgagagtctctttgtatttaatgtattaggaatcatgtcaattctatttgatttataaaacaatgtttattaaaatagatgagaagttattaacacgtatatgaaattataagattgagtcacttttggtctttatatattaaaattatattagattctgagtaattggatccaatgaattattttgtggaaataaatttttttcaacacttttaagagaaatgaagctcttaaccatttgaataggcattggttaaaatgttagtctagcaatattgctaatataaatattttttgggctaactatcatgaaaatgtcatacaactaccgtaaattttagaactaatatgacaaacgttccaaataactgtacaataacaaatgaaaaaaaagaaaaagaaaacgaacattaaaaatagcaagcatatcttattgctaaatcagtggtacagggccatgttactaatagaaaatagctggtgcattgttatatttttttttttgaaaaaaaaaatgttgactctaattttgtgcaataattgctttcgcttcacaccatataatgtagaaaacatgcacacatagtcattcatattagctaatgctagtcatgcatatatatacatatatttatatatttacaaatattatatgtgtaactgtgaaatttaattgaaaatcatatgatatggtcgcaagtatatagttttagaatctaaactcaaaacatttctcttaaaaaaaaactcaaaacattaaataattttttagtataatactattaagaaacatagaaaatagtttcacacaattaaacataaatttaagaatatttttatatataaggaagtactttttatttttccttataattacaaatatcatcactatatctttaggcttagtattctcacaatgtttgcttattttaggttcattttctcatgcttttatttattctggacatcctgcagtttgtgtggcgttgtaattgaagcactcaagatctataaatgtgttctttttggatatggagcatgactaatcggtgggtaattttaagtttgtggttgatatataaatgcatgagaaaatgaggaaacacttcctatagttcatattgcagtatgtttaagtttaatagttctatattattattattattattatattgttttagcatttattaattatttttttattattattggtaagaaatatctcacaaatggtgctgtaatttatgtgaggccaccactgatcattcattattttaatttaaaaaaatacattctaagacaaattttctgaaaacaatcttagaatcctaaatgttttaaatatttttattaaaaaaagatattttaagacggttttttagaaaatcgtctaagaatccttatttttttaatttctttttaaaaaaatacattttaagacaattttctcataaaaacaatcttagaatgatgaatttttaaagacagtttgtcacaaacctgatgtcgaatctttcattctaagatgattaaggaaccgtcatgaaaagtgttgacttttcacgacgttgacttcaaagacggttaaaaaattgtcgttaaatatgtcaaagaatcgttgttgaagatgttttttctaatggtgttggtgtacatgtgatgtattaagatatatatatatatatatatatatatatatatatatatatatttgtttattatatgttggatatataatagtagattaacttttttccaagtattgaaagattatacaaatatagattaaatatgtgaattattataagatgttaaggtaatctttattagatgaacatgttttcaggagctttgaagatgaaaactattgtcttcaacattgttatataaattgatgactttggtataattgagtatatcaaatgttaaaatcatgaaaatgtgtccaattaaatgttaatgagttcattcattttaagtgaaattatattttgtataatttataaaataattaggctcgacacttttcatttaagtgtcagttgttcacaaacattgaattaatatctcacatttttttacgcgaatatttattaaaatttaaattgatccataattcattgttggtattgatttgtgaaatatcacatatattgacatgtgttaattttgattggtgatttctgttgaccaccaagacacgaatgcttggcttggatcgtttccggattgtaatcttcaagactccatgaattagggcttgaaattcaaatagaaaaatggagaagattaaggaatgatttagaatgacgccacgatccccaattggaacgataagtcgaaggaggattcgccacaaaggaaagctcccttgataagaatcaatttggtctcaatcaagaaccaacaagaggctaagctctcaatttaagcaaaagctcaatttcattaatctcaaagttaaccaaaaatagcaaagtctgagtatttatagggctagacctctaataaacccctaaaaacgttggtgcaggcctatttacggaaatataaaagcccaatacatgaaaacatcaaaaaggaagctgcagtaccatttttaatgaaaataatcgattaaaacgaagcgtaatcgattaaaacagagcgttctgcactgtgtaatcgattacagcaatgtcgtaatcgattacaacagacagataatcgattacagcaacgaaataatcgattaaaacagacagacagacagacagacagaaaaatagactgacagacagacagcatttgtattttaatcgattacagacatatttaatcgattaaaacagacagcaaatgcttattacaacagaaaagacttttttgatgtgttttcattgaatttggtgtgtctcttcatgcttgtccacaagatatacggcattttttatgtggttttgaagggcttgagttctagctcttgtcatgggtccttcaaagctcaccaaaggaagtgcttcaagctctccttctagacctttggcttgtaatggacccccatcatcatgatccttagatagtcctctatcatcccctccttcttgaaaataatccgtcctcggatttgcattcaaaacacctacatcacaaggagaaagatcagtgacattaaaagtagaactcactccatactcacttggcaagtctatcttgtaggcattgtcattaatcctctcaaggatcttgaaaggtccatcacccctcggttggagtttagatttcctttgggaaggaaacctatccttccttagatgcaaccaaacccaatcactgggatcaaataccaatgtctttctccccttgttggccaatcgtgaatattgctccaacttccactcaattggatttcccacccttccatggaaattcctaacaaaagaagctctaaagagcccatgtatactcaaaatagaagaatcattaggtaaggagattaaatcaataggacataatgtgttaaaaccataaaatacctcaaaaggagaaaagtaagtggtagatttggttaccttatcatcaagtctaggattaggatgtggatacttgacggtgatgttgttggtctcttccgaattaggcatatatgcagccctattaggaattgaagctcccgaaacaagaacaaattgattctcacttccttttaaaggaggcaagctatggggtatgtcttgtggaatgacatcttcaaactcctttaaaagtgtatcaaaacttggaggcaagtcaaagggactagaagacaagcacaaataattgggaatgagtaaatacatttgttgtctagctagcatcactctttttaccgccataggtttgatgaacaaacccggttttaccactaattgtttttcactctttttttctattttcttggattctctcttatcaatctttttgccatctttttctttttggattttctttttcaaaggactcttttcttctttaatgttcttttctttttctttctttaatttcatttttatttgatcctcacacacctcacttggagacaaaggtgagagaactacctttttacctttatgaaggaaagagtatcgattgatgaccccattgtgtaccacatctctatcatattgccaaggtctaccaagcaacacatggccggcttccatgggaacaatatcacaaagcacttcatccacatatttgccaatggagaatgtaagcaacacttgtttatccaccaccaactcaccattgtcactcaaccattgcaatttataaggtttagggtgagggatagtttttaaaccaagcatatccactaacctagtgcttgcaacattggtacaacttcctccatcaatgattagagaacaaacctttccactcaccaagcatctagaatggaaaatgttttctctttgtgtatcatctctatctttgcacaagctacccatgagtcgtcttaccatcaaaagatctccctcttccggtttaagaaaacaatcatcctcaccttcactagtggaactatgggaactcctagaggattcactatctacctctccattttctaacacaatcattgtccttttgtttggacattgggatgcgatatgacccttacccaagcatttaaaacatttaattgaactagatttattagaaggagaatgagtagtaggattagaattacctcttgaagactttttttcaaaatgttgggaagaagaaccctccttcttgggattgtccttatccttccaagatgaatgaccatatgaagactttttgtaggcttgttttctcttcaattgttgctccactttcatagctctatgtataagttcatccatggtgttgtaagtttgaagctccacaacatcttgaatgtccctattcaagccattcaaaaatctagccattgtagcctcattagtctcctcaatgtttgctctcaccaaagaaatctccatctccttgtaataatcatcaacacatctatttccttgatatagtctttgtaatttgttatgcaaatcccttatgtattgaggtgggacaaatctctccctcatgattcctttcattgtcatccatgtgtgtccggtctatgtctcctcaatcttcctctttccatttgcacttgattccaccaagccatggcatacccttcaaattctaagctagccaacttcattttcttttcttcactaaaattgtgacaatcaaaaacttggtcaacttttatctcccaatcaaggtaagcctccggatcattagtacctagaaacttgggaagtttgaatttcacatcttccattccatccctattcctcctaggcctataccttctaccatcatcatagccatcatcactcccttgagaagaatgaggtgacctatgatatctccttctctccatgtcatctattcttccactcaactcataattacttctttgtatctcatcaaaacgtgcgttcatccttctttcaacatttctttgcaaccgatccatttgcttagccaatgaagtcattagcatagcggttctaggtgaaggtggatcactatcaccatcggacaccattgctacaagaacaagaggagtaaaacaaaaaaataatgtaccttaccactcactaagtgtttacactcgtcgacactcgtgtttcacacttgaaagactttttctctaatgttcactcttgtctttttccactctctaactctttgtcaactcttgaaatttaaccaaagattctagttcaaggaatatccaaagtgaaagatgaaacaaatccaagctcaacttaagatgtcaaggaagaaagaaaactctaagacaaaaccttggaatttagaagacaagcaataaaagctcaacaagaaaagcacaactcaaaaggaaagccaaggaaagacaattatagaaatagaagatgtaaaagaaagtgctattaaacaataacaaacatacactaagagagggctaacaataatttttttttcagtttttttttacttttgggtcctcatgtcttttgatattttcattttgaccccacaatactttttaataattgcatattggtccttcataaattatcttttaggacctgaacttttgatatttgcaaaaacggcccaaaactctctagacagaattttatgaatcaaactcagaaaatttccagcaatgctatgagtttcatgaagaacacgaagaacacgaagaacaacccatattcaaaacaactccaaattcaacaaaaccataggggaaatgaagacaattgtaagataaactcaaaaatcacacaagaaacacataaagaacaacaaacaaccaagaatcatgattttcaattttcattttccggaaaaaaaaaataaaaacgaaaatgcaaataacatagatagaaatttttacgaaatactttccggaatcaagctctgattaccaaatgatgaccaccaagacacgaatgcttggcttggatcgtttccggattgtaatcttcaagactccatgaattagggcttgaaattcaaatagaaaaatggagaagattaaggaatgatttagaatgacgccacgatccccaattggaactataagtcgaaggaggattcgccacaaaggaaagctcccttgataagaatcaatttggtctcaatcaagaaccaacaagaggctaagctctcaatttaagcaaaagctcaatttcattaatctcaaagttaaccaaaaatagcaaagtctgagtatttatagggctagacctctaataaacccctaaaaacgttggtgcaggcctatttacggaaatataaaagcccagtacatgaaaacatcaaaaaggaagctgcagtaccatttttaatgaaaataatcgattaaaacgaagcgtaatcgattaaaacagagcgttctgcactgtgtaatcgattacagcaatgtcgtaatcgattacaacagacagataatcgattacagcaacgaaataatcgattaaaacagacagacagacagacagaaaaacagactgacagacaaacagcatttgtattttaatcgattacagacatatttaatcgattaaaacagacagcaaatgcttattacaacagaaaagacttttttgatgtgttttcattgaatttggtgtgcctcttcatgcttgtccacaagatatacgacattttttatgtggttttgaagggcttgagttctagctcttgtcatgggtccttcaaagctcaccaaaggaagtgcttcaagctctccttctagacctttggcttgtaatgaacccccatcatcatgatccttagatagtcctctatcaatttcttttcacgattgttattataatatatgattgcaatatatgaagatatattgtagtatacaatttataggattgtacaaaattttttattattgtaataaaagtcaataatatatgatattatgtcgacaatatgatatatacttcagattatatacttctgcatatagatatttgacttattgattagattgttatatattattgataatatatgtaagttttttattatattattatatacatataatatagatcggatatattatatgattgcaatatataaagatatgttgtagtatataaattataggattgtaccaagattttgattataatgataaaagttaaaaatatgtgatattatatatcattttgattattattttttgcatgaagatatttgatttattgattagaaacaaaaaaaaggttttgttttaaatatgctaataattgacatatagaaaaatgttttaaatttaaatatattaataactagcatatagaaacaaaaaatgaattttgtttttaaatttaaaccttacttagaaacaagaaagaatgcatgtgagtttttttttcctggattgctagaaaaagaagtttcatacgtgtgttataagaagagccttagattgaacactaaaaaacacaattaccttttttcttattatacggaagcaccaattttttttttaaaaaaaaatctctttattccgctggtcaaagaagttgcctacaaaagttaattctattccaaacaactaacatagaaataagatttcaaattaaaatgatttaattcaagttttatcttgtcaatgactataaaaaatcttattttaggagcaaaattttgtttctccacatgttgtttacagtctttatgacaatacatatgatgatatgtgttttattatatggtgatatattatttagtttattttatatattaaattgtttaattgcatggaatgaccagaatatcaagaaacttgtggttttaaaaacaaattggagcatatgatgcaaactgttttgatttattttattacaaggaacgacttgactaacaagagacttgtaatttgaaaataaattggagcatacgatgcaaactattttgatttattttatttaaggaacgacttgactaacaagagacttctaaattaaaaaataaattggagcatgtgatgaaaattatttttattacaaggaatgacttgacaactaggagacttatagtttataataaaagcatttgatgcaagttatttttttaattaataataaggaatgatctgacaaccaagggacatataattaattaatacaacatgagatgtggattttgaaattatttttatactaaacatcggaactacccgaggagtattaaatttaatttgtagataccaataggattgacttgacaaccaaatacttatttggtataattatcttttcaaagtgtatgtgatacatcatgtcttagaaaaatatatgtgatatgttatgtctcagaatatgtttgagaagcaacttaacaaccaagtaactcattcatagttttaagaaatttttcagttaagaaatattgcaacaaaattggttggatccaattatgaagattagtatcattacctaagaatttttctcatgcgtaagatgtttaatatgctaattgactatgagaatcaagttacctatgatcttttagtaagtttatgtgcatatatgctttagaagcagtaacttatttgtcaaataaaatttctacaaaatcagtatctacaactccttatgtgatgtggaaagggctagaatgaatctcaaacatagtaaggtttgagattgtcccacttacattaagatattgcaaatagaaaaacttaaggcaatgtctgagaaatgtagattcattgggtatccaaaaaaaattatgggatattgtttccaccaaccttcagaccataaagtgtttgtgacaagagaagttattttttagaaaggaaattccttgtaggagaaattcatggtaaagaaattgagcttgatgaaatttgtaacaccccgtatgcacccggtgtattatcattatcattatatcagattagcgcttaatcacttaattaaaaacatactttgcagaagcataaaatcaaaaatcatatttcttgattacattatgtatggaatatcaaagcatctcatcacaaagcaacacaagcccctgttgatccagatcatacaaccataaccataggcaaataatataaatatctcaaagatataaacagaaggaaacatcatcatttacataacataagcaggttatgtacaaaatacatcatctgacactcaaagtgtctgtacaaaagaataagcatccgagtgcttttgatcccaaggatcctttctcacacgagggcatgcatacatagacatgtataaaacaaagactacatgtgcacacacatgtcttccctctacaggggtacaaaacatcaaaaactaagccgagctccaagctctccactgctgcctcacagccaagcaggtaccgtctctactggggcctcctgccctgagaccgctcctctctaccagaagcatcacctgaaatataacataagccccacacggggtgagataaacatctcagtaagctcagggtccttggaggcatttcctccaccttggctcactcaccatgacacaagtcatcagggtatcacaacaaactggtctctcggccctcataacaatacaagcaagctatcttgctctatgtacagcggaccgcgtcaacgccgacctcagtgtgaaaccgaaattcacacccgtgccatcccattgggagctacctcttacgcatggacgcacgtatatggtacctccaagaataggcaatcaaccgcgacgagacacacctatctcttggtcttaggggatcatcatcaccccgggatccaatcaaccatgagcaaaccaaactaggaggtgccctctactcctagggaggtccatatatatctaactggccagaagatctaaataacaggctccatacatgtttcaagcacagatacaagcatatatcatcatgagtatgcaacaaccaataatgcatgtatcatgaatgtaaccactactccctcggagtatggtggaacacaagcaagtgggaaacatccccaagggaccaggaacttacctggcaaagccgagctctgcggttcttcccttgcttcgtggcctacgccactgacacccgtggtgtcacgccctaaacaaggcatacaaacatgtatcaaacatccacacagccatacaaggcatacaagcataacacagttctcaatcgctttagtgaaaggaatcacaatcctttccaaaaccacaaggtcgtctaacctaaggttcatcaaggctcaacactcaaagccatatcatagaccctcggtggtctacctcatgcccacacggcacttgagtcatcacaagactcaatcactactagaaaaaacgcttttaacatcggttcttttggacattcgacatcgatttttaaccgatgttgaaagtacaaatgttaacatcggttttcgaaaaccgatgctaacataattacacaacatcagttttcttaaataaccaatgtcaaatagtaagaaataatgaaagaagaatttaaaatatgcatattcaacatcggttcttttgaaaaaatcgatgttaaatttatatatcgacatcggttttcttataaaccgatgtagaaaatgatatttctacatcggttctatcaaaaaccgatgtagaaatatccttttctacatcggttttgactcagaaaccgatgttgtatattccctttctgcatcatttgtcacataaccgatttagaatatcattttttaaaaaaatatggcctattctctttagttctattcttgtaattttaaaagatacaaaagctacaaatggagttcaagcttatatgaaattagaacaaaatccagttcacaataattaataacatattagataaaaatgccaatattcattaaaagtagaaaagttacatctaaaaggtatggagataacaaacatgacattcaaagaaaaatataaactataataataataataataataataataataataataataataataataataatagtaaaggtcaataaccaatgacatacttgattaaacacaagaatttacatcaagtattaaataatttgaatttactggcttacctgtatttgttcattatttctaactataatgtcctctatcaactggctcaagaggcataggagtgcaccatgattatagcaaatttgatctgcaaaaacctctgataatcttaataattcagaacttactataaaagataagaaactctaaaatattaacaagtcaatttattctcaacatgaacaaatttaaggacatggcatggcaacgaatttcaaagtaatcatgaaaacaagaagtgtctttcaattcttggaagcaaattttagagtaatcatggggacaaaaatatcaatattaacttataaggtaaaaatattcaatgcaattttataatagaatgatttctaattaattcataatataacaacttcaatgctaagaacacctatctattgactgggtatctgtaataggatcctatctcagattttatcatttaaaacaagatttattatgttattaaaaaaagaagttttaagaatttttatttatttttaccttgacaaggttgtttccttttaataagaaaattatttaatttcttaatgaagatgcgaataaataacgcataaggtgtaacacccaaataatttatgcaagctatagttatcatttatcaccccaagttatcacaaatgaaactcaactaacaaaaattaactattaaagattaatacttgtggataaaaaaaaagtgacactcgaacaacttaaaaattaccatgaacatgaaatgcaacaatttatgttcactcttttactagcacgtgcagtatttttcatagttaatctattaatgatatttttttaagaatccacaataaaccagtgcattttttaatcatctttgggcaaaccttttcccacctaccaatacgcctagagccaatttttgcacctagagccttatagctaatttttaggcataagatgtgttttcgttcattgtagaaaatagggactaaaataatataaattattttattcctatatttttttttaattttaatgcttgtaagttgatatttttttaattttggttaaccgtaagatttttttttcttatttttaattcttgtaagtttatatattgttttaatgttggttcgtgtaagattttaatttttttttcatatataattcatataagtttgttcttgcatggaccaaattttttaattttttttataaaaactaaaagtaagcaaaatattttataaagactaaaattaaaaaaaaaatacttacaaaagctaaaattaaaaaaaaaacttacataaattaaaaaaaataactaacttaaaagaaaccataaacatatatttaagtcctactttaacttatttgtaatttttcacggtatgaaagaatacaggaaagaatacaggattttatcagtaataaggcagcaaatctaaacatcttatatttagctagaaaaatagtttcatacgtaatattaaaaaagaaaaaaggaaccgactttcagttgtaagggtttggtctttgatgcaaagagtctcaaggtcagggcaatccaatccaatcctgttaagaacctgaatcattagaagaatcttatcagatgtttgacaaatggtatggcaaaaatgaattttaatatttaagaaatgaaacttaagtcatgtacaggtcagaatgaagctctatattatttgaaaaatgaaaatcaggtaatcactttgttaacattaattggccttattcaaaaggcagtgtaaatcaaacaatggatatggatgtccagaatgggtaggcttgaaaaagcaggaaacaaaatagaattttatccaccgaaacaacttttaaaatgacattaagcattgctaagtgcagttaggaaaatttcacaaagccaatgcatgagattccacatattccaaaggcaaatcacactaatccacagcaagtgaaaaaattgaaacaagcagaaaaaatgcaacaaaaggaagcataggataataaaagcaaaagaggcacataattaaaaactatcagatgctgacaatattggactgagctttcatagtttcaatatcacgttctaattgttgcttccaatcagaaagtaaagcctcgtcctgtacaagttgatttaaaatggatacatgaactgaatatagcaatggaataaatttcatattgaagttaatctaacatcaaacctgaggcagctgtattgtcactttgtttgggaaaagacgaccaagttgcttcattactttaggggtttctttgctccgatcatgcagtctaccaaagttatcctgaaaaaagaacaaataatagtggattgataattaactccttaaggaaccagaagcaaccaagctacaatttatatataacaatattaactatgatttagatctatctcaaagctatgaatagtgtgaaggtacaaaaaaaagacaagaactctaacttccatgctagaaatacacaagctttaaatcaaggtaagaagagcaatggcagtggttcttataccggaaaagcaagatcaagtagtgctgtctgattgctcccaaactcggtaaacagaaggctgccaggttgggtctggaaacataatcatgcagtcagtaaatacagcagcaaaagcattcctccaatcatgaggtcactacgatctaataacaagacagtaccttctccttctccaaagaaaaggaggttaagtttgccaacttcctaataaaaccttcttcttttttcctaactaatgtttggcaaagacagaacaaaattggcagagtacaaaaccaatttacttgttcagaacaaaatcactttggtcatgtagaaagaagatgagatatttaatgatattagcagatgacaacatcccaaatcccaaatccaagccaatatcattgcatcagaccaatcattaacggaatcacaattaaattttcaaactataactctataaaggatatttctgtaaacaacatcccaaatccaagccaatatcagtgcattagaccaatcattttcttcccgttttcccacaatccatatgcccattaacacaacttttcttatcaatattatagaaaaggataaagaatcatgtaattcctaactagtaaccaccttattttcagcagaaacaacctatctaaaattaaattttatgaaataaaagagcacacgcaaaaactaaatctagatcattacaagaccagttccaaccaacaaaaatcctgcaagcacacaacattctaaaccaatatcagtgcatccaaccaagatttctttgccagttttctcataatcgaaacacccctttgtaatactaacaataacaataagttctttggctatctagtgggacccccaaatattgctacaatttttggtctcttaaggcaactatgagactatttctcggttcagagtttagtcacttaaactctttgccatctccaataacaataacttaaagcttctttttattttaataggaataacttaaagtttatgacaagattaaagctcaaaacttcatatattttgcagccatataattttaagcagaaacaacttatttaaaactatcaattgtaagatgaaacatcctataccgttaaataattattaaatagccatatacacactataaatttcatttcattataagatgaaatgaatagtttaaacttcaaagtacctgatgtccgtgagaaagatgtccacatgaggaagatcaagtgccatgattctttcatgaagtttaagcaatgcagtgtaaacagggaaatttgtgggagaccttgacagaggctgcacgttcactgcaattaaggggtaacaatgacatatcaaaagacttaaacaaacacctaatacttttaatgaatctattgaacatcaggaaattataattcattggaataacaagatgccgcaaattcaataaaaccatttcaactttgagccatcaatatgttaaaatcgaaacttgaactcccaaaaatctaacctagaggcaacgtaattttcgtcctgagggaaccattctcaggtaacaataacatgattttgaataggtcatgtggcataccctgacatctttcttgttcatttcaaaagacacaatctgcttctttcctgcaaaaacaaaaataacaaaacagatcagagattgtgccaacacagagatgtggcattttcaaacttaaaagaaaagttttcatctttatctttgcaagcatacgtgacaaagtgaatgagagagaaaggggagaccttgttggggagcaaactacagaaaatccctgggtctgagcttctaatatgaaaaacgcataaaaaattggaaatttatatgagtggaaaagaacacaaatttatatgagtggagatttatatgctaaccttcagatttttagtgccgctgctgcgagatcgacggcaagaaagtgactgagagagagtcgcaacagggagagcgagaagacgagagagcgagagagtcgccgtcgggaaagcaagaggccgagaaagcgaggaagaacgagagaagagttagagtaaaagtttcagaaaaaaagggttttagggttttataaaagagccatgtaaatttaaaagtccacaacatcagttttcttccaaaaaccgatgttgctggttttgattttctgatggtaacatcggttttcaaaaaaccgatgtattatatcttacagtaacatcggttcctcataaaaccgatgtaaacaacgttctttatttacaaaaatgccatcgcgttttcgttaacatcgattttatgaagaaccgatgttaaattgacgatgttaaaaggcctttttctagtagtgtttaatgcaagccaacatcaagagctcaaagctctacataagccccaaggctcaaaggctcacacatggcttgaacgattctttcacacacaaaacaccattctaatatcctcccaaggccatcaaagccacaaaccaaggctcttgcatgtcaaaacacagccaagcaactcagcatatcactatacatgcatcatatagagccaagaaatcaaatttcaccaaactcacatttaagagctaatcctacatcctcacaacattttaaacacatgattccaaaggatccaaggctactactagctctatcacaagtgggtcactattcacccaaaaccccaactcacaaatcaagcggtgaatcttgagtttcttacctcaaagatggtaagaaggcccaaggacgactccccgtagcttggataaccacaaatcgtcgccgttcctcgctaaactcaagttctacaaacttcccttgagaaagggattctttgatttgggggttttcaaggagaaatgaggaaggattcaagctctacaagtgttttccatcatgaatggtgtttacggaagtgtttttggtgaactatagagaaggaatgaagcttggagcttcaacaatggaggtggggtactggaggaagaagaaggaaatgttttctctcccaaaatcgcgaccccagccttttatagtggtcctgtcagagctgtcgcgctgatcgagccagctgcaagtgaccacgacgccatccgcgccaaccccgcgccaacctccagaacctctggcgccaagagcgccaacatccagggactatggtgcctccagtgccagaacccgcgccaagagcaccaatatccagagactctggcgctaaccgcgccacaatgacgccactcgtgccaactgcaaagaagaacatgtattctgggtggtctggcgccacccgcgccagcctggtgccccaggcgtcaaccaccaggacctttggcgctgggatgccactcccgcgccaagagcgcggcactctagagactgtggcgccaggagcgccacacctcagaaccatggcgctgatagcgccaccctggcgccaagagcgccacagttatgcagaaggattctgcagaaaaattgtacagaatccaacgctgttcgcgcccaaaactcgcgccgtacgcactggcactcagggttattataaaattcaattaaccaatgaaaaaagttaggactatgagctggaaaatgagatacctttctctaatgttctaaagttagcataaaggtcatcacatccaacaattgtggttcaagagccagttatagttcaagatcaggttcatgaagcaatcttagagtcaattcaacaacctatgaacccaatgcatgagccttttagaagatctacttgagtgcatcatgcacatgatagattaaacttgatggtcttagatgacacatcaaatgaggtttatcatgatgatgatgattcaagaagctatgaagagactatacgaagcttagattgtaagaaatggcaagaagcttcaaaggatataaaaccaattggttgttaaaccaattggaatcaatgaagatcaacaaagtatagactttagttgaagcttcaaaggatataaaaccaattggttgtaaatgcgtttacaagaaaaaggattggagcagatagaaaggtcgagacctactaagcttgccttgttgccaaaggatattgtcaaaagaaatgtatatattatgacgaaacttttatcccgtggcaatgctataatcaatacagatttttcgtgctatagtagcatactatgatcatgaaacatgaaatggatgtgacaaatgactttccttaatgatgagttaaaaaaggatgtttatatgatacaactcgagggattcacacccttgtctaatcataataaagtctactgttggtttcagaggagctatttgaataatggaataggatcaagctttggttttgagctttcaacatgcattggatgccttgaagaatgatttgtgttaaatgtgtaagaaagaagcaattctggtgattcaagtgcattgcattgcattcatatcattcattaattcaattagcttgagtaataaaaatcacaaggctttagtaaaatgatcaagtgtttgatttaaatcaaaggtttttggaaaaatgtttttgtactgaattaatcgattacattaaaagtataatcgattattttgttcttggtttattttggaaaagtttttaagaacaatgtaatcgattacctatcggaataatcgattatttgaccttcgttttcatataaactaccttgatgaacactttaatcgattaccaataggtagtaatcgattacattgctatacatgatttcaagcactgctggaagaatcgattaccaaagagtagtaatcgattacacaggctaaactaaaaaaaccatcttcctgtcttaatcggttatcaaattcagtaatcgattacattatatgtaaatgcacataagattcaatgcattaatcgattaccaaatatattaatcgattacatagttcaatatgatttctaaagcttcctggtttaatcgattaccagaatccataatcgattacacagtgtatttcaagtttatgaaacttcctgtcttaatcgattacaagatgaaataatcgattattttgttttttgctcatgttcagattcttgtagaacactttaatcgattatcagaatgatttaattgattacatgagtgaaataatcgattatatggcgcgtttaatcgattactgacagttacaaatgtttgttataaatagtcagcttgtttttataacttgatcaattcgtattctgagctaaaataagctttctaaacacgttctaagtgatttttctgggttctatgagttcttgctttcactaaaacatttatgagttattgagtgattctttaaagcaagaagatactttcaaaggttaaggaagaagatgttctgagattgtttttcatctttcaacctaatttgttcattcatgtgcatgtcattcactggatcatcaggtgttttctttccttaattgattggttgtaattttgcttacaaaatttgtgttgaattggctattgtaattttgattcttaaagcttgggactagagaaggattctctagcttaaagatcagagtagtgttctctggatctttctccttagatttctaatagggttttagatttctgttctttgtctagggttgataaaggggagattcttgtaaaagcttgtaagaatatttttataatagtggaactctaacctagtgttggttagaagaaactggatgtagcttcattatttgaagtgaaccagtataaattgcttgtgttattatttctattctcatcttattaattatctttaattctttgaatcatattcattgtacaacaatgttggttttgagctattgaattcttggactgagctatttgattgagtaaaagtttcttggttttaaaagtgataaagatcctgaaaactctgatttgaaattgttttaaaatgccaaagttcaaccaattcacccccctcttggttgttgtaaagtattcctattattttcatctacaagtttcaatgattcatttatggattgaaacaagtgtgtagaagtcggagcattcattttaacaagataattgaatgattcaatcttgttagctatgaagacgaactgtgagtacaaaaaggtcaatgggagcattacatttatatgtagatgacataaaataatacacaatgcaaggaagaaagatttgactactaatatattatccatgaaacatttgggagaaacaatcaacattttagaaataagatttattgagatagatctagaaggttgcttggtgtctcccaatctaggtacattgataccatcctaaagaggtttaacatggaaactccaaaagtcactatttgtcaataggaattgaagttactctcattagggaggattgtcctaaaactcacgaagagattgaatacataaccagagtactatatgctagcatagtggagttattgtatatgacatgatttttgcatgttctaatatcatttatgcattaggtgtaacaagttgatatcaagaaagtcttggtggggagcattgaaagtgggtaagaccattcttaagtacttaaaaagaactaagattacacctcatttatggagactcaaaatttaaaactaagtagtttggtgagcatgagttgaattagtaatgaaatacatgagtgattgactctagagcaagtgggagattgttagggataaaacactatagaaaaagggtatttctgacgacagaaatctgtcggtaacccataaaatccgtcggtaactgaatatgtccgacggacaaaaatctgttggtaaaatggtcgtagaaaattttaaccaacgaacttttgttgtccgtcagtaatttttgacaaaaatatccgtcggtaattcaccaaaaaaaagaagaagcataacacaaatatcaataattacattctcaagccgaatcagttaacagctatcaaaaagtaaattagcagagaaaatcacaacgttgaacaattttgcgatgaatcctcaccgagcaggccgtctaacatgttggaagatcggacttggtgacgtgactcaacgaacaatttgactcggtagctcgaaatgtgagattcgtcgatgacgaagccgcgttgcgtttgggccatagagagtaatagcacagagctgtagtggaaagaaagaggttgaggaagtgagagagagagagataagagaaaaaaaggaaaagagaggagaagatggaggaagagaaaaagaaagacagaggagagggatttggtgaagaaggcaacacggtgacggtgcaaaagcagagtgggatcaacttagagagggagaaggaagcctagaagagaaagagagagaaggaaggaagagattgagttggatgtatgtcgttcgtgagagagagactaagggtggaattttaaattcaaattgtaaaagagagataaagttggtggaggtgagcagaagtgctttaaaaaagtgcacagcaagctgaatttattgagaggctaacacgtcaaaaaaatagtttgacatataattcaaacattttccgatggaatatattccgtcggtaaaattcgtcactaactcaaacattttcgacggaatatattccataggtaaaatccgtcggtatttaaacatttcctacgaatttattccgtcggtaaaatctgtcagtaattcaaacatttttgacgaaatatattccgtgggaatattcctttggtaataacaatttttgttatagtgaaagtgtatgtccatgatctaatctatcatattatcaatttaagtaaataattattctttattttattatcatatttattgttttattaaattagagatttgttatcatgatagatattatgataatgagaaacaagttacttataattttattctaaattgttcttgatgtaaggattattataaataggatatcgataatccggatagatcaatatatatgtaatgatctttattggataaagatgaatgtatctcgtttactaaattgcatatagagatgatatacatgtggatgtcattattgaactgactcaattgagaatttttaaatgttaatattaccttcatatgtcaataggaagttccccaaaaaaatataatagttttctttgacaagattatcatagtaattaacaagttatttattatgttttaaattcggacacctaatgccttagaacactagttgaatgaatattatatatgattaaatacttgtacaattattgattaatcaagaaggagtccatcaattatatataatgagtttgagttctatgatagaattaaaaacttagacatgacaactgaatgaaacaagaaaatagatttttaattcattcattgattaaatgtgttagcttattagagtttgacaataatactacactctagaattaacctttagttgtaaatgatggaagaaaatattacattattcttctattggttcttgaaactaaaagatgttatttcatgttacccaagcattaaggagtgttattagacgtctacctggattagtaaattaattatgattaatttagtatcgatttagtattgaacctacggggtgacacacaaacgagtgttccaatctttgcaaaagaaaaataatttatttgataattaaattagagaacttaatttaatcaaatacatattttagttgaatattattatattctttactagtaccaagaatgtaattaatataaaaagaatattattttatagatgtgcaagttatccataaaataagaataatattatattattacatatcaaaattagatcatataattagttattgtaattaatcatgtgattaattattaatatctctgtcttatatagtgaagtttcttaagataaaagatatgagataattttcatttttataaagataaagagatataaaattattttaaataaaaaactaacctcatttattatctcgacgtgtcgaaacccacaaggcagaaaaaccagaaaaaaaaactaactctatttttctcttcccttttgagatcccgaaattttgaaacccacacagcgacattggaggttgaggtcgaggagggagaggcactgtaacggcgtttgtggtcgtggccgcgggcggggccggagccccaacggtcggagaattgtcactgttgttagaccacgaagcgacgacgatttgcgcgaggccgatgttgctgcagctgtggcacccttggtgcttagctggtgctggaagtcgggagggaagcggaggatgagggaggagatgtcgtgaaatgccgcatcggatcctgcggaggagtggaagctgtggcggcaaaggttgtcgaaggacggcgggggcggtgagaaatcaggattgaagcggcactctaaggtgactaaggccgcgctggtggcggtcgagccccaaagctttcccagcctcaaggaggccaccttgagaaggcatctagctctgaatttgattttgaaaagcggaacgcgtaaaataaacggtaccctttgttgctgccgatgctcttgtttctgcaatcattttgctttcttactttctcaaatcacaaaggtagtccctcatctttgaattttgaaatgctcaccttccatggagatgctggagacttcacagtgaaaccaagattgaggactagcttacatggaaaccttgttttctatctatgtctcggttctgtagcactctttggattaatattactaatttctttgcacaaaaaatattggtttgcttctttcttttagatttctattatcttccatttatttacttgaaccttgaaccattgaatgtgtttccttctttttgttatttgcaaattgattttacaattacttttattgctaacttccaaacttcagtaccctgccaaacttttaaatcattacaagttaatacacattattgtgtattggtcgctgaatagagtttacatataaagacaataatgtgttaatttctatattttaattgcaaattatggaagctcatattaaggttgaggaacagaagcagttatatgccctttataatatttttttcacttgatcccaatagtggaaaagagactataatgaaatacaaatctgtcttttgaattctcatatatctagaaatatttgtatggcatttgctagcttttttttaaccttgtcaagtatgtctttagattagctttgtttgaggaaataatcactttctttgccagcttcttgaggaatatttctagagaaattgattattttcccaaacaatcattagctggccaaacatgcaagagggttgagaggttggatccaatcaatataatctatcttccaatataagctcaatccttttacagacttatatgtggattttatgctcgtggcatggtttcaatttgttgataaaaaatttgttcccatgcaacaagatgattgtgtctgttgctattgctaatagctattgtatattcactgcagaactctcccttgttgtcacccatcgtagcaaaaaaagatgatgttgctggctctactggcagactgtccttaagagcacttgcattaattggagctggtttgtcatgtcttctcagtttttcaacaatggcaacagttgatgaagctgagcatggcctagcatgtgtccaagctatccatggcctcacaagggaattcttagttcatatgatcacgcttcgtaagtttggcttgaattttccctatattttcctatcttttgttcaacaatattgtttaccaaattagaaaataagataattttatccctgttgaattacatgtaaagatgtttattctattctctctaatttattaacctaattttatattttatcccatccttagatcagcaactcatccttcttttcccttgtcatttcatatgtctttgatcatttgtcctccattcatagtcaagatctaataaggccttcaatgacataaacgatgtcacattcattcaaatgccctcgatctgtgaggacaccattactgagagctatagtcaatgttatcttcctattcttttgacatatgtagtaaggaccaatttgattactcttgtgtctttggaggactaacatggtggtttactctatttattatacattgattgcatcgtaatttatctagccaaattgtttaatctctgatttttgccaaagaagcaatttcttgctttaaggacattagctgtggcaactggcaggattcataaaggatgactacatgttctgctgctatcatgtatttaaaccatatttcacacatgatatatatgttttgctgccaaattttaattggctgatttgctaaatataggttgctcaaattgctatgatttaattgtggttcataatattcccttatctctgtgctaaaaatatactaattattggttaatttagtctattaagattggtcaagtgtctacccaccctcttttatacatttaatgtacttataggcttgttatgtgtaagtagagtacggtattcttgttccaattagtattataattattaattgaagtttttccatcttatggattaggtcttagatttatttgaattttatttctttagtgttaaaatgcaaatgaattcatgatactcctcttgagatatggattttagaaatagacaagaaagaaagaaaagaaacatgcaagaaacaacatccatagtatgatcatgaatgagcatctattggccaaagatgttgtgctcactgcaagtgtaaagattaatgtacgttcaatagtattttccaaaaatcttatcataatttttaattagttgatcttgtaaaatctttatatataatgttaaactcttgatttaatatactacatctacatctttggtaacgtctgtttaattttatttcattataagtgcagtgaaatttttatgttaccattcactttgcttttaaaacaattattatatcttaattttaatttatttaacatggactttggttgcaaaggcttttggtcagtataggatatcctaccacaaaaagaaatttaaaaaattcaggattctaagacggtacttagaaaaacagtcttatgattctcaatttttttattatttttaaaaaaattgaagattctaagatgattttttgaaaaatcgtcttaaaaaataaattttctaaatcttcttagaatcttcaatttttttaaaattttaagacgatttttaaaaaattattttagaacgtttactttctgaaaaaatcattttaaaatttcaattttttaatttttaaattttaaaaaaaatgcattgtaagacggttttagatagaaccaatgtcgtaattgatatttaagacggtttggaaaatcgtcttgaaaagtattaacttttcatgacgacgatttcaaagccgattttcaaaccgtcgtagaatgagttaaataatcgacataaaaaacatttttttctagttactagcatgaaaaatttctcagaattttctcacgtcaagattaaagtatttagattggaattttgttttcgttttgtgtttagttttggttcatggggttctttatcgttgcttttctagaaaatgcataaacttggatctgaagtgtagcttcactgttatattatttacacgaaacattgatgcacatacaagtatatatatatatatatatatatatatatatatatatttggttttactttaaatgtataaacttggtttcgaatgcaacttcattgttctacgtaagtcagtggtgagaacattatttgaagcagagaattatttccattgactatatttctagaaaaaaggttacaaggaaaagtagaaaaagagggattcagttttgtcataggtaaaaaagaagagagaattgaaatttattaaaggaacctctaagtatactgactaactcaaattttacgtatttttccatatttcctcttcaccaactttgcttcttcacaatgttgatgatttatttgaaagtaattaaaagaaaaatttaaaaacataaaaaaaaatatgaaaaatcaaaatacaaaaaaatataatgtcatatagtctaaattacaatattgatattttatgtatattttgcttgtatgaatttggtcccttaagttacttttttttttttttgtcatttgatcttatataatgtgtttgttaaattaaattaatccttccatcaactttcgattctaacgacgtcaattttaactgccttgatatattttacaatttattgcgtattagtaagtttaccaagttaatatgataacttgttaaagcacaattttatccttcttaatttattatctttttgttattatttttatttttattttgtttcactatcacttttttttatcataataaaataaaatttgtccttaatttctcagcatggataattccatgtttgagttcaattcaaattataaaaaaagtagaactgagtgaaggtgaatattagaagtttaggttagatatattaaaaaaaagagttttctaatatttgaattctttaattatttaaattaattgaatttaaagtttaaattaaatttggtaagaaaattaaagtctcaagactcaactcattagcttatttataccttgattgtatttttattcattgatttatatatatatatattgtgattaatttaattagtatttaaaagatattttttattatagtcaaatttggttaattagggtaaaattatatttttacccttaatttactaaatttgactttaatgttcataattaacttattttgaatccaaattgttttttccccttcaaatatgatgtaattatatatttactatgactaaaattattaattgtttgaactatgatactaattcaatagggtgacaattactatttatgccccccaaactcctctctgtggcctttttcttagttctaattagttcgaactaccttagggattggggtcttggaagcttttatgtttttatttaaaaatattcacctagacttctcaattatccacccactttatccttaacaatattctctacaatgttattccttttctcgacactacccaatcttttcctttctccaaaatcaattttgcaccttgcgacacctacgggtacaacaaccaccggagggattcaaatcttcaaatctaagattagttaatgtacagtccaaaataggataatgacacgtggtcacctcataaatgtcaatgtacatgtggccaccttccatgccagccttgcctcattaatagacgcttattcagcctctagggtgtcagtctggacacaatgtccgggtttcttgtcaaggagcatggacgtcaaccctctacaaggatattcaaataggtgtaaccaccttatcttatcaaatctcgacaagttatctaataattgttacttatctacaagtaacaatatatctacaaggtaaatattatctattattcaaattaaaataactgtatactattattatctgtattattatcttctcaacagattatctataagtaaaggtccaaggcccactccacgctataaatacaacccttcaggttctccctaacacacgacattccatacacaccactctatacacatctcattctcatttggtattctcacataatacctctctctctcatatatacttgaatgcattactcaagttccttattctccatatattaggccgagtccacacttggtcatctttacaaatttaatgttctgatttgaacgtcagagtgtttttcctttgttttgtagatctcttctctaagtaaagcctaactctactctggcatcacagaatttggaatccatcaagactacatcaaacccacacatagaatttccagattttgacgcgaagaaaaggaataacaatgtagggaattattaagagcaatgtcaagaaaagaaaactaagaaatttagatgaagattttaaatgacataacatatttgtattgacactacatgaagtgagatacaatcatggaacacgtgatttaaatcccccttttgtgacttatcctctaaattttcggtccatttgtttactagccactgtgatctggttaaaaaagtccggggtacgtactagtaaaaaaatctttattttatagcaaatcaaattaagaattaattacactatttcaagaaaatattaaacactcttaaattttgaagagatgttaattatatgtttaaattaaatttatcttgtttatcatgaatgattaatttacaccactaaaatagtagttaacgtgaaattaatttaattcaatcaataaataatctggtcgaaatcataattgagttgtgcatgctttgtacgcatatagaaattataaggtagatatcgatgttaacaacaacaacaacagagtcacaaactcaaatatatatccaccaataaaaatatccaggaaaatattaatatttgtaaaatatttatttatttaatttttttggttcatggggaaatttatttattttatttagtaattagcgaagttttgattatgtaattaatttacaaaaagtacaattttaattttaataaaaaaatattatatatttattaagatatataatttttagtgtataaatataaattatggaaaggaaggttcaattaagagtggttttaagaatttcaaactatatgtaattaacgagaatgcatgcatagatgattcaaaataccactaactttatgtaacagaaatttaatacatgcacaatgcgaaaataaaatgcctaattaggcccttattatgaccaccaaccaccaggccctagagtagctttctccttgtaaaaccaatattttgccttttatttatatatatttctacatttgggtgttcattattgttgttgcaagtttagttacagcagtcgaacaagtcctcagtcaaaaatttcactaggtcgtccagtgtcatgctgaattcatgatccatctacaatatatagtataatatctgattattcaatgttacatataagaaacatgttatatgagaaagaatccaaccagtattattaggctttatatttagttagtttttaatgtgtgaacagaagagaaattataagcttctgtgctctatcctctgattcttcatggctgatcctgtcaataattcccgtacgggttcttccagtgatgattttctcaaccctttctttctacatcattccgacggccccaacactgttttcgtcactcaaatcctaacaggtgacagctacattttgtggtcgcgtgcaatgttaattgcactctcatgcaagaacaaagttgggttcgttgatggttctttgcccaagctcgacgaatctgactctcggctgttggcttcttgggttcgttgtaataattttgtcatttcttggattttaaactctgtctcaaaggagattgttgctagcatcatcaatgatcactctgcggctgagatgtggaatggtctgcagaaaaggttcctaaaccacaatggtcctagggtttacaaactttgaagagatctagtcaatctgaaacaaggtactgattctgttagtgtctattatacaaaaatcaaatctctgtgggaagaacttgcaaattttcggccttcttgctcgtgcaatgggtgcacatgtgaaggagttagcaagatgaaagcgtacttcgaagatgagtactccatgacattcttaatggctcttgaggaaactttttcccaggtacgtggtcagcttttattaatagttcctcttcctccaatcacacaagtattttctttaattgatcaagaagaaagtcaaaggaacattggattgggttatgatatttctctcgcggtgatttgtgctgccaagcaagtttctggttcccatggcacattcaatggtaaaaatagaccttactgcactcactgcaagtttcatggtcacacaatagagaagtgtttcaaactgcatcgctatcctccaggctttaaaccacgatctagaccttctctgaccaaccaagtatctgaagcacttgttatctctaattcttcttttttgaataattttactcgagagcaatgcaaccaacttatttctatgttctcaaatcatttggcaaataatgtttctgttgatgaaccaaataatactactggtaacaatcacacaataggtatttagacactatttgcattcatatgaaattgtttacctcattaagacagattcatggtcactctgttattctacctaataatgtttctttcactgtttctcatattggtgatgttatcatcaatcctcaattagttttaagagatgtattatatgtacctcaatttcgtttcaaccttttatctgtcagtgctgtcacttctaatatacatgttttttttcaattctttgacaataaatttttaattcaggaaaccctgaacaagaagatgattggcaggggtgatgttgtggatggactatatgttctggaagttgttgctcctgttccttctatcaaaacttcttttgtaaattccgttactgctgatatctggcatagcagattaggacacccttcaaataaatgccttatagctatgaaacacaaactctgttctaatgacttaaatgtgaatgatatgcatacttgttttttatgtcctttagctaaacaaagaagattgcctttcatttctaacaataatttctctcaatctacctttgatttagtacactgtgacatttggggtcctttcaatacaccttcacattctggacataaatattttgtaactattattgatgattgttccaggtttacttggatttatttgctaaaaagtaagtttgatgttttgcatgttattgcacgttttttcaccatggttcaaactcagtttggaaagaaaattaagcagttcaggtctgacaatgctaaagagttagcttttagtcatttttttcaagagaatggggtcattcaccaatattcatgtgtagagagacctcaacagaattctgttcctgaaaggaaacatcagcatctattaaatgttgctagggctctatattttcagtctcatattcccctccgttattggactggatgtattgctactgccacttttcttatcaatagaattacttctcctctcttagccaataaatctccttttgaattattgtataatcagtcctttgatttctcttacatgaaagtgtttggttgtcttgtttttgcttttactttaactattaatagaaataattttgatccaagagctagagcttgtgttttcttgggttatcctcctggcagaaaagcatataaattgcttgacattatgactggtcacattttttattcatgtgatgctatttttcatgaatctatattcccttttcagaataagaataatgtgcatgacagacccgacccttttcaaaatttagtgttaccaaaaccttttctggatgaccatgatcatgtttctgttaatcaaactcttgagagcagtacaactgatttgcttgttaatactgaacttgttcctctaagaaacattgataatattgatcatgatcaacctataaaccatgctgctaagagatttgtcagaaatactaaacctccatcatatcttcaaaattatcattgtaatatgttggttggttgtgatttagttacttctgcaaagtatccgatatcttctgttattagttatgaaaaactatcttctagtcataagaattatattcttaatgtctcatctcattatgagccacgatattaccatcaagttgtcaaataccttcattggtgtgatgcaatgcaagatgaaattcatgctcttgaaggaaacaacacatggtcagttgttcctcttccccctcatgctcactctattggttgtaggtggctgtataagaacaaatttaatcatgatggcactctagacagacataaagcaagacttgtggctaaaggttatacacaaaaagaaggtattgacttcattgacacttttttccctgttgcaaaaatggttactgttaaaaccttaattgttattgctgcttctcaaaaatggcaaatgcatcaacttgatgttcataatgcttttttgaatggtgatttgatggaggaagtctatatggaccttcctcttggatatactattaagggtgagtcaaatgccacagctccaaaaatggtttgtaaattgaacaaagctatttatggacttaaacaggcttctagacagtggaatcataaaatctctcaaactttaattagtaatggttttattcaatcaaaaaatgactactctttatttaccaaaggagttggaccttcttttactgcagttttgatttatgttgatgatattattgttgttggtccatcttgatctcttattaactatgttaaaaagttcttacactctcagtttaagcttcgtgacttaggaattctcaagtactttctaggtttggaggttgctcatgccaaacaaggcattgtttttatctcaaagacattacacattgcagcttcttgaagacacgggcttcctagcttgcaaatctactcctgctccaatggatccaagacttcatcttactgaaaatagtggtgaagtcctaaatgatcaaactgtttatagaagacttattggtagacttctttacttaactttgtctaggcctgatatcacttatgctgttcagaaacttagtcaatttgttgctaatccgcacaattcccatttgaatgctatacatcacttgcttagatatttaaaaggtaagccaagccaaggtttattttttagttctaattcttctcttcaattgcaggctttcttcgattctgactagggagcatgtccagatactaggaaatttgtaactggtttttgtattttcattggagattcattagtctcacggaaatccaagaaacagaacaccatctctaggtcttctgctgaggctgaatacagggcaatggtctctactgcagcagaattatcatggttatctcaattaatatctgactttggaataagatctgctgaaccagctttgctgttttgtgacaatgaagcagccattcacattgctagtaatcctacgtttcatgagcgtaccaaacatattgagattgattgtcatttcatttggaattaagtctcggctggaagagttcgtctcatgccaattacctccaatcttgaacttgcagatgcctttacaaaacctctaccatccactttacttgaaactttacttttcaagatgggagtaaaagacattcactctccatcttgaggagggagtattaggctttatatttagttagtttttagtgtgtgaacagttagttttttgttactctgttgctgttacttttctgttttacttttgtatatttaaactcatattctccttttatgtaggaaatttttttccttttttctatctctcgatttactgtaataagtatagttattcttagaaggtaaaaatatatgcatggaagattataccaatggctttcttcgtaatatataaggaaaaatgtgctttttattccatatattttcagtcaaatatgattaaggtgtttgtattttcatattgaagaatctggggtcttcaaactttaaaaaaatacgatgaattaatttttagaaagaagagatcacattctcatgaatgcatggtttttaattttgaagaccaaatttcatcaatagaaagtataatgaccttgatcatatttgacagaaaatataaaaactaaattaattggggcatgtgtacctgagcaatgcaagtaatgttaagagcggaatttccaaacggcaaaacattgcaccaaactatggagagattaagagcttcaagcttgcccagaaacttaggtacaatgtccttttgttcacacataactttgatgagaacatcttttcctgatcactcttgcttcaactttgggacgtatatttataggtatatctgagccatcatcaggggtgcatgaaaagtcatcaacaaaagaactaacattggatttgttcattttgaagcatactgcagattctatttttctctttttgctgtcttcctccaaatcctttacacgcttctgaagatatttcacataatcgatagcagtcttaagaacagaagctttatccatctacacaaatgaaatattaattgtttcattttattagccaataataatggaataggtttagtggtatacttggttttgaattataataattttttaaaccatagtttgtgcagaagattactgtaaaaaaattcataaacatttccgtaagtatttataggagattgaaattatgaaaaggtaaaataatttgagtttatttgcattagctaaagttaacttatgtacttttttttttctaaaaattattttcatttaaattttctaaatttaaagtgtataaattaattttaatttatgaagaacctcaatgcattttattctcttataataagtatttctaaaaaaatttattcaaacaaaacctaacaatccaacgatttttttgtttgaagaggaattgacgaggttaaaaaaaaaatacttctgtcagtattgggacatgtataatttatcactctaaggactacatttatatataatgggctgatcgacctttaaattcttgagtttctctataaagtctcctagctaagtagaaattgtattgcgggagtatgtatcatgaatggtgtaaatgttcttgattcggttaaaattctggaacatatgcacggcatattagataaaattgctcttaatcaaagagagaacagtaaagtgcatcggtttggtcgatgtatgataggatggcctcaaaattaaatggtcaaataattaattaagatgcagttaaatatgtaatttattaattataattttattttatgtgttaaaataatatgatcgatgttatacttggatagttatcatccattgacatttttaggattagataaatgtactcatctttatttattattatcaataaatgaaatatcaaaatttatttttatcttctttatagcttttaatggtagttttcatggttttagaatagtctaactttcaacactctaacaaggtatttgcatacttggaatataatatttgtttatgaaaaaagaaattaaaaattattaccatatgcatattatgaaattatactaacactatgatacacctttatattaataaaattatctttttgatgtgatgtattaatattatcagcataaacttttgtaatattatattaatagtttattttcatttaaaaaaaaggaaaagaataatctttagtgtgaaaaacatttcgtgaaaaagttacaaagagatgtgattggttaaaaacttaaaagagagatatgaaatatgcagttatgtaaaagactttttacaacaaccccagcttgtatggttatgaatcccaattttcgtactctaattcgtaatgtgtttctcgcactgagtagcattgtttataagcttttgcaaaattagtggttcgaaactttctatccattaacttttaagccaaatttgaattctccatatatttggattttaattaataaacaaacctaatatatatataattagtttgaaactgcagtgcagtcacagttgtggctttgttgaggtaattgttgaggtaatagacagttttttaaaggaggaaattatgataaaattcgtcaggtttacatacattactggttgtgcttctattggaactgtaataatctaaatatataatctcttaatacaaacttttatcacacaaattgttaaagtaaaactttatttttttaattaataactaacacaaaaataccgaacgaactgtacctgagttttttttttttttccttttttatataaagtatgcaatatacgcccaccctatattttgcggtgaactgagatagaaaggaaagaaagacagaaaaaaaaaagataaagtgagaaaatgataaatataatagatgatataataaaattgaaagagagggaaaaaaaagtgagtaaaagtgatatatatgagaaagtagatagatgattagtttttctaatttttttaagaaggtttattttttttatttttaaaagcaacaaaagtggttaggagtccaatgggttatcaaatatgcattaattctgatccctatgagaattataggcaacacaattgtccatggttgtgatcccagataaacatatttgaaaatctggtctttaatcaagaggttctggattttcatggtattgtagaaagtagagtatttgattcagagctagggcttggtttgcttctatatgggacaatgactcattatggttttatgaattctacacgaatccagcatatatatatatatatatatatatatatatatatatatatatatatatatatatatatacactgtgtataatttctgaagtgttgattccagttttgaggggctctgcttgtattatcaaaagtatggtgggggacatttcttatgatatcgaggcaaaagaacctaaataatacaaattaaataaaaaattacgcatttggggcagtttcgaaactatttaccaatctggggcagtggaaaccgcccagaattgggcagcactggagccgcccaaaaccaggcggttccaagggggtagagccgcctggttttggacggctccagtgctgcccaattctgggcggttccacttcgtgacacgtgtcagtcctgcacagatggagcgatgcgtatataaacttcggacggtcataacttttgactggaatgtccgattgagacgaaaccggtggccacgcgttcgaaatatcgaggagaaggcgctagcaagttcccgaaggggacttggtcaaaaaaattttccaaaaaaagcttctaagtgcctcaaaattgtgatttaatcttcgaacatcccaaaattttcttgttttctaattttttaattatttagtcagttaattgcatgctattttttatttttttcattacttctatcaatttcgagcatttcgacatattctacacctcgatcggacatttctatcaaaagttagaccatttgaaggacatatcgtacgctgttgtaacttttttcgatattctaaattttatatggttttgtttaatttttttggattttttatataataaccccatttatcccaaagcacaatcattcctaacttttccgcactcattccacactttaccgagactcatcccaaagtgcactcaccacacaataatcggaattgtagcaccctattaattccaaagcgcacttggagcggggaaacattgcagaactctataaatgagagtggaactgcgtgagacaaagtgaatcaaattaaaatgcaaagaattgcattgcacttggatgtatatgttttggccacactaattttatacaattgagtcaccgattgacagaaagtctgagtttctgagtttcagtgtagtttcgatgacgggttaatcgactgcgtgcttttgactggaacaaaaagataaaagggaaattgtcttctatttttttttaaagagaattatcaaattatgagagcatgaaagagatgatgagagtgatgagaatattgtgtttaatggggttagtctcgatataaaaaatgagaagtaccaaaaatcatatcaatttttttgaattcataaataaaattgaaaagttttttttattgaataaaatattttattaaaaattagttatatatacaaaatccaaaaaatatcaaacaagatcatataaaaatttagaaattatattaaataaaataatatattaaaaattatatatacaaaaaaatccagaatatattaaataaaatcatataaaatttaaaaatttactaaataaaataatattaaataaaagtaaaaaatatcatatctatgataaagatcaatttaaaaatactttcaaattaaataaaaataaaaataaaaaatattaaatgatattttacgtcaaaaatcaaaacacgtcaattttgatttttattttagtcaatgatagtttttgcgacggaatattttggtcacaaacaaaaaaaaataaaaaaaccaaattttccgtcgctaaatcggtcgctaaccgaaaaaaccaaattttccgtcgctaaatcggtcgctaaccgatttagcgacggatttagagacggatttagtgccgcccaaaattgggcggttccgactgccccagattcgtaaatagtttcgaaactgccccaaatgcgtaattttttatttaatttgtattatttgggttcttttgccatgatatcgatgtgtatatatttctttgggggtagggctcgtgttcctaggttccatgcagtgaaggttaatgtatttattagaggggccttcttttgtctggggttaggtattacatttatggtcattctggcatgggactcagctggtttgggttctttctattgggtggattttcggtggttttgacacctttggttatacatgacaaggatcttgttgatggtgtctacattaattaagaattttaaaaattataaaagaatgtaaataaaacataagtaatataattttatgtatttttataatttttaactaatattctaaaaatactaaataaatattaattagtatctttaagaaattagtttaaaaaattaaaaaatatacttttatacataaaatcatattacctgtaatattattatgttttaatttctataatttctgtaataaatattttttcatttttattctttaattaatattataaacacacttaacacccatcactttttgagttgagactgaggctcttaaatgttttataaccgggtgaggagaggtgtcttttatttcacctcctcactctaatttgtattcctttgaggtactggccggtaattgtttatttataaaaaaataatttggcagataaaaaaagtcaaaacccatgctattaatacggaaagagataaacatataaactgacctttttcaaccctggaataacggctgaaagtgttatgaacatcttagtgagattctctctcctctttctctcagtcattatgtgatcttgtatctgagaagagcttctggtacccctcttatattttctttcattttttggttcttctttggtttcctttgaattttcaccatgataatattggcattttgagtcctcaaatgaaagagtagtgtagggcattgaagaggagaagaagagaggttcatcttgagatgcatgttgtttgagactactacggttatcaaagccagtgttctcttccaaagatgatgaacttatagggttgctaagaattgtggtgctttctttcgtgagatttgaatcacaagggtgacttttgcaagatagttcttgttgcactaaattctcccccttgaacacttccccaagaaagtgcatgtgaccaaataaattgcactcatccatttcctgaaacaattcagaacaccaaaactagagaaattttcacaaggattaatataaaacatatatgtgtgaatactatgtgacatttatgcacgcgatgcttgattcaaatatcattgttaccaaataaggaggaagccacctttcccgtgactcttccattattgatgccaaaaatcagataaatttgatgttccagtttttgcttcagctattgaagtaatgttatcgatgattcgatgcatgtgagactccaactaaaactaattaatttgtagagggtaagtggttgggaaaggaaaatgatggaagagacattttatttatataaaaaaaaatcattacattattattctattttacgttttatgtgtatcccttttttgttctatttttctctctctctaaattgttgtgtacaattaacatctcttatcgttaattaaattttagataatatgtggcagacgcttcagatgacacgttcactcacgcttttctatatcaagtacgcatcacatgatcgtgaagtcaaattggatcagtcattattttgatagaaaacaaatctatatctatattttactccaacaaaaatttaaccttagtagctaggtgataaaatacaaaacagtataaaataaaatcttatccgccgatggttgattaggagctttcaaaatctatatacacagaagactgtcaccagagagaccatcaggtcatttaatgatatagcattggacctacacccatatgaacaaaatcatcacattattctagccttttcctatcagagatcggaactgggatattcaacacgaaaagattgtcttttattgaagagaaaaaacgttgtaaaaataatatttatattaaagagtaaatagcaaactctttttttttggattttaacaatttctctaaactttttcaaatatttacttttaattcatacagtatttttagtttttatgttttttcccttactgataattttagtctttgttattaagtaaaaattttaactgacgtaataatctcattgataatctaatgacttgttatgttattaattagtctatcaaaataattacatgtaattataatgataaatggtgttttaattatccattaactaacttaacgtaatcaagtagtctaaataaatgaaggattaaaacagtactagtacaaaaatgtttttctatgtcgtcatttctacattagctagtaaataacttatgtatatagtgacatactgacattttttttaaggaaacgagtttacaccatttcttacttaatggatgtagaaacactatgtttacatctattcaaataagaaccaatgtagaacaacttcatagcgtctcaacccctttcaatttcaccctaaatcactcattggtgccctcacaacttctccctacaaccctcgccgccctcaaaaccctttatccatttcactcccaaacctcatgatcatcacaccaccaccatatatgataattgaattttatacttaccattttggtacatataagtgcaactatttcatctctcccctatttaaatccttgtttctaccttttttagttcaaaatatttagtttttagacatctacttagttatgtaaatttggtagttagtctcatgtttttaatcttttgatatctagaaattgaagttggattttgaagcattttaggatcaaggtcaaagtgaaatattactgttggtctagccagacattgagcccgacccaaccaaacacaaggtagggagcaaccattcattggagaaatttatggctaggtgaaattggttctggttgggccgaaagcaagttagtagcacttcatattttggagacaattttgggccaacaagcccaaccaggatccctttaataagcataactgagacttcggcctagccgaaacatattgtagatggggcaaaactatcatgttgacactttttggacataagacaacatttaaagggacttttaggaagagaacatggtatattattctctgacctaggttttggcacaagtggagttgcttgggaaactcttattcctccatttttcatcttcttcttctatgcaccattttgaatgctcattttaaccataagtggctaaactcccctttgttggtgtttgatgtaactaaatccaaacttacgtatatcttttgagttattaatacatgtttattattcgttgttttgtgtcctctctttagcttaatgcttgtttttgtttgatcacctctttgcttgattctatggtttaaaagagattggaaatgcatttgaattatgaattagagaaaaacacctaataaagacagaacaaaacacattagtcacctttagttaagcctttttcttaaagataaaacgtgactaaactatacaaaggatttataattaattgagttaagggatttaagctttttttcttcttgtaaggaatcagggattgaacattattatttttataagttgatgataacaaaaaaaaaatgataaacattaattattaataacttaatttgttgatacacgagggagtgctttaactcaaactctaatattctttgtatattattgtgtttcgtaacatttattcttattctatatctttgagaataaaacaaaaaaaaaacccttttaataactgtataaaattaatacatccctacacatgcactaaatccctgacaactaattgtctaaccacccttaaaaaaattgtctaaccaattcatcactttgaaccatttacattcacgagacatgcctatttgattatacttcctaaaaaaataagttaaaatttgtttactctaaaataactttttactccaagtctaaaacaactttcctcattccaatcataatatatatatatatatatatatatatatatattgtccattcttttctccttgattggatgaaaactagcttatatagtcatcacaaataattatttctgcgaaataatattgcggcgaaaggccaaatccagttgtttgctcgtatagtcgtcgtattaattagggtttgttgaaacatgaaagcataggccccaggagttggtgatacgctgacatatacaaggactatttatctttcagtttagtttaatttcaaggtaaaatgattaattcgatttaaaaatgatattaaatctcaacaaatctaatttgctttttttgtagttttaaattaaaataatttttatttttttaaggaatatcactttattttatgataagcatactttattttatggtctctaatatatattatataaattcttgtagtgattattttttatttatttaagagaacacttattaaatattttttttaatatataataaatattcaaaacttaaattattaaataccatcataaaatcttaacctgaattacagataacactttaaaataatatataatttatttgagaaataggaaaattaatataaatttgttatacttgcagttcagttaaatttgatttatattttgaacataagaaaaccaaaaagcgaattaaattgaataaaaaccatatgttctttcaaattttaaattaattatttattagattttttatgatttcaccatttagatgaattttaaacactcttaatatgcatatattaaaaattttatttttataatttattttcaaaatatataattataaacacgattataaatatagaaaacgttgaaatttaaacattgtttaaaatattaaattttatgctaaaaaataatcattaaaatatgtatgctctacatattattaaaatgtcttaatacagtactgtagggatgaaaaaactagtttttgctcctaggacacataagcatatttcctctccctttttttaagtaaatatagattttatatatgagaaccagcaataagagtagatcactctctccagtttttgctctttgtagggatgaaaagggaaaggattaacttgatcaaccttaataataaaattaaacttaataaaaaccaataagtctgattaaataatgagaaattgacgcataaaaataataataataataagacattgaatgagagtaatgctaataattaatgaatattcgatatattagtgaagtattgtatctataatggatttgatctgacttgacttaaataatccaaccaaatctagtcgatccgaatcaaaacagggaatgaactataatccaaatcaatctaactaattaaggatgttgatgatagacttctcctaatgagtaatgacacagttatatttaaaggagttttttttttcacagatcgagtttaggaagttagacctgatgtattgtaagaatgaatttgtgttacacttgaagtcattctaatccgatcctatatctcatgttttttctccaaaggtataacttttaaataattatgtattatatataatataatttcttgacttataaaaaatgttctatcaaacataatatttatatagattttctttatcttaaaattgacattataatttgcagttgtatacttattgaattctacgatttaactatatatatatatatatatatatatatatatatatatatatatatataatgataaacaagtctcttctaaaaaaaatgttcaacaagtcattttttcattatcagtaaataaaataccttcattgaatatggtacaaggagtagcagataaaagtttacaacagaagtcaagttaccttagtcttgtcctatatttgttgagtcctaattagatcgggttcgaattcactaaattaaccctattaacaaaatgttaattaacttgatgaaaacatggataaactcatcttgacccgttccacggacatcttaaatccaacccatgatgttctatccaatttggattttattttcctttaatcttgatccgaccaaacccatattcaccacctacctctttgcagtaacagtcaagctagcctctatgcatggccagaatccggttcaacttgtttttcttcttttggcctaacaaaatcatctcaaaacaactttcaattttgtcacgttcttgtttgattcttttgcttcctacgatcccattccccaccagcacctccaaacacgcgctacagtctcatctctattattacatgacacgacagcaccatgtttcttcgatacacataacacccatagcctccaatatttggcatttttcttttatcaatttctttgcttcggatcctcacaattagaggtggggggtaagaaactagcttgattttttcaggctagttgtccttttataagctttaggctatgtttgcatatttttaattaaaaaaattgaaatgaaatgaaattgtataataaaataatcaaattatttaaagaaaaaaaaattaaattgtcttctagtaacacgggtagatgtgttagtcatacttttcgtttcatttacgttgtaaattgtaatagggttcaccagtttaggatttacttataagtataggcttgctttgttcaaaaaggaaaaaaaaaagaagtaataaattatatgtttcaatattatttgaaataatatatgaaaaatgttataaaattagaacttaactacaattagaacactttgtttgtgaaattcaacatatatatatattggatgatttttaattaattaattaatagtataaaagaatttatattaacagtgtatcaaaattgaattcataaaatcattaaataaatttttattcataaatatttttattttaatcaaacaattattaatactattctgtttttacgaatagggatgtctaactaaatagctaacagattaatcttgaatcaataactctccataactctctcttaggtatttatggatgaaataccctagaataagcagattaccgtgcacatcgataaggcatttagccaatggacttgatgtgtatgtaaagtgacaacatacaatagaattaagagataatccacatacctgtgagagaatctcttattcataagggagttacatttaggttaattgctaccatcttgtgcttaaataagatataacatcttgattagataatatatactaccttttgggattaggatatgtgtttgttgaaatctccttctatggtcgttaaacactttgttgagattttctcaattattgttgagattcttaattaatgaatccttaatgagaaattttaataatgcccattaggtccttaaaaaattataaattaattaaacttacttaccaaattcacttcgaattatctcttattaatacagttgccaacccttcccatgattgtgagactcacaatataaagacaaagtgatcatttaattttcaatatagtgaagacaagattggggctttatcattcaatttcaggacccatccacccgtttgatttcttcgagggacttctatttaatcatgaatatcttttcttttgttttctttttatttcgctaaattttcggtgcattaatcactcccctatgtgagaaagatgtttgaacctcttcccactataatttaagtgaaaacaattatattttttctaaagagaagtgacaacaaattagttaattactttattcgtgtcagaccaaattaacatcgtttacgaattataatctaaccatgctatttaagttaaaataactttaaaaaagaaccttaggttataaacctattgctattaaaaaagttaatcaaataattcatattagatgtatactgacaaaatatatatccatatatatatatattatttaagcaattaacaaagatttaattttgtaaggaaaacgtagacttatttattttattaagacagttatatgtacagtttataaatatattgaacttgagatattaaatttttaaagcttagaaattttggaaaggggggactcaattaatagtgcttttattgaaggaattttcaatttattttcgagaaagtatacatacaagattaaaaatatacaaatattgaaaatacacaaaatgtgaaatcacaaaatcatcttattttgccataaaaatgatgattatttgtgaagaaggccaaaaagacaactattatgcacaccaaatgcataatatatgaaaatactgccaatattaattatctaatagggcaccaaataaaatgcttgaactgcttaaaatgcacttttaaatttactggtagccaattcgttagcgtggctcattattgttggaatttacagcactccaacaattcctcagtcaacattttcactaggtcgtacgtgtccactgtcatgctgaattcatggtccatctacagtataaaacaaccatatattgattattaatgttccatacgataaacatgcaagtgtgagaaagatactaactaatttaacttttcctagaaagtaaatatcaattgattttaaatatatagtaagcatgtaagtgttagaaagaaatgtctatccttataattatccttagaaatttataatgtaatttcgatttatctaaacaaaaactatgtgcttttgatccctttaatttaatttttatacttatatccttttattttcaaagtttagcatatttagtcctccatgcacggatttttttacgacctccaaattcttttataataaaaaaatttggtttgtgatgaaactaataattaaatgatattaaaagtttagcaataaaagaatcaatagaaacttggttgaaacaagatttgaaattagaattagggacgacaattctttagatatttttatgggtcggttttgaaaagaaggaaatttaaatttattcaatttaatttgtaaagattatgactaggaaaatagaatttgagggttttgtttgtagaaaatttatgaaaggaccaattttttatattttaaaataaaataatttaattaacttgaaaaataacttaaaagaaccaaaataacataaaatccaaactagaagaaccaaagatatacttaccaaagtaattacatgcatgtatattgaagatgaaaaaagacattagaaaaagtgtttttttatgttttggcttttccaaagagagtaacttgcttttaatgataaagtaagcaatgtaaatacatgtttggatttgtaaacttaagttttggttaaacttaagtttataaactaaatttgtaaaggaatttcaagtcttatttttttttttttaaaactgagtttttaaacaaaattttactctaaaatatacttttggtgtaactaaattaacatgatcccaaactgttttgacctccaaacaaactttaatttggaacactttcaccgaaaatctaaacatagtctgatgagccatttttcttatcgacacataccctaattgatgaaataattattttctaatgctctaacacattcatgatttgttattattatgcatgtaatattatctaattgattttctcattaatgactgatattgtttatttcatagttaattacacttatacttcctaaagttattttcaattgtacataataatctagctccttgctccttttaacttttacaatagattttcttacaattaaaggtccatgatataatattttttaaataattaaaggattaacataatataaggattgtcgcacagaaaaaatataatgtattagtattatcagtagtgtaggaataaaaaagaacgaatattttgtgtaatatgaaactatctcgagaaatattaatgtaatagataaaatctgatcttcaacagtaatttactttctttttatcctctaaaatgagttgtttactttagagaaatcttatcctttttctaaacatcaaagtataaagatgaaaagttatcctattgattcttttttggctaactatctcatttaattttaaaatataatttttgacatgaactatggaacatgaaactgatctcttctaatcacgtcattataataatggtgtgcacctaccatagcaatgcttgtaatgctgagagaggaattcccaaaaggtaagacattgctacacactatggagagattataagcttcaagcttggccagtagcttgcgtacaatgtccttttgcttctcacacgttactctgatgagaacatcttttcctgagactcttgcttcaactttgggacatttctttataggtttatcatcacaggttttgtttattttgaaacatcctaaggattccgtctttctcttcttgttctcttgttctaaatctttcacatgctgttgaagatatttcacatactctatagcgttgctaaggacagaagccttgtccatctacacattaattagaaatatcttaattattattttataagctaataatggattggtgtgatataaatttcttaagtttggcttcgatattacaataacaacaaaaactttattccactagatgaatcattcatctctctctctctctctctctctctatatatatatatatatatatatatcacaagaaatcattaaactagcttaaaaatcaaattctgggaaatattattattaggcattgaaatcaaactagcatgaatcattcatgctattcaaagtttagtttaaatttcaacaaagggatctcatattttgtatggtatcccatagtgtttcggatatgattacctcaaatttagtatttctgagggggaaaaaattatgtcattaaaaagtaagatactcatatttagtatccgacaatttctcaaacagttgtgagaaagaaaaaatcatgctattaaaaagtaacaaaacatatgaactgacctttttcaagtctggaataagtgctgaaagtgctataaacattctgctgatattctctctcctttttctttcagccattatgtgatcaagtgtctgagaaaagcttctgcccctcttgaggcgtttgctattgtgtggcttttcttgtgtctcctttgaagtggaatcctcaaaagacagaatgcaagactttggtttctgtggagaagcatcttgtttgagacttgtcatatcgaagccagtgttgatctcttccaaagatgaagaattgctcacaagggtggtgctttctttagtgagatatgaataagagtgattttcccatgagagttcaccaggatccactgaattctctccctccaattgttcctcaacagagttaatgtcatattcactgaataaacgatagtcattagtgtcctgcaagcacaaaaaaatagaataattttcaggaacaaagttatgtacataacgtatataatcataattatatatcatatgttaatatatatatatatatatatatatatatatatatatatatattatgattgattcggatctcctattaccaaaatagaaacccattttagccatgactcatccattgggtacttaaatttggaaaaacttgttcctgtttatatatatgcttcagctattgaagaaagcagcgacaaactcaacgatgtaggactccatgcaattattatcatgatttttattattattgataaaagtattattacgagagaaaatatgtggcagatgctaaagacacgttcctcacacttttctttaataagtgttgtcatcgttgcaattacgtcatgcattatcgtggtttgacatttgataggtgattatcttttaatttctagtgtgtggatgttctgttgagtattattaatatcattaatctaaatcaaagataataacaataagggacagaaaaaaatttctccttaatttctaatgtggctatatatttttgaattggagatttgcatttaaagtaaaacgaccctttgtggtaatcattttaagagcttggtactaggtatgcctttattttgttttgcatatatttagaattttttgttgtcttgttttatatttattgattggtatgcctttattaaaacttttttatatattaactatacacattaaactctttaatatttctttatttatatatcaataaatataatataatgatattttctatcaataaatattaattattaataatattaatatttattagtagagaaaatcatactcgaaatctattttctcttttgttctcccttaaatgtagtagtaatatttttttttcatgattgcatatcccaacttttggcatcttgcacgggacaaagttagaagcacataaagattttgaaaaagaaatgcgagtgcaccaaatgtacaccaaataacttaaactcccattggtttgcattttcaacgcactcaaattgccggttgaccataggggaaaattattcatcctgttttatcatctcgtactaaaaaaaaaaaaggcttatttggatttgaaattgattaagcggttgcttctcttggaatatcttctaagaaatgaagccttgaaagaagaaattgattggtggatgaggtggtagaagaggtcacggtttgtaggcagcaaatagaaggcaagacaatgaaagcaagatccaaggaaaattggaattggccttggctttgggatgctagctcctacatgtaacacccccatatgcatctggtgtattaacaattacttaatcagattaacgcagtaattaatttaaaaccaattaagtaaaaacaacagaagcgttttcaataaaaacatgacgtcatcgtcatttcctttcaaaaccatatttcctgattcattatgtatggtgcgtatccatgatacataaacgaatgccacgataccacaacaagcctctacgatccagataacataaagaatgacaggtaaaggcaaaatatatccatacagatagaacaggagaatcaaaagccacatatgtctatatgtctatatgggtatatacatatatacatcaccaaaaaccaccactgtggctatacaaaagaatgggcaccctgtgccatgatctcacatatcacatcctcacaagagggtacaaaacgtacaacatctgtacatcacatccatacaggatccaaaatatgtgtacactcacatcttccctcgcagggtacaaaatacatcataaacataaaatagtgagccacaatgctctcgaaatattgccaagcagctacatagagtctatccctaatggggtctcccgccctgggacccatcacctctaccagatgtatcatctgcaaaatataatcctcacacatggggtgagatacaatctcagtaagctcagggttcttggagggttctcctccccctggctcacttctatgatacataacatcaaaggcatcacaacaccaggcctcatggccctcacaacaacatatagacattctctagctctaatgtgtatctgcggtactacgcccaccaaagatgcatcatcatcagcatcaggactctcagtcctcaatgtgagactggaactcacacacgtgtcatcccatcgggagctatccctttacacatggatgcacgtatatggcacttctgagaataggcttcaactgcgacgagaccacctatctcaggtgttaagggatcatacaccctttacgtgagcaaactgactaggagttgcgctctactcctagggaggtccatatttatctaactggccagaagatctatctgaaaggcaaccaaacacaaagcatagaaacatgcatacatattatcatgaagaaagctgtaacatccaattcaatgcatatgaatcatgtatgcaaccatcactcccttggagtatggtggaactcaagcagtgggaaacgctcccaagaacaaagaacttaccaggcaaaaccgtgctctgctgttcaatccctgaaatgtgatctccgccactgacaccctcggtgtcacgccctatacaaaggcacacaagtaatcaacaatggttcttaacctttagaaagaaaaggaaagcaattcttttccatataaacctcttttctaagttataagaacaagtcacctaaccaatgacttacagaccctcagcaggatctatccaggcctaaccaaagccctagagtctttctaagactctgcataagtcaattcaaagagttcaacactctatccaagccacatttcaaagattatcaaggctaaaacggttacttcaacacattttcaccgtttatataatcttctaaacgcatcttgtgaaggcaccaaggcccaaacataccatatcatcatcaatttaaccaacattcatcctacacatacattctttagagccaaattccaaagtccataaaatttatatttcaaggctaaaccttcctcacaatgacctcctaagcatacttttccaaaggacccaagcctaatttcagctctaactcaaatgggtcactattcacctcaagaataaattcttaaataatcggtagaatttgagtttcttacctccaaatagacaaggaaggttagaggacaacttttccaagcttgggtgtccttaaaacacctcctttccctttgaaatcaaaactcggaaagtttcctagagaaaacgatctctccgtttgatgatttttagggaaaattggtgatgaaatctagctcatagaatgattaccttcaagtttcatgttgggtgtgaagtgttttgtcaatggttgagtgggtacggagcttcccaagcttaacaatggtggaaaaatgctcaaaggaagaagaaaggtgcgttttggccagaaaacacgtgaaatggccttttatagtggcccagatcgcgtcctggcactaattgtgccacgcgtaaaattggctttctggcgcacttctgatgctactggcaccatcttggcattaacggcgccgcatatggcgctattcgcgtcaggaactagccgtcaccgattccgtcgccaattacgtcgctaatgtttttttgcgatagaatattgtaaatttaaacttttttttaggcttggtcattatattacgtgaattttttccacagctctaactatttatactcatttattcaattgtgttttaagtgatttagttgggttataactgaattaggatttagtttggttagaatttaactaggtaatcattaccttagaagatattatgacttaagcattatcttgacttgatttttcttggtcaagattccattgaattcttgacttgggggcagctagcctatgcacgtggaaaggcttattcaagaggaaaaatttgattggtttaatgcttttggctgaaaatcatctcttggtcctaagttaattagttgccatgtgtaacaaattttttttccacttccaaatggcctagaaagttcatgtatggcttgcttggtcttattgagaactcttgtgcacgtgggattgatcttggcatgaggaaacctctgattttgtcaccttttgggttgaagattctattccttgggtcaaaatttcaagagttacaagttgtgcccaatccaaatggtccaaagggctagaaacacttaatcagatggggctcgctcattgtttattttgtaccaatatattggtccaaaaatttctcatcttctagtatgctaaactagacttcctaagatttctaacaaggtatcatatgccttatttggagttataaaactcaagatatggcatttttaatctacacttccaaaactgccagcgaattcaacttaggacaatgacatcccttagtgtttttgttatttcaggcagtacacaatctagattgatctgaaatttttatatgttatagtagacatctagatatttaattccatataccatacactaaatttggataagaattgagagagaaataaactttcaaattcgggtggcagaaacggaagatttggacagcttatgtacaaataaaatttatcctattcttcttgtatccaactatcatcctacttccataattaaatcataaatacaactcataatataattttgaggatgttacaaatttacttgacaattgtctagagttcagtggtctcctttcattttatgttatgctttccacaattttctcctttaggcccttcatatttctcaatgttgttagttctcacctcaattagctgagtctaattattgacaggtttgcataggtgtgacaaaagataaaaccttaagtggatcaattgcttatggtttgatttcaacagaggtatattatcacaagaagaaaaaaatattattgaacttcactttctttttcttatttttgctgcacatccattttgtcattaataaactatgctagatcttgtaattttttaaatatctttccagtatatcttaactacctttttaagaattatatgtgttcaaatatctttcttatcatcttttctctttttctcaattctgaaacgttcttttttctgatgttctctgtcttctcaccatttttctctcttttcttaccttctacattcactcaatttattttctctctcttctaaaaataaaccagtgaaatatctttttatttcttcgttaaccgttcaacatcgcaacccttgctgaagatgcctttgttagccactgttactataacttcttcataatttttttcatgatttatggtgatttgtagcaacaaatgttaacaattttcttattttctattttcttggttgattttgttttgccctaattactttattttttcctccttcatcaaaatttctctaatattgtgaatatggactaaatttttctaaaaagtttatttgatatgtcctattggttaaagtattttgtggaaaaagatactaaacgggtctttataagaattgatgagaattggagaatttttaaatatttatttgattttgttctagactgatttttgggttgcaaattatgtgtttgatcaaatgttaaaatgacatttttgggtatgtttccttattttttcttttacttttaaatttatgacacttttgagactacttttcatatgagaaccagtgttattaaaatcgattcggccattgatccagttaaggtaatgggtcagtgggttagtggtccaaccggtgagtcagtaattgacccgatttgaccctgtctatattaaaaaaatttaaaatatattatatataaatacataactaacattatttgattaagaaaaatatattcaaatattcaaaataacaattgaaatattaaagttgataatacaagtaaagtgtattaataataaaagagtgtaaatagtaactacttacattagaacacaagcccaatttttaaaataaaaaaatgagccaaaaggagtatagaaagaaaaaagaggggtacaagaagcaaatgtggttctgaggcccaaaacgaaaacctaatcccctactatatattctttcttatttccatccagtgcctctttttcttattttctcccttctctctatgtgctgctccctacacccttcccctagccgtgccgtgccgcgtcgcgcctcaccgatccgcgcctcgccccgcccctcaacgttagtatactcattttctctcttctctctctacctgttggtctgctaccctcttcctcttttctctcttcctgctggtctgctacctttattcacgttatcggcaacgaggtcgctcgcggcgatggttgagtggtgtccacgacgtgcacaactcagtctgattttttaaaacttgtccgggtcgtcggattcttcaaaaatctgctgattcttgtcaggcctgacctagccacttgcatgaccggttccacacccaacccggcctggagccaccaccggttcccggtctaaccaatccgatcggcgggtccgaaccgattttaataacactgatgagaactttttagttgattccgtcggtttggtattatcttatagagagaaatgaagatattacttggctaaattgaaagataagagctaaacaagttgaaagtttactagcataacattaattttacataatttttttgttgttttctttaatttaagttcataaatgaaaatattttgtctaacaacaaatgatgtcattttgaagtcctaccttttttgtcacatttatgttaccaacaaattcaatcacctatgcaagttatatatataccaaattcattttcaactaattatgacgtacatgacaagtttattgacttcattgtacacaaattctcttatattatgactgtttcataatttttcttgattttggatcacttcatctatatactatctactttattaacaaaaataatctcatttatcatgttctctgagtttagctttgacaagcttattttgttctttatatttcactatccttcgtcatgaccaggttgaatagagctgtcatggggaacaaaagtattaatgaataagaaaatttaatgaaaaaacctaccttagtatcaagcataatgacatagaatataccagtgttgttgttcatttcctgattatggttataggtgccatgagagaaattgaaacaagcaatgttcatgcctatccaaagaagtttctcaatcatttccacatttgcctatcacaggttcctctacttaggttgctcaactttaagttatgaccatactaaaatacttataagaataactttatattatcatattccaatatattttcttatcaacaaatttctttatttttgcaactcatcatgattctaacagtatgttcaatcatcacaacacattctctaaaacctccaccatcgttcatcatcggacgtcgctgggaaacccccgaagtcgctgctccttcctcctccgtcgtcagcttcacgctcatataagggtttcaacctccttctcttttgttcgacctcatttctgctccttcctcctttgccttcagcttctcgctcggacaaggtttgcaaccttcttctcttttgttcgacctcatttctgctccttcctcctccgccgccagcttcacgctttcctgaatgagtgtcatttataaggaccaaatgattattttaaacttttttttcattaacataatcttttaattatccattgcaatgctatgcaggttcagttaaatcctttcaggcaacccatcattttattttatataaatttgtattatgtaaaagcaaatattttgtttttattttttattttgaaatatgattctattttgttaacataatagaatggagtcaaacataaatcaaagcaatagttcaatacaatccaatgcagaccattgtggaattatgttactaaaattggggatgaaaatgaagcaggagggaatatgacttggaagtgtaacttttgcaaacttgaatatagaagttcatacgcgagagtaaaggctcatttgttaaagattaaatgtaaagggattggaatatgtaagagtgttaaggaggcatctttgatggaaatgggaaaattggaagaggaatattctgaaagggtgaggaataatgcaccgagacatgttcctttaccacccacaagcttttcagctacaactagtacatctgctaaaagaaaaagaagcgatgaaggaactgcaagcatgagtcctgttgagagggctttcaatatgggagagcaggaagaattaaatcatattattgctcggatgttttattttgttggattgccatttcatttggcaaggaactcgtactttcatcaagcatttacttatgctgcatacataacattggaggtatttaatgttatgaaatattatgtttctttttatctcatttatttcccttatttttaactattttctgttgtgacttcaggttatcgactccctagctataacttgttgcgaactactctgttgcaacaagagaaggataatgttaataggttgtgtatccctgcccgatctctttggagaacaaacggtgtgagtattgtcagtgatgggtagagtgattcccaaagaagaccaataattaattttatggcagtatgtgatggtgcagccatgtttttgagaagtattgattgttctggtgatatcaaggataaatattttatcttcaacttgctaaaggaagtaattcaagaagttggggtggagaaggtggttcaggtaattactgatattgctactaattgtaagggtgcagggcaagttattgagcaagaatattcgactatcagttggacaccatgtgttgttcacacgttgaatttggctttgaagaacatttgtgtaggcaaaaatgtggagaataatgagattacttatggagaatgtagttggatatctaatattgttggccatgtttcaacaatcaagactttcatcatgactcattctattagattgtccatgtttaatgagtttgtgcttttgaagttcttcctattgctaacacccgatttgtttccatgattgtgatgttaaagaggttcaggttgataaagggtggcctccaaaacatggtcatttgtgaaaaatggagtatttataaagatgatcattaaggaagggcaagatttgtgaaggagaagatattagatgatgagttctgggcagaccttgattacatccttgctttcactactcctatttatgatatgatcaggttttgtgatactgataaaccttgtcttcatttggtttatgatatgtgagatgcaatgattgagaaggtaaagaatgtaatatacttaaaagaaggacggatgaatggtgaggaatcaacattttttttcatgtggtgtatcatattcttatagatcgttggaccaaaagttcaactccctttcattgtttggcacatgctttgcatcccaagtaagttttttttataattttaacttagtttaataattatattatttgaatccattttgaaacttctaatttttttgattttggtagatactacagtgatcaatggcttgttgaagatccaagttgagtttcaccaaatgatgatgtggagattaatttagaagtaaaaaagtgcttcaggagacatttttctagtgtggagaaaaagggctatagtaaattaagagtatgtcaactttgttcaaatgaaaggaggttttagagagtttgacgctattgaagatcgatataaaatgaatcccaatgattggtgaggggttcatagttgtagtgcacctttgcttaaaaaactagctttgaaactcactgcacaaccctcttcttcatcatgtgctgaacacaattggagtacctcttttgtgcattccatgaagaggaataaaatggatcccaaaagagctgaagacttagtttacatacataggagcctccgactcttatcaagaaagagtccaaaatataatgaaggagaaagtcagtatcgggacattagtggagatgcagttgatacctttaatgatgttagagctttagatggtgctaccctttccctagatgagttaaagttggaggcaaatgttattagtagcactccatatccacactagttgaggtatttatcaatttcgtatggataacctattatttgtgcttatgattttccttttattatattttattaatatgaaatacattctatataaaaaaatattatttaatactaagacatatcggaaacgtatcaaaatattagtatttttgaagtaatatatcgacgttccgtatcgggaacgtatcgaaaatgctgtgttggtatcggtgcttcataggagataagtgataacagactcacttagcacagttttagagttccatcataaatgttgatgggtgcaaaccgatcgacataaaataaatacaagcgtttatactttatataaacacatgcacaataaaacacttcaaatgtgtaattgttctcaagatttgaggtaggagagaaaaggatcgatgtaagtaaatcttctctaatatacatgtggatgacaatatttttatgggaaagacttgatcgaagaatgtgatgactattaaaaacatcctagatgttttaaattaattttcggactaaaagttaatttcttgtaaggtgcttatatgtaactatatcaagtatttcaacaacaccttacacaaaaactagaaacaacaacgacaatccaagaccaaaaaagaagaacgcgcgtatgagttgtatcatcatgtagttgaatgtacatacgtactgcaattcccatcacaagttgataactgatcgatgatgacacatacacaataacaagctgcatcaaaatgcaaaatgcaaaacctcactactacacgaataacatttaacgacagacattctacatcaattattacaaaccgtcgtagttgacaacgcggtggcatttttgtaataatgtcgactgtccaacgacggttctttggaaacccgtcgttattggtgagaacgatgacagttgttggtgaaccgccttagtaaattccgattcaaaaacgggtttatcgttaaaccgtcgttgtccttttaatcaattttatttcattttggaatcccggccttgcccttcgtacgacaccctaaaattaagacatagtgcccccaatccaaaccctaaaacttacacttctccttcgaacaacccaaggacccttccgcctgtaaaccccttcgttcaaattcataattgtagcagtcgatcagttccaaaggccaaggtaaggctggaaacaagtttttgtttactctagagtgtttgcttggtgcctgttgttcttgatgtgtttgcacacatgcgtttgtgtacatactcaactcttaaaactttaaagttcatttgaaataaataatcaacagcttttgttgattttatactatgcccaaaaatagtctccttccttcccatagctttggattctgctttatgatttgtctatgttcttcatttgataaatgatgttttggattgaaattgtactcgggatgtggctgttcacccgttgaagtactttttgaggattttttccattttttcaattggcttattattttttcattttccaccatcacactgatttcaatgtttgagttggcaaaagaaggtgtgtgatagtggcctagttgcatcttttactcattaacttttggttattgcaaactatttctatctaaacatccttaaaccatccaacaaattaaagtggattctcactttgtttttccttggtcatggttataggctttaacaactaatgtcagtccttcatatccatagaggtgcaagggaattatttcttgtccttgctagcaatctctgctccatttgtacagtctaattaatgttacaccagagtcagaaacttggacattggttagagatttgttgtccttgcttgcaatctctgctccatttactatttatcaccatacatcagtaaatttatttcaaattccaagctgaatgaattgtgatatgatttaaaggtatccatgcataataatattttcaattaattgatttagtttctgttaatttaatgctggagatcaacttctgttttgtttgggtagctcctgttaaaaccttaggacatgtcaaagataagattgtgaatacaagcaatttgggcaggggctgtttaaagttgcaatgctttaaatactaaataaattatgattgaaacaatagtcagagataatcatgttctggcactacaatctctaaaattctctttgacctcatcgcactataagtctacttgctttattgtgtggaaaggttggaattggaacatgaaaaattaataaaagaccaagtaaaatagattttcaaagaccaggtaaaagagatttccaaccctagttatagcttagaatgagaatgtgttataattattgtattttattgttttgtctgtggctttgttatatgcaactcaaatgtaaactgtgaagtggctttcattccaaaatttttgtattaccattttccatgtactgaacgaaccaagttgatgtaattgtcagtttagaaccaatgttagttactatgttgtaagattgtgaaactactttggttaggttctctgagtgttgtcaaatcataaacaaattgggattacaagcatgtaacttggtttgattttgcagtggtaaccaagtttcatccagcaactaaaaagacaattcaagggcaaggctaccacccattttacggtatcttatccctttttgtttcaatatcatgtccctatttggatctatgaaataaaaaagaatatgaaactgtaattagggtcttcatagaccttcaacttcatagacattccttttatgtgttttttcgtcttttggtttggattaaccttggttgacagtttggtgagtgtatatggacacacattcatggctgtttactaataacactaagaatgtcaaagcaaaattggcccgcttgatagcaaaagccatggatcataatggcaaactatctagctagcactgacatatatgtagttttggtccctttgataattatcttataacaataacaaaaagagatggggttggagtctggtgcatagttatctataatcacaactaactatgtaagtcttcatctagttgaaacatataaaatgtgggttttagagcactgaaggtcaaaccaagcatacactagcatggttgcctaaaatagatagtgtgggtacctaggtgcagggaatggagtggaaaacaactccctgcctcagatggttggcccaaggctaaaagggttaattttgagccttaggtgaacctaaagtgacatagtcaaaggattccagcttcgaaccaaagacttgaaattttacccatgatcaaggactacttctgtcagtctaattaactgtttatatatttagttttgtgagtattcaattccttgtagaccaatgataagttctaagtgttaatttcgggaatgcagaaaaagaattttcacagcatgaagctgttttatttctctgagtgataaaaattgcaggaacctaaacctattatatataaaatgagattaaagtagatgaacattcgaaattaatcaaactagaaactcaattttgggtagggtatgtttaaagtataatatcaatgatctgtatatattgataatacttaagacagttaaaatcagagtaattaggtgggcactaattttatctatcggactatactacaaaatagaagcatttaattattcaatagttttttttttttggagtttattagaataatgcaaagtgtgtcgtttatataagttgtttggccaattttcattgtcaagttatcattctggtttggctgaaaatttataagacattacattattgcatatatctccattgttgactgaaggaaagtgaggttcattaaactattaaagcatttgtgcctctgactttgaccacatggtacagaggataatagcaggtaaaaagggtctgaataaaaacgttaaaaagggtctgaacatgaaagcaacagtccattatataggtactttaaaagagctttgattaattggttctatctaatggcctttaaggacaacatgataaagatttttactttctttatggttcctagagtaagagaaagctgccgacagtgtggtcaataaggttttatggcgtttcatgctaccacactttcatttccctagcaagtaccatagttgttgatttgaaagggagctacatgaagaattacatgaagatcaagcaatgtgaagtcttggatgaagttttggctttcaacatgcatgaagccttgaagaagaaagtttgtgcttaaaagtaaaaggattaaaagcattctgatgatccaagctttgcatgcattcctttcatacacattttaagcattgcatcatataagctttaagtaattgttttaaaatttaagaaaaagctaagtgttttggaaaaatagcctaaaactggtttaatcgattaatacacttagagaatcgattattttgttcatcaagctttctggaaaataattatgaacacttaatcgattaccacgtcagattaatcgattatttgaactttagcatacttggaatatggctgtgtgactggtttaatcgattaccatatagccgtaatcgattacatggttgttttgaaaatatagtcacgctgccttaatcgattaccacttcttgtaatcgattatttagttcacttcatgttttgcatccatgctggcttaatcgattaccaataattgtaatcgattatattacacacatgatttttaacatggtctggcttaatcgattattatggactgtaatcgattattttacttaaacatgattttatgcttagtatgttttaatcgattacacgtcgggttaatcgattattttacccgttaactgaaatcaagaactttccaagaacgttttaatcgattacaggagcctgagaagcgcttttaatcgattaattctgttacagattttagtataaatagaacccttgccttttgtgatcaacaacagagagaattaagtacaaacatgatattttcgaattctgagcattgaaaaagctttctaaggattcacaaaggcattcttttgggttcataggtcttgcttccattgattcatctatgggtcactaaggatctagtgaagcaaggcaatctttcacaaaggctaaggaaacctgattctgcataattgattctgcattcatcctgagattttcattgttatgcatttcattcttggatcatcaggtgaattctttccttattctttgtgggtgtaaagttttctgttgtaacttttgatttggttgattatattgtaagtgggttttcttgcaagaggagatagtgtttctccaaggacagttgagtagtgttctcagtgtgggtgtggcttctaagggtctaatagggttttagatctctgaacttcatctagggttgatgaagagaagcttgtaattgcttgtaagactaatatttgcaatagtggaactctactctagtgttgagtagaagaaactggatgtagcctcatagggtttaaggtgaaccagtataaaacttgtgtgtgctttcctattcttcaaacttaattgttttccttgtgaattctgtttatatgttggttcttgaggcattacaagtcttggattgatattggataaagattcttgattgtttttgtgataaagatccaaagggcaaaaaaactctgattttgatttatcaaagaaatttttaatttactaaggttaaccaattcacccccccctcttggttaagtgtgaagtgttccttattttcacaatagttatttttgtgaataagaggacgaaaacacaagtatttatcaaaatgttgttattttgattgtactgcctaatagcttaacaatgaaaataaaatcgccaaagtccaaagataatcaatggtaattatatgacaagaattatcttgatttaggggttatattgtggcacttcaacatccaatatgatttgtctttatgattgcatttctgatatatagcatgaagaatttgatgcatataagggtggcttaaactttgaaaacaattaacaatataacattccacttgaacttttaatcaaagaaccataaatttcattataataataattgggaacttgggacccacactaagaaaaaagcaagttgggcaaatatcagttaatttttactagacaacactagcacaacatcatattggatgacatttggtctttcagtgtatatatataaacacacattttgatagatgaaatataaactaaggaatgttaagctgggaaatctagagttaaggtaaacaccatatttttttcctgtaaaagttgcatagtagagtatacaacagtttgctggcggttaagaagtccttgttaagtttataccttaggcttttggagagtcagttcttgccatatgacattagagcctctttgacaaatttgttatgggtttgtccttgctgcaccattcttgtaagttagaattcctacaatgtaaaatggaaatgcatgtgcactgtccacgcattaatcctaaagcgttcatgcttaacactgtgtttgataagattacatttttggtggagggacttgagcaaactttataattcaggtgtagaggaggattggtttaggaatagtattaaatggaaaatagggtctggagaaaaggtcttgttttgggaggatgattggatgaattctggagttcctttgaagtttaaatatcctagaatatttctaacttgtcagcaacaacagaacaatattctgcagatgggatccctatctaattcgaggtggatgtggaattttagatggaggaggtgttttatggagagtgaagtagcagtagtcatatcttttttaacagaactgcaaggtgtacaattacatggtcaggagcaggattcttgggtttgggagggtgattcaagtgggctatacactgtgggaagtgcttatagaatgctgaatgaggaaacaaatgctcagaatcaagaggaggtgtttaaagtcttgtggaagttacctgtccctagtaaagcttcctgttttgcttggaggttgataagggatcatttacctactaagaagaacttaaatagaagaaatatacctctatccgacatcagctgtcctttctgtagaaactctgtagaagacacatcacatttatttttcagatgctgtaaaatcctgccattatggtgggaatccctgaactggattaacactcaaggggttctccctataaatcctaaagaacattttatacaacatgcatattatggcttaatggttgtattcataaattctaataaagttgtaaactttaaagttgaatattcatatatagtaggcttcaaatttcacactgttgacttatttcaatgtatacacattaaataagtgtaaactgcaggatgaatcatccttaatctggattacaaatagtggagaaaaaaatctgaagctatcttctttctctagaattacaaactgtgagatttcttcccttaaatgtaactacatacaataccgtgaccttctttgttattaataaagcgatataaaaattggttcaaaaacttactcttatctgttcttgttttgtttcccttaatcttttgacaggctgttttccaacgttacttgcatgctgagaaggagtatttgtctttgtcacttatttacagtaacggaaagcgatcacttgatttggtttgtggcaatttatccaatttcattgatcactaaataattatttgttttcattttttgtattttcattattatacaaatttgtgtattgctattcagatttgtaaagataaggttgcgacagaagtgtggattgctggcctcaaatcactgatatcttttgttgaacgtggtcttcgaaaattgatggatggagtgatgggggtctcattcttaatgtaaatatactaacttgtgatttttctagttaattacatttttgtcacattatgtttcttgtatcttgtactaccctccataagatgtaaaggtgatagatgttagtatcggtttttttttttatcgccaaagataaatatatatatatatatatatatatatatatgcatatatatatatatatatatatatatatatatatatatataagtagagatcatagtacaagtagtaccattacaaaaacacctagcaccaaaggcaaacctgtggcaccttaattcatgagaagcatgaattaaagggccaaaggtctggatggattataggtaaccccaaaatacaggggaaaactagatacaaaaccctcccctaattacaaaagcctccctcaaatgttgaccaaaagtggaaggatatgccaaatcctttctccaagttcttaagccatgtccagcaggtgaagtgcgcgtcatccatcaatttaagattattaaaactttcattgtggaacataattctagttctatgcctccaaatagtccaggtcaaggctatccaccagattagccaggtatgcgaacaaaccccactgctgtaaaagaaccaaaaatttgactgaagtgttctatcgggtttttagagaagacacccgaaatatttccccatgacatggattctccctataacagcttcattctgtcacagctaagaaatagatgtgcagcctcctcatcattgttcctatagaaaggtcagagggtatcattgagacctatattcctcctgtgtagattcatctttgtaggtagtctgtcccaaaacaaatgccaggcaaagcatgatgctttggaggggatttttactttccacatgtccttcaatacttgatcttgctccacatctatccctggcttattatagaatctatacgcacctcccactgtgaattttccactcggatcagcctgccatttccatgaatcttgctgttgtgcttgtctaccacaatcctgtatgtcttctaaaaatttgaaagctgattccacctccccctccataaaagcccttctccaacgaagctgccactcccagccagaacatgatgggatccccatttgctaaatataattctgttgttcataagatatatgatatagtcgtgggtacttctccatcagcgataaaccctcattcctccatccgtcctcccaaaatagcatatttgatccacaacccacactccaagctatcccactcatcaacccgttccctgccccgttcaaattgcatgccagaccaagatccccccaccatattgattctcttgcagacctcctaggtccagccaggcttctccacccaccatatctcgattccaacacctgaacccacagctcattgtggtggtgaaacatgttctatatccacttcccaagtaaagcatggttgaatgtagttagatctttgatgcccaagcctccacggtcttttagttggcataccagatcccaccttacccaagccaactttttttggtcagcattcccaccccacaaaaatcttttctgaattctctcaatctagctaccaccttgttcggagccctgaaaaaagaaaacatgaaaatagcaatcgaatttaacactgatttaatagtgtcacccttcctccaaaggataagtgtttctatttccagcttgctaatttctgctcacatttcctgactacggaatcccacgtctcacatcgtcttggattagccccaatagggatacccaaataagaaaagggtatagacatcacactgcagttccaaaaagaagtagcattgtttgtccactgttcattcatgccaaaatacatcacactgctggacgtccccaaattgggttttattccaggctttcagcttctgtttgatggctttgagcttctctttgaatgcatatccccccaaccaatagttgtactaccctctataagcagtacagtcattgttagctttgatcttgagaaattttttgtaccatgacactcatcagtttatttacctcaaatgaagtggacttacctaacattatttgaatgaatccttgtcaacatttagaatagaaacaccttccacattttccttcattttccttttatttcattggtaaatggtggaagtaagtgccttcgtcaaacttggtttttctgtttgtgcatgtgtgagaatcattcattagacacagattatccataactatgcatatggctatcgagtttgtacattcaacttagttatcttcacatttctttctagatgatgacatgaaagagatatagttgtcagtagttggaaacggcttgcagactgcaatatcactgcgaagttctctggcaggtaatttcataaatcaattttatcttaattcagattaagcatttttatatggcattatcagaaatgttcattctatacttgatttggtgtgtttactagtttatgtggacccctcttaaagagtgaaagctacaggctcaaatgctcttcataactaaaactatacatatttacttaattactcctataagccgaaaaattagttgtgtttgaccctaaaaacttatgaagagaagacagtggcattaattggaagcatttttaaaatttatcaatgtattggctaacctatccattacgtaataactaataaaaacatatctacaactaatccaaatatgcaatatatatacaatgtaaaagtcactttctcataaatagtgacaattagtaaatagtgaaaattaaattaaaatgttaaatggtctcataggtctgccaagaaacaataaatatttaccatatatagtagctgtgtacattgtgacatgctgtccaatgtccatgatgacgatagccaaacacagtctaaaatttgagatgaacaatgcaagagcagtcatctcttggaacttatctcctgcaatgtcaaacaggtcttgtgcttcttcacttgtaatcgtctcctccaaagcctcagaacagagcttcatcccaagttcatgaaaatccaaatatctgtctgattcaaatcgaacatcgttctttaacagtttggcaaactgaattatccaatcctcaatgcaagcaaagctaacaatttcctttgcctttcccacaccaccactctcgagtgcaatgttaatgccaaccacttccaccacaaccactttaaatttctcaaaaggtggatcccgctgaggagaagattctactatgtacagtcacatagaaccattggatcctgtttcagcccatattaattcatcattagaagtcattgcgaccaaatcaccttgttggtccctgtatttgacaagaacaactcctaatcttgggaaatgctcatgaataacttctcttaactagaagcgactacaattaataggttgctcagtatatcttatatcatcaccaaaaataagtgtagctgttttattaggaacaggttcccttctaccattacttctttcctctataacttccttaatatcagccttcttctcatcaacttttacattggccttcttcttgttggacgtgttgatcttcttctctacaactacaacactgcccccatcttttctgtttgtcctcaaatttctcctcagtttgcttttctggaatttttccatctgctgcattgtcttccactttactagtagcaaatttactaaaaatatcatgggcccaagaactaactgggctcacacgacactccaataaagtccatgagcagacaacacacacgtgtaaaaatgtagaatatccctgtacacactgtttaagtcttgcaaatgcttccacaccaccacttgtcatctaagaaaaaaatgtacagaaagacaaaaagtgtaccagccattctctgtgctcttcatgactattgtcaccatcatgaaccttaacagctccagcaagtgttggaagcccttccgttaattcctcagaaatgaaccctttgtaaacacaacaaatcctcctcccccagcacacgatttggcctaaaatttgctgtgattattgttgcgaaaaccgcacactacggcaagtgcaccggtcatttcaagtaataaaataggtaagtgagtatcgtctcctcagggattgggttgaaatttacaacaatattaattctaagtaattggaagtaacagaaaagaaattattttggagaattgtgttgggtgttgaatgtaaaactgaaattaaaataaacagtaaaataaattgaaatattaccaatggaagaaacaattgtggtcaggcgcaatccctaatgttcactgcctcttttactcaactgggttatcaagtttgatcacaaatgatacatctttcctatttttgtaaatcctaattccttagcaatttaaccctttgacaacaatcctaattccttagtaattcttatcaagcatataaaagactatatcataagagttgctatttcttttgctcagagaataaatctttcctactttagttaatccctaattccttagtgaattaacctttaacctgaatcaaagacccaattccttggtgaaatctatcaagttaagcatgtaaaagactatattataaagttccgcagtcacgcatccctatccctaggtgatgaacaactgttattttactaaggtcagaaattagaaccccaacgtccccattgcgaatcctaaccctcaatacctaaattgaatgaccaattctaaataagaattaaacaatgaagagcaaagtaaaataaagcaataagaattctcattaaataccagtcaagttacagaggagtttacattagttcatgaccttcccacaatgcaaagtttagcctgacataggcttcaaagacaccaaagctgtcaaataaaacattattctgcagtgacctagccttgattcttgccttccaatggtgtagaatgatgtatagaagtgtagagaggtgtggaatggtgtgtaggtgtctttttcttcagtcccattggcctttatttatagattgatttaattcaagtaacaaagcctattttctgtgccaatttcgaactcaatctttttaattcaggaaacaacgccttcgcagcgcggctggcgcgggttgtggcgctgattgcgccagcagttcgaattcatggcactgatagcgtggatgtccgcgcagatcgcacgggttattcgagttgaaaggctgatccaggcatctggcacggatcgcgcaggacatggcgcggatagtgcggtggctttgatcaattggtgctggtagcgcggatacggcgcgactgcttcgagttgaatgcttggtttttctgtaatggcgcgactcgcgcggataccggcgcgatccgcgcgggactttgaatcttgttttcttctttatttggctttaaactcctcttttggccctgaaatacatactttagcaaagaatgagatataattaaatataaataacaattaagctaattctaacctatatttctatttatttgattgaattctaacctaaaactaacctaaaagtaagatgtgtttgcaacacatcaattatctttacctcatcataactgaatgaaatgaagggatttgcaactgagtcacgtcgtaggtcttctacttctttaggatttgatggttacttactatcatcatgcctttgtttggctccttggttttgtttttttggtgaatcaataagaaaaattaaaacaaattaatgcacatttaagtatattaaactctgaattctcaaaattaacataatatttattcccatttatatatattcatccaactattctccggaaagtaaccagatgttacattaatgagttaatacaatggaatgtcatacacaaaattatcaatacgttcactatctatgaataaccagatgcacaggcaatgaaaaacttaacaacgcatagcaaatttcaatcattaagggatcaaaagaagttagagctctaagccatatgaaatcagaaaaacaaacctcttgtttccatatggtcctagcccgaacaacataaaacacaagagtcaacagttcaatattcaccataaaaaaataacaacactttccaaatttcgaaaaagacacatatttataataaccatagtgcacacatgactcaaaagtgtttttgcacatagaaggtgagcacatcaccctcctataatggctttctttgcggacccattgaacaatttgtgtgtagacactactagtctcacactactacaaataacctaaatatttcctacatgtttggttgatgttgtctaatttgcatctaacttcagcaccattatttactttgtacgttattgctatcactaaatgatgtatgtatatctttatcactgtattaaataagtttgttttctggttttaggtgactgtttttaacgccattaccaccttaaaagcttgttttaccttcaaacaaacaacaatcagcaacctgcttcttatcgtggtcagccttgcaatcttcaacaataagggttaaattactagtcacaggtatgtctcctgtttcccagccttgaatgttttttacatgtgtgttcatatatccatattttggtttgtcatacatttgaatgcattgtgagtcaaccttagttttccgttcaagcttcaatgcagtgattaatgcgaatagcttggattaatcattgaattgaaacttgaattgtccgtttggacagtttaggaagttacattttatacatgaatgctcaatgtgaaagttaagtatggtttctttaatttaatgacatttcgatttattttattttgcgttgatctccgagtgcatacttgatcgggttgagcaaaacttacccctttcatttcgtgtacttggagaccaatgcaaaatgctgccgaaatttcgttaaattgaactaaccatagttaacttcgacattgacgattcatgcataaaatataacttcctgaatgggatagggctacaccttttcaacatgaagttgacatttgcattcatatggtaaaggtcatggatagaagttggatgagagcgtcccacattagtgacgagtacgaaaatggggtcgaacaattccttaattttaccacacttaatgcaccttctctgcatggaaaatatttttgtccttgtctcaaatgtgggaatggaagacgccagtcaattgacgacataagatcacatctcatatgtgatggcataattccaacatacacaaaatggatatggcatggtgaattggtagaaatgtcatctatcccaacccctgcgcctgttgatgtacacatagatgatcgtatagaagacatgctacgtgaccttggagaatccaattttcagcaagcccacacacctatgtattacaaagttcaaattgattcgaaaatccctttgtattcggcatgcacaacgtacacacgtttgttggcggtgttagcattggtgaatttgaaggcaagatttgggaggagtgacaaaagcttcactgaattgcttgttttgttgaggaagttgcttcttgaaggcaacactttgccaaaaaatcattacgaagcaaagaaaatattatgtcccatgggcatgcagtaccagaaaatacatgcatgtcgtaatgattgtgttttgtttaggaatgagtttgctgaaatgcataagtgccccacatgtggtgaatcacgatacaaagtcaacgatgacgaatgtagtgatgagactttcacaaacatgggtcgtccagcaaaggtatgttgctatcttccaattattccaaggtttaagcgtttgtttgctaacccacatgatgcaagaaacctgatttggcatgcaactggaaggaaaatggatggatttcttagacatccagccgattctcctcaatgggaaaaaattaatcgtttgtttccaacattcggtgacgacccaaggagcctacgactaggtcttgcatccgacggaatgaatccgtttggaaacctttccactaaccacagttcgtggcctgtgctattgatgatttacaacctccctccttggttatgcataaagcgaaagtacataatgttgtctatgatgatatcgggtccaagacagccaggcaatgatattgatgtttaccttgcgccactcatcgaagacttgacaaaaatgtgggttgacggggttgaggtgtatgacgcccatctgcaagagacctttactttgcgtgcaatgatattttgtacaattaatgactttccagcatatggaaatttgagtggatacagtgtgaaaagccattatgcatgtcctgcatgtgaaaaaaacacatcatttgtccaattgaaacatgggaagaagacaatatacacgaggcatcgaagatttctaacactatatcacccatatcgccgattgaaaaaagccttctatggttttcaggagaaacagtctgcgcctattccattaactgggcgtcaaatttatgatcgtgtttaggacattgtcactacatttggcaagacacaaaagaaggatgctaatgacaaatccctatggaagaaaaggtctatattttttatcttccttattggtcggatctggatgtcagacattgtattgatgtaatgcatgttgaaaaaaatgtttgtgataatttaattggcaccctcctgaacattaaaggcaagacaaaggataatttaaaatcctggcaagatcttgttgaaatgggtatacgtgaacagttgcatccaattagtaaaggccgacaaatgtatttgtcccctgcatgcaaatcttttgctttaactgtatgcaaatccctttttgtgcatcatctgggttggtgcagtaaatggtgaggcatgagtttgtgtggctgtctgttttcattgttttatttttaaaaaaaactaacaacgttttaaaaatagaaatcaacacacccttagaatatctatattatagcagtgattatgttgccaagtagagcaacattgaatacctcatgtccagaatcgtaaatatttcagtgctgccgtcatactgaatcttgtggatggactaacaaaggttgtgttcgaattccatgtcttcttaatggattagtcatgattggctaggcatttatgtcaaacttatgtcattggtgaatttttttttataatctgctctcttacttttgtacatttctacagcgagtaacaggcttatcaactcccttgactgtgagatcaatgtcacaattcaagtctgctgatgctgatccttcgagtatattgggtcaggtattgaagtgcatgatttgctgatcattgatgactaaccagtctggctttacaatatgtaggctaattgttcctttgctttctatccttgtcttcttcaaaatttaagattaatatttgtaccatgttagagactttgtgaagagatttgtaaccaaggttgtgcttggtgacaactaccctcaggtactactcacaacgttgattagcattattgtacaaatatgaatggtgaattatttatcatttgtagtatacattctagttctttcataagatagtcaaaacattattaacttcatcaaatgcaaaggaatcttcttagaaataattaactgaaacttttatactgagcagtgatctcactcgaaataatttcaatgtctcaattccaaaaagccttggacacctctcatcagttgtgactctgtaagtcatcattccctattcatctgtgtgtttttatcttgcttgctctattggtgaggcatgttcttcaaatgttaactaagaacctttgcaactgtctttttcattgttcttgctattgactttagttttcataaattgtaggtgtaaaactttttacattgttaactcattagaaatcaccctagataaggctttggtttttaagcgaggtaaatggcgcggtgtcatctatgtagccgacctcacttagtggggtaagactttattgttgttgtggtcaattagaaatcgccctggatatgagttttaaaatacttattacagaatcaattatcttaccatatatgacaacctataattggactcattcttagtgtaaaatcttctaaactatcattgcattttaattaaaaacaaaataatcctaaatggtgtttgcatgttccctcacagtacaattgcttcatgcttcaggtcacttttgggaaatcgacttactagttcaatttcctcagaaattggtgacatggctagtctgcaggaactgtaagcgtttgagaaaactatgctgtcaattgattaaaactggaggtggaataattatatttgtaatccatgtttacagcaacttggaagataatcaagttgaagtacctcttgccccgagccttggaaaaatgagcaacttgctgagattgtgagactatttgtttcatttttgtaatttcatttgattgacataatcaatttgaatcattaatttgtctccagattatctgcaatttcatactgttttctccacacatccctaactccttttttttctcactttaactaaatgaatctgcagacttctttctacaaataatttcacagggataataccagaaacatatggaaatctaaagcacctcactcagttgtaagtgatttaatgtgatgcaatttttcccccttagtctttattttatgtctgttaagttgtgaaatcacacaacattttctgcatgcagtaggatagatgggagcagtttatctgggaaaatacccagttttattgggaactggaccaaaattgatagattctgagtctaaatttggattcatccatgaccttttctctgttgaagaataaaataaagttatatcatgattaaattacattgtattatccaagaaaagtttgttcttccaaggatttgcagggcacatccttggaaggcccaattccttctgtcatatctgacttgacaactttgacagaattgtgagcactttgtccttttaagagtattccaaattattacattttctgtgcattttacaatggtaatggaatgcaatgtcctatagtgtaacattttcttttcactaatgaaacatttatatatcaggaggatatccatgatgaagggagcaagtatgacatttcctaatctcaagaatttgaaacttttgctaagactgtgagttgaaaccttcactggtcttacgcgaagaactatataattcatttagggttctatcatatttctgttacttagggaattgtggaattgcttaataactggtcccattccgaacttttgatttttgtttttctttctttccctgctttttcattaaccatattcatttttcttgataaattattcactttcactgtgtctctttgcagttcattcactgttcataaactgtggaggaactgaaacaaagtttgagtcaatgaatatgaagctgacctcagtctacgtggcatttcaaactatcttcctagtagtagtggcaaatgggcttatagcagcattggagtatatttacgaaatgaaaaagctgattacgtagcaacaaatcagttttctttgaataataatggccctcattactaccacacagcccgcacggcccctctgaaggataatgactatggcctttgaatgctgaacgacaattataaagtgaaacttcactttgctgagataccattctctgatgaccaatcatataacagcattgggaagcgtgttttcgatgtatcaattcaagtcagtaatgaagcaaacaatttcttacattttttttattgtttctcctaaaatttttctcatattttgtatatggttctctaataacacgagttctaaaggtagatattttcattactgtacatggacagggttttaactatttgaaagatcttaacattgcgaaagaagctggtggagttggtaaggttatgactagggagtttaatgttaatgttacagacaacaccttcgaaatccacttatcctgggcaaggaaaggaactaatgccattcctataagaggtgtatatggacctgtcatatatgctatcactgtgaccccaagtaagtcgttttgataatattggtgtcctctctttcaaatacctagtcctttcatgttctgtaagcatttccactttgttttagactttaaagtttatgcacatgggttctctacaggaacaattgttgggattgtagctggggcatgtgtgattgtcatattgatactctttgctctttggaagatgggtttcctttgtctgaaagatcaaacagaccaaggtaagattaaagtccaaattaagcaggcagttagagcccttatgatttggtttttgatattaagttcagattggtttgcagtcaaccatgatgcatatacatctattagaatcttgtaacatactaatagacatgacttttttttataaatattaatattagattatataccaacatgaaatttatcggcaaagatctaaattgtggtaattttaaggtaacaggaaatgcacacttggttcctcaaaaacaattctctgatttctctctttctgtatgtctttcataagtaatattcaattatacattttatttcaaactagctatatctaccttgttgcaacacttctaggtctgaaaacaggttatttcagtttaagacaaattaaagctgctactaataactttgacctatcaaataagataggtgaacgaggcttcggaccagtatacaaggtaaatttgataggttataatcatcttaagcaatatgaagttttgaaacattggggttaagtctttttatccccaatatttttaaacgtctcctcaaaatcagttaatatagtgtgagtttatgttggtaatgaagtgaacacaaaagctactgaaattttatctaagaagagctattaagactttagtctaatgtgtttattctttgcaattttataacaacttgttataacttctaggataatcaatccaattgtggtggctccaactgttgctgctgtaggtttagcattcttcagctatggctttccaaaagttggaacatgcatggaaattagcattctgcagatagtattagttctattattcacactggtgagggacgacctaagcatttcaaccaccactgatatagtataagctcctggtgcatgacaagtctttaaaatgactgtgaagttccttcttgtatattaaaaaggctgtctgtttcgtctcttaaaaaaaattattggtttttgtcctttaaatggtttcagttgttatctgaaactcatatgttagtttcttttattacagtagtgaagcatcatcgagaaaattcaatttttggacaccatgcatgatgaatttatgctataagtatcatgaattaaaatgttcctctttgattttttaaaatgtttcaacgtactgtttacttctgcatggctcagaattcctgaccctttacagtgggttttccctattttccattttaggacttgcataatcatgggcatcgtgtcgctggttgcctctgtggattcagtaagtacattgttaaaatgcttgcaagtgcaaaataacagcctgccattatgaatcctagaacaaacagaataagaagcttgatatggcatgaagctttctctcctatttaagtgtcttcattggtaattggtacattctttgtgagttatcttaaaagaggtgccaatgttgacttatgaatgtcacattaggcagaatataaaactcaacgagatacttaaatcacaggactgtctaactagattgacaatgtcaaaagggcaaaaccagtgaaatgttcaagatattttgtatttaaattgaataaaataacataaatacacacacaagaagagaaaggcattatcacaaaggttgttagagaaatattagtgttacaatggtaaagacatatttttgcctttttaacaccagaacatggaattttaacttgtcaccttatagccattttttgattgacttgaaataccagattgtagcaccttgtcgagtaaatgattttgtatgtggtagggctactgaatgggtctccaatggtacacatctttaacttgttgtaggttttcgagtgaaattcaccgatattgacatgttgggacctttgggtaaatttgacttgttattgttgggacatcattggttgcagtgaacgttactgcaaatgccatttatgatcccataggttcaattgtagttggcaacttacttggaatggtaaagagggtttagatgtgctttattgccagccttttgaagtggtatctattgtattttaattccattctgaattcatcatgcaggcagccatatttattatccagagaaactaacatgctttgattggtagagttatggatgaccataatatggaaaaagtactttagtttttgaaaaaggacctatacaagctttttgctagtttctatggaaatcacataaattttttgtccttcatttgactaaggttaatattttgctttaggttgtagattccctctatgattgcaaaagtgaagttattgggcctggattcttcagaccaaccaggcagaaataggttcctatctcatctttgttatagaattaaggacatgaattatgcatcaaggtgctaagctgatcattgttaatgaaacagattttaacggagagatggtggtgcaaatatatcttaaaaggaacggtcgtgaagagtggacaagacaggtagatatgctttataatgttcatgtaaaacctctgataatatgctgctatgttctgctgctgttattagcattattcgcctatggctgcttttgattacatgctaccaaaataggaatgcatttcacttagttctaatccaagccaatcctaatataagtttgcgggttacaataggaagccaaattttgttaaaaaaatagtttaaaaatatataactcagtaaataaataagaatataaaataaaaacataatctcctatatattgtatacatgcaccgtaaaataaacataaataaattacaataatataataaatcatccaaatatctcaacgttaaaattataaataaaaaaatagataaaaatcacacttgaatactcgatagatcaattgggttaagttatgcaaattagtaactttagtcctaatcaaatttaatccatgtagataatttaaatgggtttgctattgggtacaactcattttgatattccaaagaacaagatatcacagatttatactgtcatggagttaaattgttggatcaaattatcataacgggctttggagtcctagtatataatctagctacaattaataacattaatattatttgattaattttagtcaaagaaaataaatgattattttcatgtggtcttttaaaaagttaaattcattcattctcattaacttaaggtattcatatatgtttaacttttcttttgtattcatctttttttggttgttgttgacttctttcactaggatttcagtttgattatgtctttgcttggaccattttcattgatcacaaacttcaactgatggtgcccatgatcgtgctacaactatggaaaggagaaatattgctacaactatgtaaaaattaattgtgtattgtattttcacatttcgacatacattttatgaataactatctatctatatatatatatgaaataacttggcaaaatatgtttgttgttggccattttatttaatataatttttaattaataaattaaaattatatgaaataactgaatattaatgttaaaaaaaaaaacaggtattcattgacgtaagtttcaaagacggttgatcttaactgacttcgtatcgtagtttctaagacagtcgatcttaacaaccgtcttcatatcgcacattcaaagacggttatttgaaaaatcgtctttgtatcgcacattcaaagacggttttgcacataaaacagtcttcgtatcctacattcaaaggctgttcttataaaataccgtcttcgtatcctgcattcaaagacggttcttataaaagaccgtctttgtatccaacattcaaagacggttcttatataagactgtcttcgtatctcacattaaaagacggttttgagaaaaaaccgtctttgaaaccattttgaaaaaaaaaacgctacatacgaagatggttgctatcaacaaccgtcttcgtatcctacattcaaacaaggttcttatgtaagaccgtcttcgtatccaacattcaaagatgattcttatataagaccgtcttcgtatctcacattcaaagatggttgtgagaaataactgtctttgaaaccattttgcaaccgtcttcgtatcatacattcaaagatggttcttaactacaaccgtcgttaaatgtattttattttattttatttttaaaaaaaaaaatttcagattaagacggttgttcaaaataatcgtcgtaaaaagctggaaacaaagacggttccataactgtcattgaaaaccataattttctactacgcaagattcgaagacagttcaagaaccgtcgttgaaggcataaaacaaccgtcattaaagacctgctatgtagtagtgccttaactcttccattggatcggatgcaggtagttgagtatgcaacccattgaccgaatgaatatttgaaagccatcgtcttatttttcaactcctaaacaagccataaacatatataatatcgtcaatcaatttcgttttttacaaagcttctcccccaaaacacacaacctatcaaagttatttaatagctttgttagatctcttaagattatatatgtatacactactacaaaaatgctattttaagacggccaatttaagacggttgcccattaaccgttttaaaaggaggggcggtggcatttttgaaattaatagcaacatttcaaagacggttcccatttaaaccgtcttagatttctgaaaacgaagacggtcatcaggtaaccgtcttagattctgtgttttcatagacgggtgggtataaaaacgtcttgaaaaatgggttcaagaaaaggtgaaacgcagtcgttttgtacaccaatccggaatccccctcaccaaaaagaaaatcgaacccgaatcgtgttttctgccctaactctcattttagcttttcctctgtggttccctactctctcgtgccctaaacccttaaaggtgcagtccctctgaataccttgcttttgttctgcatctggtgtcctcagctcctcccatgaggcgcctcagctccgcctcacttcgaccattgaggtatgatccttgttcttgaccgtgccatttttcaacttaatagacattcagataataatgaatgtatacgaaaaacagttgggtctagcagaagatactagtatcccacaacttggtgaatcaatgttcgaatttcaacagtaaaatgaacccatgtttactatctgactatgtcttgaacactattgttttcatagaatgaaacatttggaaaaccaaataaaagataatgaatgtttgcattgattaaggtagaaggagaacaacagaagatgataacatactatttctctcattatttttagtctgtgtgtaaggtaaatttaactttctttttccctcaataattttccggcatttttaggtttgctccttgactggatcattagatgctactatatttctttgtccaaatgttatattgttgtaaggctaatttagttttaaatatagttaatgaagaagtgtacatgttcacatgtcttggtacattgctctgttactgtagtttacttattttcattctttattgccagtaatgagaacataagaatgcatttttcttgtgaatccatgaagtattgcactggatttgggtgtctagtgcttcatattaactccatatattcatcaccttaatttggaatgagattggggggaactcactctaagagagtaacatgaatcagaatgtcacaacaacacttgttaactagtatatgtaaccaaataagtttaagatttcagatccgtttctcccaccacaattgacaggtgtaaagaaaattgctattactgtttctcgtttaaaataagcaatctatcttcccctgaattatgttgttttccagcgcgtttcatgttgatgttatattttaagcaatgggacaaattgaaaagcaaatactgatatgctaaagtggagaaaatgggagaaattatgtacgatttatcagcaatgcatagatgggattcagtcaaacctgaaagcattgtacaacattgataaaatgaatgataaattccctggaaacccctcctatatccaaaaagaagcttgttgctttaacatatacaagtggtgacaattatttgacccaaaatgctcagcaaaatagacaccataagttggttgtagcgtgggcctacccacttacaagtggtgcctaaggaaccgtcgtattcactaaacatagaaatggataggtattatatgtctgcaaattagtataaattataaactctaagaaactttttgttattatttcaaagaagtgcaaattgacttgttagaaaatacacactttttaacattatgtacatgccatcactaatctatggtttcataatcatttggtactttgtgctgatgcaatgaagcctagtgtttaactagattgagcatttgtcttctaactcttccttcaccaattctgatacaatcacaaaattgtgatttcaattcaccttcgatcaataggaaattctgaataacatgcactcttttcagttgtgatttcattgtgaattgcttatactagtttgataggcaaaacaacctcaagaagcgatataaattcctattcctgtacttgaattttttcttcttttcactaatatgaatttttgttttaatgtagctgttcctttgtctatcgatcacaaacctaatagatctgatgaatgtcaaaggattgaacaggctgggggaatcataatttgggctggtaattttcttcctgtatgggtgtatgccatttttttagttcatacttcataataaagtgatgataaataaatttcttgcactgctgccggttgatccaggaacatggacagttggtggtgttctggctttttcccgtgcatttggagacaaacttcttaaggcgtatcttgttgctgacccagaaattcaggttgccaaaattataagcttgatcacccacttggtatatctgtgttgttatttgttatgcttgctaaattgctccttttttgttactgttatggcttaggaggaagacattaacggagtcgatttttatcatcaaaaaatagtcatggcctccgcaatgtcatatcaaacaaggtgagactatcttacttgttaaagttgggcctaaacaacatagatttctttttctttgtctacatttttagtagcaacatgaccttgtgaacttttattatttataatttcagtctcttgtttgaaagttttatgataatttttgttagtagctattgattgttttgcttactaaatgaatgatcttaaactccataccttttttattattcgtgaaatataaaaccattactcattaatttaatagcgctttatatattcataatcacatgtttcatctgttgtcattttcacggtacttatctaaggtacatggatgtatggtattatttttttattttgcatcaaaccttagttgtaaagaaaaaaaacatgtgatttaagagccttggttttctttctggctttctgtaagtgacaatcaaacccaagttttttagtattttcattttgagcaaaaatgatggtttgaagtttcagaacagttacatgatgaaccttttcctacatacccactccaatcagctattcgtacaatcagccttcaagggcattacttcttttgagtgggatgaacagggtttttttctattttttcacttattgggtgtcaatcgcttaagagttgaagttgagttagtttttggactttccctaaacaactaaatgtgcagcttattttttgaactttccctaaacaactaaatggcatatcttttgaacttgtggtagagattcgtcaacaagctgtgtatttggtacttatagacatccaaatccctaatatagtgtcgtgctagaaatagaatttagtcataattaaccaaataacatgggcaatctaagcagggaccattttttatgatctgaattggtgaattgggctttttttaccttaagatttatgttacagctttggaaaatcttcaatgtttgatctctcccttttcatctgtgttacagatagagcttactttgggaccacattcatctgtaactgttgggtggcataggaaagatcagagaaggtcggcctctggagaagtgaaggtacttctatgttttctgaaaaatattgttttcccctgtattatccatctttctaaacccaagaaattagaaaaaatataatagatcttgtattccttcctttcaaataatgcaaattttttataggacaacatagattcatcttttcctatattgaattaactctttctcaactcctttagtttggcacatgttcttttgagacatcagttcattatactcatcgtttttctcccaaatctcttggctgcattgtgggaagacttgtgaggtatataaaatcttattacatgtaaatttagattgggcatcatttttcagtttctggttgctaaaatgttcacaatgtcatgatattcttggcaaaggtttttgtacgttcaaatcttgactcaacccaactctttgtatgattatttcagttgtttgtttcttcactgtcttaatgaatgtcgtctcataaaaaaatgaattattgccatagctttctatgaattatttgagaatttattttagcttgtagcttatatatcaaattaacaaaacagcattgttgcggacttattcaatctatattgtatcctttcttgcttgagtataaattatattgattggaagacagagtgttagttgtagttacatttcatatgggactagtaattgtaaagctttgttgtggactcatttctgtgtcactgctaaacgagaatttagttctgctaaattcttattatagtgtgtacctattacagcttgttttgattctcggattatataacttagtaatattatgttgtgatggattatataacttattgatgctatttttttttatcagcaaagataatatgtatatatatatatatagatgagaatgaataacatagtacaagtactaccattacgttaaacaccaaaagccccaaacagacctatggcagcctaatacatgaaaatacatggattaagatgccaaaagtcagggtgggatttgggttaccccaaaaacaggggaatctaagtagtatacccccctaataacaaaagcctctctcaagttactagaccaaaaatggaaggatttgtcgaatccaagctccccatttttaatccaagaccagtaagagaacagtgcagcttccatcactttagcaggattgaagctttcattgtggaagacaattttgtttctatgcctccaaatgttccaagtcaaagccagccaccataatgaccatctatgggaagtgagccctattttctggaagaatccaaattgtgtgaaatgttgtctcggaatatcagagaaggcacccaagatatttgcccacgtcatagattcccaccaaagcaccttgattcggtggcagccaaaaaataagtgtgccccctcctactcgctgttcccgcagaacgggcatagggtgtcattgagatctatgcttctcctttgtaaattcatcttcgtgggaagcctatccttaaacagtctccaagcaaagcaatgaactttgctgggagctttgactttccacatgtctttgaaagtttcatcctgctccacttctaccccagcccatttgatatacctatatgcacttcctactgaaaattggccacttggatcagcctgccaattccacacatcatgctgataaacttgcagattgtgctcctgtatttcttctaaaaattgaatagccgatacaacctccccttccatgaaaggtcttctccacctaagttgccattcccaacctgaatctgttgtggagcccatttgctggatataattatgctgctgattggatatgaggtataatctaggatacttttccataagtgatacaccctcgttcctccagccgtcctaccaaaacagcacctttgacccacaacccacccgccaagatatcccactcatcagcctgttcgccaccccattcgaacgacatactaagctgaggtctctccactagattgactccctcccgaatctcccaaagcctaccagattcctccaacctccgtatttcgattctatcacctgaacctacagatcatcttgctggtgaaacattccatagccacttaccaagtagggcatgattgaatgaagttaaatccctgatgcccaaaccaccgcaatgacctaaaattggcacaccaaatcccatcttacccaagccacctttttttgatcagcattcccaccccacataaatctcttttgaatcctctccaatctagctatgaccttcttcggagccctgaaaaaagaaaacaagaaaatagggatggagtttaaaattgatttaatgagtgtgacccttcccccaaaggataggtattggtgtttccaaactgctaatttttgctcacacttcctaactagagggtcccatgtctcatatcgtcttggattagccccgattgggatacccaaataggagaagcgtagaggcataacactgcagtttaggaagcaagcagcattgtctgtccacgatgcatctatgccaaaagtcgcaaatttgctcttagcaaagttgattttcagccccgacaccagctcaaaacttctcagcatgaccttgattgttttgacattttctgtcgttgcttccccaaaaaatatggtatcatcagcgtattgtagaatgctgatatcaatctggttgtttcccaccttgtagccagcatacaagttcttgcgttgtgcttctctcatcaaacaacatgtgaccctcagcaactatgttgaacagaaagggaggtaaaaggtctccttgtctaagaccacggtgcggaatgaactcctccgttgggctcccgttaatcaatacagacactgatgcagatttcaggcagccttcaatccacataatccattttgaacaaaatcccagcctcttaagcatatagaacaggaattcctagctaaccgagtcgtaagccttctcatagtcaactttaaatgtcaggcagcttctgtttttccttctagctttgtccacgacttcctttgcaatgagtacactgtgcaacagatgcctcccttcaatgaatgcagattttttatgatcaatgaggtgaggcaatatctttttcagtctattagacagcaccttcgccacaattttatatgtacatccaatgagggatataggcctataatcattcaagccctgtggatcctgtcccttaggaatcaacgcaattaaggatgcattgccaccccttgggaatctgccattgacaaagaactcatccaaaaagcgacgaaagtctggcttgataacctcccagaaactctttgatgaatttgaaattgagtccgtctggccccgggctcttctcattgccacatgcccatacggcatctcttacctcccctgcttcaaggcttgccaccaaagcctcattatggtgctgttcaatagtcttgaaaaccacgccatccagcttaggcctgtcctgattcagctcctcaaatctactcttgaagaaggagacaacatgctccttgaccctattgggttcctctatccagcaaccattgaccatcattcctctcaacatgtttttcctgcgcttccaattaacaatcaagtggaaaaatcttgagttacagtccccctccttgagccatctgtttctggctttttgccttaatagtgagccattggacaaagcagccacccataactcctcctatagcagtttcctcttgtttacctcttcatcaaataagtttctgtcatcagcatcagtctctaatctgataagctcctcctcaatgcgcttcagtttctgttgtatattgccaaaatgggaattattccattctttcagtttttgtttcaaagctttgagcttttcttttaaagcaaaaccccccacccactgatcctgtttgatttccagctatcgcacacaactttcttgaaagatttatcctgaaaccagcagtccaacaccctgaatggttttgggccccaatccacctgtgatcatcttaataggatggggcaatggtcagagaagtttctgtccaatatatactgagtggaatccggccatttgtccaaccatgcaagtgaaacaaagactctatctagtctgcttttggcagtcccgtttggcctataccaagtgaactttctaccaacatagggaatttcttccatctccagctctgctatccactcattaaattccctcaacaatccaccatcctgagatctcaagcaagtccccatcctttcacttggtcttcttatattattaaaatcacccaatatgcaccataaacctcccacatgtgcatttttcagttgccttaagtcctcccacaatttcctttttaacgatgcctcacaagatgaatacacattcacaatgacaactttagagccatctgaaacccagacaccttccaagaggataaacccaacaacaatcaaaaaaagatcttaatctaaatatatctgttgaatttttggattatgatagacctcaatgatattggttgatccatgatgccaaccccacgttgtaggaaaaggcttggttgttctattagtattgtgtcttttacgtgttcaaaacttggggattagttctgatttctgagtagatgcttgtttcagttccctttagtactggataacgaatgaagttgctcatccctatactgatagcatctcttttattgtgttctctgtttggtatctattttattgtcaggcaatggcatcttacatgtatgctcaaagaagaaaattttaaaaccatcattagaattgaattgtaaggggaaaaagattaggaccaagttagtgctgttacagttggaagttttgaagcaagggcagtattaatatggatttttattattgattccaaattacttcatgtaaaattgaatcaatataccttttgtacgtattaaatggtgagtagaatctcttttaatgctaattttaactgatcctataatattttatgactgctaatgttgattatggcatcatgcatgatcactagtataattatcagccatatattttagctacccattgctagtcaatgttttaatttgtctgtgtgctatctgttttgacattaaaccatttgttgttgtaattcttcccttgaggttgaattcagtggtgggaggaagttatccaaattcagctcggtacgctggttgtatataataggaattcagataatgtagttaacaatttcttatttgtattcatgtttatatcttgtatcttttttttccctccctttttctgtgatcaagtcaaataatgtggtttaggcttaggggatgaaagcttgtattaactactgctatataaaatcaatttggtatttgacatgaaccaattaccccaaagtttttactgttgatgatggtaaatcagcagttttatattctttttttcttttaacatatatagcttttacacactcattctgcaacatccttctaggcttgaagcgtgaacaaggcttagaggctagagcaactaaatatttaagtgagagaaatgctaggaacacattctttgatacactcttttgaacacaccctttcttattggatgaaatttattgaaaatagtttttttttgtagacatcacatgctatttaatgattctctctcatgtttttaataaattgtaaccaataaaaaacagtgtgttaggaggagcatgttagagagtgtgttactagcactccttttcagttaaaatcaaatttcatcagcttcagctgcaatgtgagccatctcatcctcatcttgacttttgcatacactagatatcacacaagagcaactgcaccagtcaccagtccaccggcaaaagaacctaaatggtgtttttttacaaaatatttaccgataaggggctgtttcaaaactatttacaaaactggggctgtgtgacataaattatttaccaaaatggggctgtgtaacatgcctgaattaggcatgttacaacacgcccaaatctaggcgtgttgtaacatgcctaattcaggcatgttacagctgccccaatttggtaaataaggccccccgctccgcagtttcttcatatcttggcttccggtgttctctgtctctgctaaactgccaaccattctggtattttttggttttttcagagatttttgaagttgttttgagtgacgagaagcatgagttcaagtggcgattctatttgcgtttgaggggttagggtttgctgggcatggttaggttgtgtttagggtatggtcatgtgacgttagtttgtggttaagggtttagggtttggtgggcatgggacgtgacgtttgggctagggttggattagggttggtttcatggttttggttgcatggtttagggttggtgggcgtgttgaatgacgccctaaaccccaaacaccatgtacgcctgccgacacaaccctaacccttcacctgaatacccaacccctaaaccccaaccaatccctaaaccccagccaaaccctaaaccctaagaccctagccaaaccctaaaccccaaccaatccctaaaccccaaccaaaccctaaaccctaaacccaagacccatccagattagtgagttcaatcttttgctttagagcttcaagctcatgtttgcagagtctgcgaagatgagccttaatatatatggttggtcaaaagtttctttaaatcttgattctgtctcaaggaagaactacattaatcacgtacatcggaccgagaagctgttgggggtcaagtgtaattgagaaaggcatctcaaaaggttctacctcgttgcttctccaaatagtgggaccaagggggaagaccttcgttgcagttggcatatgctcaaagatcaagttttttttggatttggagcagcaatgtgtctgatggaaaagtctttgagcattgattcccttctctatatactcaaagagcacgttgttccactttaggaaaagtagcccaagatggatacttgaagggattaatacctggaaaacccttccttccatagctttgtaagattaaggttgtcaagttatacttgttgaaatatctgcatgaagaatgtgggagccaatatcacatttctccttccagactaaatctaggcgtgttgtaacatgcctaattcaggcatgttacacagccccattttggtaaataatttatgtcacacagccccagttttgtaaatagttttgaaacagccccttatcggtaaatattttgtaaaaaaacaccatttaggttcttttgccccagtccaccacttctattctaggtctcctacctcttaagggaaaaaggaaagccagtacaataagagaataagatggtgatgaaagtgaacaggcgaaaaagcactttggaaaattttcatatatatatatatatattatctgtgtgtgtgtgtatacatattcatcacaatattatttacatgcaagagtaaatgcaaaatggaatttcattagaataagtactagacatgaacctaaacattttaatatactacttcacattatatgtgcagtttctagcaaaaccataaatagtaaagtaattaataattagtaattacagtgagtatattaaacattgagtatgagttgggttctgcacagcctcttcactggcacagtttgaatctgtttcaatcaaacagtgaagtaattagtaattacaattaagaatagctgcaagtcatacttggaaactgataacaaatattgtgtcatcatcacattaaataaaaaacattcacaacaaactcattgtaatgattctctgcacaaaaagcaagcgaagcaatgctagaaagtaggccaagtaagaaccaagataaccatgactttccagggtgatggtaagtcttcattgttgtcaatggatttgtcaaatggagttacttgacttatctggcatttggtctaaggtgtagctatttattgaatgataaagcgggaaatgcctagattaaaccttgttttaactttgaaagaggattattttggccattgtttaatgaattaacagtacacttaataatttaggattgttagtctaaccacactgaggatttggtgcacccacttgcgcaatcaactgtggaataaatgctagattatgtggtttagatatattgcagggaaaattatgtacgagaatacatatgaactattatcaaatcatcatcagaaagtgttagttaagataactactaaacactctttattaccttgctctgtagtattaaattaaaaataagttaaaatatgtatgtaaattcttaataaatattcgaaattcgtgtttgttttctaattaaaaaacatttttctctctaataaaacaattttgtttttgatctttgattattttggttttagtctttggtgaattagtaaatttttgtttgttccttgatattttttttcattaaaagtatgaaggaccaaaatccaaataattgtcttattaaagatgctcatgttccttttagaatcgcatacacatgaataacacaatttatttttatatttctatgaaaggagttaatcaattatgaagatttagctattctgatgttcctatgtgtgcatttatttatagtttagtgaattaatttactgaagtgataaaaagcttcacatgctggttgctaatcacgtaatgaatcaagccttatgtgcttacattataacttgagtatcctaaatttaaaataatagctattctgatgttccagtgtgtgcatttatttatagttcagtgaattcattgagtgaagtgataaaaagcttcacatcctggttgctaatcatgtaatgaatcaagccttgtgtgcttagatgataacttgagtatcctaatttttttaaaaaaattcaatggtagttgaaattagtttggtaaaacctgggggactattagtttatagtacatgctccatggatcccgaatagaatgatgagagtgtagcagcatatcttgtaagacatctggtaagcattatcattgttcacttatcgtatttaaatatgttaatttttggtttcacatacagttgtcctttctaaatacttgaagttacctttagttgaatatgtattaggcaagctatatattgtgtatctgctttgttaatgttggttttctctttccaactcaagttctggttttctctttatcttctttgttaaaacaccatctgcaaccctcacatcatccacgaaactgcttgaacttccctttgctttttcttgttttagaccattcattgaactgggggtgcttgtattagaaacttgcttgttccctgaagtataaccatgactgctacactctggagctgacctctctcgttggttctgctgtgaagtaattgtattggtatcaaatcaaacattctcctctggcttagttggcaacaactttttcctcttaattttctcctgatcctaaaaacaaaaagtaaaacaatagtcgggaaattcaaccaaattctcatggatattattcattgtaagcttacttataataatttcctccttagttttttgttgcttctcagtaccccttatagttttgacaaagctaaaaccatgctatatactctcctcaccagtaccttcaatgtttttctttgcacatgtcaaaatcaccttaactgattttgtatctttttctgaataagtgtcacactaatatcttctcatatacaaacaggaccttatgatccaagtatccatttttctattcacatttcactatatgatctttggtaaaatatatgaccttggcgaccttaacgaccatgccaagcacatgtagtttccaattgcaattccatatacgacactatagtgtagagcacaaacaatgttcatgaaactctttccttggttaaacttttaagaacaaggtaagattgtgatggagaaaatctaatggttctctgttatcaaaatcttccataagcctacttacatattaaagtctaaaatcccaatagtcaatatccacagacagtaaaaatttccataagtctacttacattaaaatgaactaaagtacaacatagatttatcacttgagggaagggagtgcaagttactcagaataaaaagttccaggcacacctttccaccccttttgacaaatctttgcttttatgcattcattagcaagacaaccttagtaaatggtaaaataagggttactctgttaagaaacaaccttagtaaatgcctagccagtggcctgcaaaagctccctttctgcatgctctctaatccttctctgaagctcaggcctgaaatgcttgataagaccctgcactggccatgcagcagcatcacccaaggcacaaattgtatgcccttcaatttgtttagtgaactcctgaagcatatcaatttcttctaacttggcattcccaactttcattctttccatgatcgtccaaagccaaccagtcccctccctgcatggggtgcactgccaacaactttcatgcttgtagaaatatgaaagccttgcaatagcatccacaacatccgtagatttatccatcacaattatagctgcagtccccaaccctgtcccaacagcctttaatgcatcataatccatcaagatatcatcacatacatgctctggaatcagaggaacagatgatcctcctgtaattactgccaagtagattatcccatcctcctcgaatacctccacagtgcctctctatcaactccttcagtggaatactcatttcctcctcaacaatgcaaggcttgttcacatgccctgacacacaaaacaactttgtcccagcattgttcttcctaccaaaactggcaaaccattcaggcccatgccttagaatggttggagacacagccacagtttccacatttgtgacaatggtaggacatccatacaatccagcattggctggaaaaggcggcttcaatcttggtttaccttgtttcccttcaaggctctccaagaaggctgtttcctcaccacaaatataagctccagcaccgtagtggatatgacatcaaaatcatagccttagccacaagcattcttacccaacaaaccagcagcataatcctcttgcctagccttttcgagattgttacgttcattgacatattcacccctgatgtagatgtaagcagcactagccctcatttcgatcatgcatcatatattctacactaaaacaacttaaactggcaaaacaacttcaaaaatgaatatagaaaacaactaaaagagaggaaacaagcttcttgtgagttttaaacagttttttgatagaaaacaattagtagcctacaaattgatgcaacattaaccatataacttgcaacaagaccaagtttcatcagcaatcattacctcctattgtaaacttggcaaatgaatatagataaagcaataacgcaactctttgtcctggaagaaaaaatatcaagcaaataaaaaaaagagccaagagggaccaatccattaatagcttccccagaaaccttggagagccaagagggccaccccacagctacttgctcaccatgtacgtggttaggtggattgctcaacctcggatttggcttatgaaatttcacaacacagtatttacaaacaaaaaacttcacatataatactgccgacaacactatccaattcatagcagtttaaaagcatgattaaaaaaatattgtactattcagctcttgaattactatacctgaatattctagtccttcagagttctcatgatgtcataaagaagacccttgtgatcttgacataatttggacaagcgtgtgagtaggacttagcaaattgtccatagcaatagaaacagaatctgatgtggaagttccactttgtattgaaccaggtaattccaaatcaaacatatcttctgtcattgcacttggaaggaatgcagatgcttgagaacaagcagcaatttctgggccaaccaattcaatgtctatggtaattaagggatcccccaaaatagctgtcaactattcaattgtgtcatcacttctcttctttgtatgtagaagttccctgatcgtatgtatacaagattaagcaataacttagttagtttagtaaacacataaattgtaatcaaatgcacactatacatcagaaaattaatctccactctcataaaatgtatttcaacatcatctaatgaaagatctttgcttcagaaaaaaatattagtaacacatttccttgagctaaccaaaaaagatattattagaacaggataaatctagctaccttattagtgtctttcaagttccttgtctaattatatttaaaagaacacttagcaatccaactcaccagatccactgccttagtaaataaaaaaagaaatttcaaagcaaatgaactggcaataaaagagtatcgaattacaacacaagcatgttccaaaaattgaatggatagaaatgtacaacctggtatccgtgatgaaaaacagatccaccactttgccatcaggtgtagtagacaccttcactttgtgtatgatgagctctagctccctacaattatattttacgaaaacaaatcaacacacaaaattatatatttgagacaacatcaaaacatgtcaggactatttttaagtacatgtcttcactgtttttgtgcaacaacccatccactaacaagcagatatctgcctcaagaaaagctttattgagctttgttgttgccttaattaatccatcattgtaatttggctcagtgtcttgctttttcaaacctgctatcgtttctgaaaaacaaatcaattttatcaaatactcattaaactagcaaacatccccattatggctgcatattgcatttttctggataaagcatcagttgctttagccttcagttcctggtttgtatttgatctgaaaatcaaatcccagcagtttggaaatccatctgtgctgttcctcacccatacaattaagatttaccacaatcctccttttcaggacttacatgaacctctgaatacaagttacattggtaaaaattgacatttaaatgcacttccattaagccccaccactattgtaaatataaccatagaacaggtccacgcttaatcattataactaaaaaagaatcaaaactcactaccacttccacccctagtatcaaacatttgaatgttgacaaatcaattcaaaaacaaaacaaactctcgattaaaaacagtaaattaaactaccgtaaaccttggggaatcttcaaatcacttcaccagcagcaaccaatattttaagaaaatgaaagaatcaaacaaaattatcaacaaatgctgaagcaatgaacacatatttgacaattttcaacaaatcattgtgtttgctgaaacaaaagtagcaacatatatagtaaggcagacatgttttgagtaaaaaaagtaaagtcagacacatggtcaatcattggtgtacttgaatgttataatgcagagcccatcataatgaaaatgactgtgcactgatttcccttttaccttattttgttatatattaaacactatgcttgatacttaattgatgtatgacagagtgttgttaccttatttcagtaccatgtctattgaaagtcgctttgaaaaccttggtcctatcacgtgcaacgtgttcccttatagacaataacaacgcactcacatttgctgtttacaacttcatgtgtctttaatgtttgccatgacaccaattctaagacctaatttttttaatattcagaatatcaatttctatatacatatgtctaacatagtattaattatttgttggttgttgttttaggtggtattttggctcagttagaacgtaaaggcgtcttttaacttattgttacttaacgaagcaaaaaatcgttgctattgtcgccctcattggactttggtcctatttattggccatattttgaggtatgtccctttttccatatgttatgtgtttacaacttgctttgttcattcctgactattgctttgtcacaccatgcaatgcattgttagtcaaccttagtttcccgttcaagaatcaattcaatgagtaatacggatagtttggattattcgttgaattgaaccttgaattgtccggttggacagtttgggaagttatatcttgtatacatgatttgtaaatacaagtaaagtatggtttgtttaatttaatgaaaattcagtgtaactgcatattgctttgatctccgagtgcatacttgattgtggtgaattcaaatcaccactttcatttcgtgttcttggagaccaatgcgaaatgctgccgaaatttcattaaattaaataaaccacacttgaatttacaaatcatgtatacaagatataacttcctgaatgggatagggccccaccttattaatgtttaacatatacatattcatgcatgtaacatttacaatatcatcatggcagctttttttttttataaaacatggatcgtaactggatgaaatcaccgcgcattagtgaccaatatgaaaatggggttgaacaattcctccaatttaccacacgtaatgcaacttctttgcatggaaattatttttgtccttgtcttaagtgtggaaatgggagacgacagtcgctgaatgatatccgatcacatctaatatgtcacggcatcattccgagttacacaaaatggatctggcacggtgaattgccggatatgccaacagttggaaccactgagcagtttgacgtcaacacaggacatcatatagaagacatgctacgcgatcttggagaagccaacttccagcaagcacatgcacctacatatgaaaaattacaaagtgattcaaacatccctttgtattttgagtgcacaactttcacacgattgtccgcagtgctagctttggttaacttaaaggcaagatttgggtggagtgacaaaagctttactaagttgctagttttgttgaagaagatgcttcctgaagacaacactttgcctaaaaatcattacgaggcaaagaaaattttatgtcctatgggtatgcagtaccagaagatgcatgcttgccctaatgattgtgtattgtaccgtaatgacttttctgatctgcaaaactatccgacttgtggggtatcaagatacaaagtgaacgaagaagaatgtactaatgaatccagcagaaacatttctcgtccagcgaaagtctgttggtatcttccaattattcctaggtttaagcgattgtttgccaatgctgatgatgcaaaacaccttacatggcatgctcatcgaaggcaacgtgatgaactttttcgacatccggttgattctccccaatgggcaaaaattgatcagaagtacccagcatttgcgaatgacccaaggaacctaaggcttggccttgcatcagacggaatgaatccttttggcaacctttccactaatcacagttcttggcctgtgttgttgatgatttacaacctccctccttggttgtgcatgaagaggaaatacattatgttgtctatgatgatagcgggtccaaaacagccaggaaatgacattgacgtttatcttgcgccattgattgaagatttgcataaattatgggttgatggggtggatgtttatgatggaaatctgaaagaaacctttactttgcgtgcaatggtattttgtaccattaacgactttccagcttatgggaatttgagtgggtatagtgtcaaaggccattatgcatgtcctatatgtgagaaaaaaacgtcattcatccaactgaaacatgggaagaagacagtttacacaaggcatcaaagattcctcaaactttatcacccatataggcgactgaaaaaagctttttatggaagtcaagagacacaaactgcccctacaccgttgactggccatgaagcctatgaccgtgtgaaggacattgtgaatgtgtatggcaagacccaacagagggatgctaacgaacgaaacatttggaagaaaaaatcaatattttttgaccttccatactggtctgatcttgatgttagacattgtatagacgtcatgcatgttgagaaaaatgtatgtgatagtatagttggcacccttttgaacataaaaggcaagaatcaaaggataatttaaaaagtcgccaagatcttgcagacatgggtatacgccaacagttgcatccaattagtaaaggtcgacaatcctatttgcccccagcaagtcacactttgtcaagaaaagagaaaaaatctttttgtcaatgtttgcgtagtttcaaggtcccacaaggatactcttcaaatatcaagagccttgtttccgtcaatgacctaaaattggtgggtttgaagtctcatgattgtcatgtcttaatgcaacaactattgcctgttgcaattcggggtatattgccagacaaagtaagggttgccatcagtcgcctgtgcttcgtgtttaatgctttatgtaagaaggtcattgaccccacacagttggatgatttagagaatgaggcggctattgtactttgtcagttggaaatgtttttccccccttcattttttgacataatggtccacttaattgttcatctagtgagggaaatcaggttgtgtggtccggtgtttttacgatggatgtatccaattgagcagtacatgaaggtcttaaaaggttatactaagaatcaataccgaccagaagcttccattgttgaaaggtatgttgccgaagaatgcattgagctttgttcggagtacatggattcagttaaacctgttggtatacctgaaagtcgccatgaccaatcaaggagaggaaagggtacacgaggattcaatgttgtaactatgagtagacaggaggtttcacaacctcatttgtatgttttgaataacaccaatgaggtaatgccgtacttagaagctcacaaacaacatgtggccaatagtcacccaaaatgaatatcatgaagctgttgcaagaacataacaaaactttcatgtcctggtttaaggaacaaatcttgagtgatgacaatgcttcttccactttaaggctgttagctcttgggccaaatttaaatgtacccacatggaagggctacgacatcaacaactattctttttacactaagtcgcaagatgataaaagtattgtgcaaaacagtgggttactattgacgctgactcgttacacttttctcgtgcatctaataccaacccaattcaagcgtccatgccatactttggagtaattgaagaaatatgggagcttgattatagtgcatttagagttccagttttcaagtgtaagtgggtaaacggtaagactggtgtccatcaagataatatggggtttactttggttgaacttgataaagtgggttacaaggatgagccgttcatcatggcagagcaagcgaaacaggtgttttacatcaaagatccgtgtgacgatcgtttttcaattgttttacaaggaagatcatctattagtagtcattattatggtgatgatgcatcaatggatatgtgtgaaatggcttgtttctcaacacggatgtcgtccatagttgaagacaatgacgttgatgctgaacatgcaaatcgggttgatcatgataaaggcttatgggagaacatcaatacttaattgctgactttcaaagtaaagtattttcaatattaaatgtggttctaatgatttgacttacctttaatattaacattttgtaatacttttatgttatatatctgacttatgtgattttggttgtttcattttacttgcagggtaatgtcgacacctccattatccccacccaattcacaacataatctttcaaagccaacgtctaggaaaactagacaagcgactcgactaagaagcttgactcgtagagacttcgatcagccaaggccaacagtggacgtaaatccttccactggccaagcatcaggcaataacaaagaaaaattccacagctatcttggagtagtggctagagacaaaattcctatagtccattcttcttgggatgacgttccagaaacattgaagaacctcatttgggaagacattttggtatattaactaggtcaatgtttatgagaaagttcagttctatgttatcatatatattgtaattggcaaattctcaaattttgttcaccattgtagggaaaatttgatatccaagaagcagaaaaggcaaaaaagaagatattgtcatcggtttgcacaagatggaggtcattcaagtctttattgaccacaagatacatatatgctgaagcggaaagccaaaatgataaagatccttccgttacatatggtatacatcctcaaacttgggagcaatttgttgctagcagaaaatcaccaaaatggcaggttagatggcaatatatgtttaacttgaaataaattattcaaatgacttgtttttttaatgtcgtcaatcaactacaattcgaaatgtgacagggaataaggaaaaaggctcaggaaatccaaaaaaataatgaatgcccccacatactttctcgtgggggttatgacttgctagaaaaaagctaatggatgaaaaattaaagaagcgagaacaagatgcaatgaatactgagaattcgttaaatttaaacgaccctccatctccaattcctagacatgtaaagtggaagatggctcgcacaaagaaatatggacacatgacatctaacactgccaaagaaatttccgataaaattgtgagctgaatcaaaagttcctattattatgttatgtgaattagatgttaatttgtagcttttatgttgtaggacttgttagaagaacaaatgacagaaggaatgtttgttcctcatggacaacatgacatattaaatgctgctattggacaaccagagcaccctggtagggttcgtgttgcagggacaggtgtgaccataactcaatactttggacatagttcacgtgcctcaagtggtactttaggatccatcaatcctatgcagttggctagtctaatgaaagaccttaaggaagaattgaggagagaagtggaggaggaaagcaaacaaagaatagaaaaaatgaaagttgaaatggaggagaaaaatgaaaaaatgaaaaatgaaaaatgaaatggaggaaaaaatgacacaaaaaatggtggaagcaataaaaacggagttaacacaaatggcaacacaaaaatccccccgggtgatgcacttttacaagaattggctgctcgtgttagcacaaagggaagtggtgttgaaactacagtgaatccatcaggggaagaacatgcagctgttgaggtgccacagatggggctgtttgtcaggtctgatgggtcgacaaagctagttgcgttgggaaaagtttacggtggaagctcctcaattcataatgtcacatatgtagatgatgtcatacgggtaactgttgaagaaatatatgacagggatgcccttgttccatatccgacataagagataacgtatgtaagagagagcctaaacacatttctcgcttggcccacacatttggttaaacctgtatcacagaaggtatatatgcatttaatgtttgtttttgttataaatatattaactaacaattggttatttttaattcatgtgaatcacataggatgcacacactagctcaggaaaaaaagttgaagctgttaataggtcatataaattgcaagtagctgatcgtttggatgaattgatgaagaatgcatatgaagtttaccataggcctatatggttgtcgtgggaggggtttaaatttggagttgctgctgtagaaacatcattcttcatcacacattcagatattaatgaaattatatctggtgacaagtatttgaacatttcaatactacaactgtggattatgtaagtaaaaggcctatacaatgtctcagttcatgtcctatttgtttgtaattgttacaatgtttatattaacaatttcaatttcacttaaaatgttaattataggtttctagatgaatggagtacaagcttgggatatagttcagcgtatgggttctttgagcctcaaatgatacataatgcaaaggatagacgttctgaatgtcaacaatacattcaaatatgggtcaaagaatcacaaagagaggtgtacctaggagcttatttgaataagtaagtaggaaactaatgtggtttcctaattaattgtagtttttttatattaagttgctaatatatatgaagtgcagtgcacattggcagctttttgttgtttgtcctttgacgcacacagttgtgtggttttgttctttgcgtaagaagcccgatattcatatcaaagaagtacttaacaagttatatcgaaaatttataattttacattatgaactgattatattttgacaaagctaaaacctcatgtgttaaccaagacgtgtgttgcatttggtaaagtagtgcacttaaggccttgaataccgatgttcatggtaaatgcaacgtaggtgcaccgaactggattgaactgaaggttagacattgagtttccacattcatatagcttgtgttgtcatattgtatatggaattgtgaaatttacgtttcaatgtttcaaaatttagagccatgtgcaaaatggaggttttgaatgtgggtattacgtaatgcattggatgtggaacatagtaagtgggggtttgaagaatgaatggaccaaggtatacgaagttcaacccatttgtatgtttagtttaatttgttaaattgttccagactttgaatgtagtggaataatttgtattttgacttattcttgcaatggttcagtgatggcacatcgttagacgtggacaccataacaacatgaaggaaaaaatgggcttcgtttttgttagaatcaaaaaacaaatcattgtgatgttgtcttgtatggtgaacggtgttgtttaaaatattcgcccttgtaattttgtgtaaaccagtagacattattaccaagttcgggttttttggttatgacaaattaatgatcaatttaattacatattttaatgttgtcaagcacaatgacaatcactcttgaacatcgggaaaagaactgcatacatatatatatatgtatatatatgtatatatatatatatgttatgtccatagtggaaatgttgatagttttgaaaaaaatgtttattccaattctatgaaatcatatacttcaaatgctgtttttcctttacaaagctatacaaatgagtatgaggtatcttgctcaggacttcccgaagtcgccaatggtgctacctcttcggaagtttgctatggtgcacatactttttctttgcaagattttgcaggtatgcttatcctgtctattgaaaatgtcatgtttgactctttacaactataatgcatttattttctatgtgctcatttttgtgtctcattttttgtgcctcggttggaagtagtagcctttctctcgctcatgatggtagacaacgatctagtaatggttactcctacaataaaaaggtgtgtttggtctttggcttcaattgtttttcatttatcattctgacagtttgagtttcagaatatcagcactcattggttggtgacttcattggtaagcaagcaagatgccaagatcaaagtttctgaaattttgcctagtttcaagtcatctaaattttatgttttgatcatcaaggattatggttggcttcacacgctatattgtcatactttctctatagtctgtaatttattttgtagcacttttctgattcttgttctgttcctgcattgcagttgtctaatctaactgtgcaattccgtattgacaaggccaacattgcattttttatgaatgtgctaggtgcatgacaatggaagtatggtaagcggagagagcagtcatcaaggtatctatttgtaattatgacattattgtttttcttccattcttatagtactgtaaagttgcaatatgcaagtgccaattgaatatttacacttagtttcattgctgaaatttttatgtatgcaaaatatttaagactaatatcaaggcagaaaaagagttgtaagattttactatggaagaataactctcgtaatgtagattgtggtggggcactagaatgatgatgcattttctacttatgatccttttgcattttcaggtgtacaaatggtcactcagatttctactggaagtgctgggggaaatgttttttctgaagaacctcgaccatggcttggaacaactgatgaagttcagatgcattcttcaaacaagttagggaagtccaaaaagttgaattcaaaacgggttgaagcagcttgggttgaaaagaggaagattgaaatggagaaggaaaggaggggagagtgtgtaaggaatgagtgtgatgccaactggcttcctaattttggtagagtctagcaatctggtagcagacgtgaatccagaaaagattttgagaaggagaaacagaagttaaatgttgaaacacaatatgagatggcaatcaagatacaaccttatgttagcaaaagaatggtgagttttattctatgatgaacattgtaaagattgctggtttagtatcttttaaaactgtcagccaaaaccaacttgctttttgccgatttaaattgcccaagcacaacttgttgataaatgggctaaagctcattataccaatctagcccagcttgcctaaaatggtgggatgtattcattaatggatggcacattttattttacttttggactcgtaaattgttggcgcatttttcttgggttggactcaaaggatagcacaaattttttaaatggttttcctgggtagcacatggaccagcctactgactactgagccaacagaagcaaattatagtatttttgtttgagtcttcaagaaacgaccaataaaaaaaacggtatacaatttgaacctttaagcctataacttagctatgatgctcgacggaggacagctaatcaaattgacatgttgttaattatacttctcatacttagtcaagatacttctttcaatgcaggaattcataagttggtaacactttttttttggcattacacactcttaaactgtaatgattgtgctaaatactaatctagtatatgtattatggacagatattgccaactgttccatggtacaaagaacgtctcctccttcagttttctcttggttccctcatggtcagcattcttatcagaactatatagtataatttgtctaaacttcgagtatgaatcttaatgcaagtgggatcattaatttaactactccacttatttaagcttccattttctgctttcttaagaagtttcatatcattagtacattggctaaggatgtgttgactgttcttataggtgtatatataaattgattgatgctgtgggttgtatttttttatgtttattattttttatgcaaattattttgttccattcttagtttgaaggtacttgaactcaagaagctcaaaacaggattgacttctgctaggactgtaaggaagggggagttaggatagttagaatattagttagttatagtgagttactgacataaataaatagtaggactgaaatggagggaactcattctgaatcaatgtaaattgagcattagctcttcctaaaaagagaaatcttgtgtgaaagagaaacccttcaaggagagctatctctcctattcctttttcatttgtaatcaagaaatacaatctttctcttgtatttctaatctgggttcctaacaggttgtgatcctaaactgcacatgctttttgtccttactatgatcctctgataaacaattgcttgcttaaaaatttaatctatattgtagaaggttatggattgatatgttcctgagcagcacatacatatattttaattcattttacattttgattgttgaacttgatagcagaatttccagtattgtgtttgtaagcttcaagtttgtagtaattacttaatgtttccattgatatgtttatatgctgtgctaaaataggatattgtgttgaattgtgataggatgtatatcttcatacaacatgcctggcaacattggcaaacatggcacctcatgtccaccgtttgagtgcatatgcatctcagagcgaagtcagcctctttgacatgctatcacgaaagtatgttgccagtctttctgggctttcataaaaaaactatgttcattagtcaccaaaaaatataaactatacatttcatatttacatattgaaatgagtgatttcttgtataatgttgattctaatgttgattatgattaggtataacaaattagctgatctcagagatgctaaggtcaatattgcagaaaacaactcaattgaaagaagtagccttctagaagatatggtttgtgatatgggttttgcgcttgtgtgattctattgattgcagacttctgactattcctttttctaaatgtatattcttttcatacagtcagcagagatgcagatatatactgacttcttgaggcttgtactagaaattataaatgcaattatgacttatgcactgcgtgaaaatcctgaggtacaatttgatgttccacttgattaattgcagattaaaatatgcacacctatttttatttgattctggacagatgaaaactacatttgcattctgatcttttacatcaaatgtcttacttgtgactgagataggtggtgtatacaataatgcacaagcaggaagtctttcagcctttcaagaatcaccctcgtttcaatgagcttgtcgaaaacatctacactgtatgtttcatgtatttcattgtaatcatattacaatatacacttgccctttaaaatcttgcaactttaaatagcagatttcatggtgtctaagatacacttgtgaaccttgtctttataaaaaaaacattatgttcgagtgtgttcaagcaatgtggtctatttggtattttgcaggtgttagatttttttaatagtcgtatggatgcccaaagaatgaatggtgattggtcagtcaatgaagtgctcaaagtgataattatgaactgtcaatcttggcgtgctgatgggatgaaggtaaaatgaaatttgtgtgattcgtgcttttcacccaataggtaataacattaggaggattacctgtcccacttctacaagaatatatcttgtttggcagatgtttacataacttcatttcacatatgaacaagagagtcaaccagaggagttttttatcccatatgcctggcagctagtactatccagatggtatggttccagagattcttattcacttcatcgtggctatttgtaactgttttgctcttattgtagtttgaactttgttgttcttaatgcatgtggtttccacttctaaaccgaataagattgttaccgaggtaccggccctggaaaatcatcattagatgtttttttttcttgagagcagtcatcattagatattgagatacactcatgggagtttattaattttatcaactaatttctatcttaatactttattttttgttgattcccttttaatatggttttctcattctgtgcatgttactaattcgaaagttctttcatattcagtggatttgaattcaatgcaggagctatacatttatttcctgctgatctacccactaaagtatgtagctgaatctccattatatatttatatatgacatgtcccttgtactcaacttatacaacttccttctgagttttttgtttttcaatccttccttgtagacatgtttgttgttgctgccacttatattactgttactatgatggaatggataaaagactactacgttaggaattttttccttataaaagagctacactactagaaaaataggttttaacatcgctagtttaacatcggttatcgagagaaccgatgttaacgaaaacgcggtggcaattttgtaaataagcgaacttatttaacatcggttttgaagatttttcgcaaaaccgatgttaaccatgaactgttaacattggttttcaatttttttagtataaccgatgttaaccacgaaatgttaacatcggttttgtagatttttaagtataaccgatgttaaccatgaaatgttaacatcggttttgtagatttttaagtataaccgatgttaaccatgaaatgttaacatcggttgtcaagattttaagtaaaaccgatgttaaccatgaactattaacatcggttttcaagattttaagcaaaaccgatgttaaaataacatattaacatcagttttttttatgggaaccgatgttgtccttatatcgccgcgaggattaaacttcagtatcgcgccttttagcctttatatcttctccttcagtccttcactctcgcgcccatatcaaaagctctgtcgttgtcgtcacccaccgaagagccccatctccctcgttgcccatatcgcacctcttctccttcgtgccttcgcgcccttatcaccttcgacacccaactcttctccttcgtgccttgcgccagtatcaccttcgacaccccatctcttcaaggttccgcgcgcgctgtcaccattgtcgcgcattgttggtgtcttgttgagtcgcgacctcatcccaggctttcggtgtcaccggtgacattgacggcagtcgcacaggctcaggtacttgccctaacctcagcttgtagagtcttttggtctgttctgttcgaggtactatgggaactcacatttcgaactaataagtcgttggtatttggtttttatgttaccgccatggatttgcaaagtaggaggcgtcatttggttgagaccgtggttcgcattgttggtgttagctttcacaagtacttgactttattccatgcttgttggtcttggttattcatgtgaaagagacaatgggtatctgttgatgtatttttgtttaaaaaatgttggataattgtatggacatctgctggaattggttttgtttggtgttaattgtttgtgctactggacatttaccatatgacaaacaagaaaggaaaaagaaaaacactatacatgattgctggtttgttttggtttctgttgtggtttgttttgactatagcattattgatgtttaatttattgtcactgttattatactaagtgaagtttgtatggctggttaaaaaatttaggacacttagtggctgattaagtaaacttgtgatgctattttttgtccttgttaagaatacttgttaagtatttatgttaggaataattgggagctatgttaggctgatgatgttggttataacataagtagcagcactggtagagtctgttttagtcattggattggtcaggctctcaaataatggtgttgccaagcaattgttcacaaaaaatggctaagttgatacttaggctcaagcttacaaataccaccttgtattcattatacagctgctgaaaatcaggccttgccccattgtttttgcatccttttcaggcggtgcaaaagcttgtatgcagaaggttcttcaggtattctattctagattaatgtttatgttttgaccatcatgctatacagtcttttagttctaacgtctgatgactctgttttcctttcatccagataattagtggctgcagctctgaagctcataatagggtatgtttcctgccattagtagttcagaagatggctgtgatacataattgtataattgataaagtcattattgtcttcaattttcttaaatcattttaatgtctgaatgaggcatacggtgttgattccataccctccattctgtttctgtgttccatgatgtaattgatcatatattcccttttacccagtgatttggtcaagtcaagttgttgttacatggacttatgtgcgttggacagtattttttgaccttaactcctgttctgacacagacaaaaaaatatgttcactaatagttttatcttttattttctttaccattactaaactattttgatggcacaaacttaacaaacactgaacaagatcaaagtcctaatacttagcctagttccttcccactcatcatcatcctagtcaaatgtttatacctaggcccatgaatagtaactgaaatagtggctgctacaatgaaaacaccagcattttgcacgaccatatcagtcagaataccagccccaactttgattagtaagcatgaagccgaagttgattcagtcaatcatactttaccagtaggttagatgaattacaaacctatagtttagtgatgtgggacaatatggagttgatggggacaatctcagacaggttggagaatatgctaacgatatcaactgtgtcagcatatactgcagcatcaagcagaatatcaactgtctcttcaaatgagcatctcatcattggcccagtatcatttcggttgataccatgacgtgtaattgccataaaatgccctcgataagtcatggtatcacaaagaataggcaaatgcctgtaattgacataagaaccatcaaaagaaatgacaacacgcaattcatccagaagagatcgccgaactgcctcaataccaagaacttcaatgacttcaatcaagtggttgcttgtggtcctggtggcatcaacatcttcatggcacattacagctagaaggttgacaccttcagtatcaagcatccattcctcattaggcttaaaaccttgattctcatcaaacttctgaactttagtattttttatgaaaaccttattgatgttagcatgttgctttctattttctttaagaaaacatcaacttcagcagactcatcctgaatgttgcccttgggtgcttcatcattcataatacggatacgaagtataagtttttcagcattgtcatcattaaatatacaagtcaaatcatcatcaaattcaatgttaatgttctctgcaatgtcagcgatactcaacttcttatccaccatcatttcacgattcagctctatgcgaagcaaccaaggtgaaattttttcacgagcaacttcttcatcaggcatttcatagtaggacttcacaaaatgaacgtcctcttcaattattgtactcatcgggtctggatcataccacacctctgtagcttcagtcacactcctgagagtggtatattctaaagcacactgcacactcttggctctctctttagtcttaccaacatcaggtctcaagtacacaaacaaagaaggcgttttaattctctttgccacattaatgatttcccttaacctacgaacaccaagactaacattctttgcactgacaccagcatagtggaaagtgttgagagtcatcttagtaacaggttctccaattgattgtgctgccatacaaccaatcatttctccagatgctacaagggactgcaagaaccttgattctttttctcccactacccacacaaatgcctcacgataaagcctgtattcctccaatacccttttactggcaaaagggctacggagcagaatattgaacaggagagtagcattcttctgagcttcttgactcaagagatgttaagcaggaacaaccttaagtcgctcatggagcttttcaatggcttccacaatctccattggatgcatatcagaaggcctttggaagtcaaccttaaatgtcttctgagcattccagatcagtctcttcaggtgaacaggcagtgcctgacaactgtcaccagtagtggctatctcagttgcaagttgaaatctatcagcttcaagcttttgaacttcagcctcaaacacattacgaaactctctgatggtttttaagtcttctacagcctcttcaagcatgttagtaggcttccagttttcagcatcgaattcatacctaaacaccctgtcaaattctaattttttaattttaagggaatccaacttctgtgtttcaatccaaacagcatccataccatcttctccgttttcatcatcaaattcagacctaaacatccttgggaaattctaatttttttgtcatcttaagggaatacagcttctgtgtttcttgtcattttaatatgaatactcccctaaatatgactaacatagcattagtttattgaatagcgcaacccttgacaatgaacgctcctataatgatgtgatttgatccttatgattatataaatatatatggtaagtattttgggataatgttgatattgtcatcatgttgtttgcaggtttacaaaaagattctcggtgacttctttcagcattacattcattgatcctctgcatctcttccctgcgtaagaacaaagacattttattataaaatattcaccacattgactaactttctacttctaatgcttgtattttgatttggctcagtcgcttgataggttcccattgttttttctcattcccatactttgatttggcgcagccgtctcaggtactatgattttaattgtctattgcaagagtagtaatgaaaggtattattgtgtatgaaccattattatttatgcacaaatcaatgcaatagggtagatgactgttcaccatcatttgtatgtagttttccgttgcctctgtgtaccatcatcaccatattcattgttggacattagcattcaccatcattttaggtacttacaaatgccttgcatctttttttatcttatgtatgtaaattgttttgtgccattaatgactatgtctatatacaaataatgttcattatgagtgaaccgtagtttcccgtttgagattcattaaagtgattcttccggacagtttggattaatcattgtattgaatcttgaattgtccgtttggacagtttgggagggcttaaatttttttagtatattcacatttatacgttgtcattcttgtcttaaatatgagaaaatttcggttcaatgcatttcactttgttctccgggtgcatacttgactgtggtggaactcatgtcaccgctttcatttcatgtacttggagaccaaagcaaaatgctgccgaaatttcgtcatatttaggataaagactcaacgtatagatatgaatatactttaaaaatatgccttcctgaatgggatagggccacaccttgaatgagaaaagtgaggttttcatgcatggctgaactttgtcagtatctcagagttggtaagcacatggatcgatcttggatgaatgcacctcgcatcacggttgagtacgaacaaggagttgaaaatttcttacaatttgcctccgaaagaggtcgacccgatggggatggaaaatatttctgcccctgtatcaattgtttgaatggtagacggcaaacactagaagacatacgggagcatcttctgtgcgatggaattaagaagacttatacgacatggatatggcatggtgagtcgacagacacgcagagggtctcggatgctaaacgggttaatgttgacatcggcgatcgactagaggatatgatccgtgatctggggcatgagtcttttcagcaagcacatgcccctatgtatgacacgttggagagtgattcgaaaaagccgttgtatccggggtgcaaggagtcattgacactgttgtctgcggtgttaaatctagtgaatgtgaaggccaaatatgggtggagtgacaaaagctgcagctcactgcttgaggtagttaaggacatgcttccagaggaaaacaccctgcctagcagttactataaggcgaagaagatactttgtccgatgggtatggagtataagaaaattcatgcctgtcctaatgactgcattttgtaccgaaatgaatttgaacaaatgcataaatgccccacgtgtggggtatcacgatacaaagtgaaggatgttgacgaatgtggcagtgatgacagttcagcgaaaggccctcccacgaaggtgttgtggtatcttccgatcattccaaggtttaagcgtctgtttgctaatgaagatgacgcaaaagaccttacatggcatgcagacggaagaaactctgatgggatgctccgacatccggcagattcagttcagtggaaaaagtttgatcgtttgtatccggagttcggcaacgagccaagaaatctaaggcttgcacttgctagtgatggaatgaatccgtacggtagtttaagtactcagcacagttcgtggcctgttttgcttgtcatatacaacctgcctccttggttgtgcatgaagcgaaaatacataatgttgtctatgatgatatcaggcccaaaacagcctggaaatgacattgatgtttatctcagtcccttgattgaagacttgacaaacttgtgggatgagggggttgccgtgtttgatgggtatcgaaaggagacattcaagttgcgtgcaatgctattttgtaccattaatgattttcctgcctacggcaatttgagtggatacagtgttaagggccatcatgcatgtcctatctgtgagcaacacacgagttacttgcaactaaaacatggaagaaaaacagtttacactcgccatcggcgttttttgagaccttatcatccttatcggcgattgaaaaaagcatttgatggaagttaagagcatgaacttgcaccgattccgttaaccggtgagcaggttcttgagcgggttgatgccatccatactgtatttggaaaaaggcaaaagaagcagaaaggtaatacatgcttatggaagaagaggtccatattgtttgagctttcatactggtctgatctagatgttagacattgcctcaatgttatgcatgtggagaaaaatgtgtgtgacagtgtcatcggcacgttgcttaacattcaagggaagacaaaggatggtttgaacactcgtcaagatcttgctgagatgggtatacgtcaacagttacatcctaggtccgatggtaaaaaaatttacttgcctccagcatgccacacattgtcaagaaaggagaagataagttcttgccagtgtctacgccgagttaaagtgccacaaggatactcttcaaatattaagagccttgtacagatgacggatttaaaactagttggattgaagtctcatgattgccacgtcttgatgcaacaactgttagccatggcgattcgagacattttgcctaagaatatcaggcatgctatcattcgcctgtgctttttcttcaatgccatttgttcaaaagtcgtggatcctgtaacgttagatgacttggaggaagaggcggcaattatcttgtgtcagttggagatgtactttcctccatcattttttgacataatggttcacttagttgttcatctggtgagggaaattaaaatatgtggaccagtttatttacggtggatgtacccgatcaagcgatacatgaagatcttgaaagggtatacaaaaaacctacaccgtcctgaagcatccatagttgaaaggtacatagcagaagaagcggttgaattttgttcagaatacctgcagaaagcaaagcctattggtcttcctgagttgcgacatgaggacagagtgggaggaaagggtacacgagggctacatgttataacgccttcgttgcaggacttgaatcaagctcatttgtatgtcctgaataacagtaatgaagtgctgccatatattgttcgtcatgaagcactacttcatcaaagtaatccaagaatgacgaagaataggctgttgaaagcgcataacaagactttcttgaattggtttaaaaatacaatatttcgtgatgaatctgcatctgaaacgctgaggaagttagcagatggcccaaaaagaaatgtgagaagttggcaagggtacgatatcaacaactactccttctataccaaacaacaagatgaaaagtccaccatgcagaacagtggggttagcctaagagctgagtcacaacactttgctactgtccgtgacaacaatccacgtttggcgtgcttgccttactttggagtcattaatgatatatgggagcttaattatgttagtttctctgtttgtgttttcaaatgcatgtgggttgatgtcaacagtggcgtgcgaaccgaggatttaggatttactttggtagatcttaacaagctagcttatcaagatgaacctttcatcatggcagaacaagctaaacaagtcttttatgtacaagatccatgtgacgaaaggtggtcagtggtcctgaatggaaaaaccattggcattaatgttgaggacgacgagtcaacccccgatacaagtgtcacacatttcgccacacaaacacctgacgtcaacagagaagacgaggttgacgatgtgcatgcaaatcgttatgatcatgatgaaggagaattaattaacatcagctcatgtaatttgttttgcttaagtattttggactttaacatactatttgttatttaacataacttgtcatttaactttacttatatgtattcttgttttttatttcaggatcatgaccacaccatccagctcccctgaggcaccacattgtcctcctgaggcagcagcggttcagcctgagacagcacctccagttcactcagcacctccacctcctccaccagtggctcaggctgagactacacctccagttcactcagcacctccacctcctacatcaaagaagacgagaaaagcaacacggctgaggtcactggctactagaggtcctggtgtggagaggcccgttgtccatgttgatcctagcacaaggaaggctgatgggcctcaggctaagagattgaggacatatcttggggtcgtggccagagacaaggtagatatcacccttcctaattggaaggaagtgccttcagtgtagaaggacttgattttggaggacattcaggtatgacaatttaaagtattacacaaataaattgttattcatgtaagttggaaactaacttctttgtaatgcaggctgagtttgatatacctgaagcctcagacgaaaggacaaagaagaagatacttcagacagtgggtgagcggtggaggcagttcaaatccgacttgacaaggaagtgggtccttgcagaagggaacgcggacgttgccgacgctatatgcgagaaatacggcatcagtcacgaacagtggacccaattctgtcagagtaggcgagcagcttcctgggaggttagtggttttaccccttttgagtggatatgtgttaaccagacaattgtctgcatgacaagaagtactgcataccaatatcgtacattaacataacagcactaaggaagcttgaactagccttctgatgtgtatggcatagccccaatccattaatgtttaacgtggtagaatgatttaggaacactcattatcacttgatttcctcatgttcatattctttgctgaagtcttttattatttgactgtaacttcatagtgcaatatgaggattgaaagacaatagttcaattttgtttgtaaggaaatgaaagatgatttcgagtgccctttagttctttgtatatatgtaacgtaatagtagaaggtagatgaaagcatgatagtattgatccataactatctctatataaccgtgtattttttcataaccctgtcttttttcatttatgttgtcatacagtcttttatttgctaactttacgtgtcaacctgttacaggatgtgagaaagaaggcccaggcaatccagaggcaaaacaccgcccctcacgtattgtcacgcgggggttacaagttgctcgagaagagattaatggaggaaaagcaaaagaagcaactagagggagcaactcgtgatgacagcacggagacgatcattcatcctccgtcccccgtgcgacgacacgtgaagtggaagctggctcgcacgaagaaaagcgacgacatgacttcggaggcggcacgccagattgctgagaggattgtaagtaaaacaatacaaatgacatagacatttagttatttttggtatcacaactaacaaaacaaatgatctactttacgaattgcaggattccctggaagagcagtccacccagggttcttttgtcgccagtggtcgtcaggatgtcctggctgctgccattggacgaccggagcaccctggacgtgtccgtggtgctggagttggtgtgaccatcacccagtacttcggacccgctgcattatcctctcggaagtcaaggtcttcatccatggcgcctgaggacttggatcgcctgaaagacaacatcagggtcgagctggagcagtctatcactgatcgacttacacagtcgatcacagagagagttacccagcaggtgatgatgagcttcagccagttgcagtctcacatccagactcaggcagccattcagcctccagaggtacagtcatgtccccttggtgcccgtgtcagcaccaagggaagctgtgtcgatccctcgggcaatgaccctgacacgggtgcatctgacaggcgtgggttgtgtgtggatggcaatcctccccgccttattgcccttggtagagttcatgagggatcgacgactgtgcacagcgtccctcttgcggatggtcaggtaaaggtgagtgttgaggaggttcgcgatccagacgctcccgtccctgttcccactgacgaggttgtgttagtggggcaggcacttaacactttccttgcctgggcgacacatcttgtacatacaattttgactcaggttttgttatttttccctaatgtcttgtagtttacgaatgatttgtcacatttgaatataacatgatcgctcacccttggttgttaactgtgtaggataaagaagaacccaagggaccggcgaaaccagtacacaagtcggaatgtgtttctgatcccttgtaccatttagcattgaccatcctcgatcttttcctcagacccttccaggtgccaggggacccggagatgttcggggtgcataatgacaacttcccgttgtacatcaagcatgaggatattttggagatcatccatggtggtcagtgtctcaacatctccgttttacagttgtggatgttgtaagtctcttgcaattgactagcattatttggtgaattgttttatcttctaccataacttactttattttcactgcataatagccatatgaatcatttaagtctgcaattcgatcaccctgatgtctatggattcctcgagccacagtcgatacagagatctggccaatctcaatttctgaccgaggactatatgaagaaatggatgcagacttcacagaaaaaagtctaccttgcaccatatttgaatgggtaaccataaataagaatcacaatttattaatgtatgcagtataataaccttgttttttacaatgcagttcacattggcaactggttgttatatgttcgaaggccaatgtagtcgtctggttctgttcgttgcataacaggcccaacaactaccttaaaggaattattaacaggtaggttctaatttctaacacatttacgttttttcttgacttgacatctaacttcaacagtatgcatacttgtttgtcttaaatagtgctttgaaaggtctggatgactctccagcaagtaaatcaaaggctacaacaaaatggattgcgcttaaagtaagtcctatcctaaatcatggtttaagtattcaattaatttttattcatgttcacggtatttgacatttaattatgactttgtttttcaatttagtgtaataagcaaacaggaagcactgagtgtggctattatgtcatgcattggatgcagacaatagtccagggagccttcactgatagctgggacatggtaattacttgtctaattcaaattgttttggtttacttatttttgttttgtacttattattacatgttttgttatgtcatgtcatgcatgcagtttttcaatgatcaaagaccattggaagcggacaccatgaaggcaatcagactcgaatgggcgaaattttttcttaaaattagacaagatgtattagtagattagggggttcatttgtatttttgaaaacaattgtatatatatatatatatatatatatatattaaattttagcttctttatgtacattgacacattacattggatttgttattggaatattattaaattgtgcactgctggttctggatatttaaattatgcattgctggttctgaatttttaaatttgcaggttgaagaactgctaaaattaaaaaaacaaataaaatatttaaaaaaaaataaaaaaacaacatcggttgccaataaaaccgatgttaacatgtaaatcaacatcggttttcaacgtaaactgatgttgtttgttgataacaacatcggttttgtaaagtaaaccgatgttgtttcttaataacaacatcggttttcgagagaaaaccgatgttcctgcattaaaacaacatcggttttctctgaaaaaccgatgttgttattaagaaataacatcggtttactttacaaaatcgatgttgttatcaacaaacaacatcggtttacgttgaaaactgatgttgatttacatgttaacatcggttctacgacaaaaccgatgttgacaaaccatcgtttattcttttgagcgttttcatgtacgacatgtccacatcggttattgatggcaacccgatgtgcttaacgtttgttaacatcgattggcagaaccgatgttaaattttcaactttcaacgtcggctgattcaacatcggccaataaccgatgttaaatgtctcaaataaccgatgttgaaagctgcttttctagtagtgctagtaggatcttaatttatgatcatacattcgtgctgattctgtaactaacttcttactctgaacttatctatttacaggttgtcaattaattgacaattaaatgggagagcatccatgatgtccaggtgaaggaccgcagtttaatctggtaattccttttcgtgaatgatgaatgttcctaatgtttcatggattatgcttgtttagttttaaagtttgtcggttatatattcacaatgtactgtgctgaagctaggaaagaaagtagaggaggtcatggccgtgaagactttaaggtccattctccctatctcatgaaaatttcataccattaacatgaatagggtagttgaccatattatgttggattctgcagcttagagatgatgagaactggatgaaacacacttgatttctattttctagtaggaaccttgatccttttaggtaatttggtttgatggaaaggaatgcgggtgggtatgaaatgaaaatggaatacttattctctgtctttgttttccttctttaaaaataaaagcatattgtactagaaaaaatataaaatacgaaaaaaggaattaaaaaaaaagacaaacaaagacggttgctccataaccgtcttagaatgtacatctactaagacaggtcttataaagaaatttaaaaaaataatttagatcactttctaagacggttatagcctcagccatcttagaatttcgaaacatactaaaacggttgctccgaaaaccgtcttagaaagcattttcaataaaaaaagtaaagtatattctaagacggttattcacatacccgtcttagtttttgcacattctaagacagttatgcagaataaccgtcttagtttgtgcacattctaagacagttatggaaaatagccatcttagaatatgctttaaattttttttttttgtaaaagcaccttctaagactgtcacagaaccgtcttagtaagtgtgactttctacgtcgcgtgatactaggacggttgtagaaccgtcttaaaatccccgctttgtagtagtgatatatatatatatatatatatatatatatatatatatatatatcatcatatttgctttattctaatatccatttcctttttcctcaattagaaaataacatacttaaaataacattttttttttaaagaaactaccgaggtactcatccacaggggcggaggcagactaagaagccaacaggggccaactacaaagaaatccaacaaatatacaaacattaaattccatataaaataattataattatttttttctaaaacaattaaaaatatataatagcaaatatactcatataatagaaaaattaaacatatttcttgggactcaagatcacaaatgttaatcgttaagttcccatgtcaagaatctttaatggtatctttaatgcttcttgcatgtaaaactataaatttatagttttacaatatttctatgggtgtaatttgaacaatttatcttatgtttacaatgtcatgtcataaatcatatattttggtctaataatataattttaaataagtcttgaattactaactattatttatataagtaaccggagtttaattttaactatttcaatatgacaagtacatcacttccaatgataaaaaaattaagtaatgatatctaaaaataagtaacttgttaaacaactaaccttaatttggagatgctcttgaaagatatatatgttgactataatgttttatgaaaatccctattaattatgttctaaatcataatagattatgaataaaaaactaaattataatggattacgtcattgttatattttatttaatgcaataaccaaccaataactactcagaaaaaaaaaaccaataactattgaacaagaatttgctttttattgttgaaaaataaaagaaaaagaatattgtatataaaaggaaaaactattaaaatgaaaataaataatattcaaatatttttttctaaaattgaaaattcaatgtaattatatatataatctttttatacaaagagaaatagtataatttgtctaaaaagagaaatgatctcattatctttacaataaatactatcaaatagaaatagaaaaatttgatttatgtcaaaaacataaaaaatactactacaaaaataacacttaaatgtcattatttatataattaagctcctttaaatataaataatcactctaatatttaaatattatacataatagcaatttttttcatgattaacataagaacaattttttagattaaaaagtcaaggagccaaggccccaagcttccatgtacctccgtctctgttcatcagatctttcctgttttcatgcatgttcaaaatacacctatatataaaattaaatatttttattaagacaaacataattaattaagttctctgaaatagaataaacagttaaagagtattcaagcatagaaaacacacacataatagttatagttatagtgtcacatatatttattatatttttttaaaatattttaaaaaattgttcaagatatctattatgtataaaaacataaaaggattttgcatttgttaaatttaaataatttaattattttacaactatatttgtaaataaaaattattaatttgtaatgttatagtttataaataatatttgaaataattttaaatataaaattaattaaattggatgaaaactattgaagtcaatattagttaaaataaattattattttaaactctaatgaacaatttatattaattagcactgatgtaatttgttgttataggtgtttgatattatcttcatccaatatatatatatatatatatatactaactattgagttttttaatgtagatatatttttccttaataacataatcatgccataacaactccagtgtttacacctaatggtgtattagcgagcaacccaaagataactttttgcaggagtgtggtctgccacttcctctcgttagaaagattcaataacttcattagtttggtgtaagtcatatgttatcttcaagtctcccacttcctctcattattagaagatttaatttgatataattcatatgttatttattttgataattcatttaagtcttaataaaataataaaataagagaaaaagaaaataaaaataataaagatataataaagataatttgaactgaaaatttaaatttatttttatttaaaatagttcttataataacttgatcgcacacgcatatgtgcacatatcacacatatataaatatatatagacatgcatgggttgagtgagattgaaaatttaatgaatgtaattttattagtgcgtgtcttatctttttataaccgttaatttattcaaaattagtggttgagattgtgtttcatatgtaccaacttctatgctagtcattcgggtgtttgaatcccttccatattaattttgtttttgtggtgtatttaatagcctactttttagattctttttaagttcaaacttctgatttaatttaccactttctaacatcaaaataaattaatacaagaaaacgcgcttcatcttgagaaaatcaaataaacattcataatatctctcaacaaactctgatgtctgtcagcaaatacaagtacagtatagtactacaaattataattattattccttagtacaattatatataattattacttagtaatataaaacgttggcttaattagccacttgatgataaatgcgaaggacatacctgaaacttttccaagcattcccaatgtccatctgaaagcaacaatgtcaggacaatcattacacaaacaacagccataatagtcttaacatcatgaagtagcagtacaactagcataaattgtagtccactacccacagcatatcctattatatattggtgctataaaacttatgcatgcatgcaaaaatccttgtttggattttcttccttcactctaccttcaatcaagcatgcatgcatgcatagtaggaatttcaccgtttttagcatttgcttgataacaaggataagtcattttactactattaaaatctctttcatgcaaaaacacacaccctaactctctcgttgtagcaaaattttctatttaactctgaaagaatcaaaggaatcagaatttctatctaacaccgaaaatagaatgtgaattcatttttctctcattttcccacacattttgtccaaacggaaggaaaataaaagagaaagaacattttgatggtgggattttggccgctgttcaagatctagctagcttccacagtctccattgttgtcgttgttacaaaaattacacagtaaataaatttcaacataaaagttagatgacttatatatggtcaaaagtcataaccaacaaaagcaattgaacaaaagcgctactactaaataaacatattatccaaaagagttgtttccctcttaattagtaccatgtcaatattagaattttttttgttttgaaaatagaagcaagaatactaggatactatttttatatattatttgaagggaaaatataaatagaatggttaaacaaaaatatgtcatataaaaaatgaggtattcgttcttatgttggtctaggccgaaaacaactaaacaacagtgtggattaggctcatgtatcaaaacattctattatgagctattgtgaatcatgtccatagatatataacgacaagccatcaacatatatcactactattcatcatgtgacctttaataatattcttttgtttaacgcttattaaaaatattattaaaattttttgcagcatttaaaaaatattaaataaatattaataatatgttttcataacatgttatcaaatgttgtctataatccatgttgctaaaaattttaaaggatttaatgatgagttatacataacatatgataaaatattacaaaaacatattaataatattttttaaatattgtcaaaagttgttagcaacatttttaacaagcgttagacaaaaatattgagggtgagtcctgacacaacggtaaaattatgtcttgatgtcttggtgacatatgcaagagaagactaagtacaatatctcttccccttacatgcacatgttgttaaagattacatatgttgtagtgcgtatcctagcttcttaatggttttgggtgcattgatttttaataatgtattgtttcttatgtgcactcatccaacacaacattctcatctctagattctctactttgccgagtttattctattgctagctttttatcactcaatactcagtttcatacaacattataagtcttatagttcagttgtcacgataaaattttccattaagcttgagtgataccattttgtcacataaaacattctaggcaccccttcatacgattttaaaaataaaaaaatcacaatataataatataatattacacaaaagaaatatttaatagagtataaatatatataatattataataatatgataaattataaatgtattattacacacacatatatatatatataataataataataatgatagagtttttgtctttataagtataaatatatatggaagataaaaaaatgtaaaaagaaaacaaaaggcttaaagggaatggagagaaatttgggaggaaaattttttctaagaaattgacacttgacactaagagggatttgttttctgattatattgatatagatatataagaatataagtttaactatggaagtaagaaaaaaagataaaaataaaataaaaagctaaaagggaaagatagtaatttgagaggaatttttttctaagagatagacacttggcactaagaagtgtttgttttcttagagcgtgtatagatatttatagaatataagtataaatatggaagaggaaaaaaaataaaaataaaacaaaaaagctaaaaaggaagagagggaagtttgggaggaatttttattttcctaacagattgacacttggagtaagagagatttgttttcttagagaatatagatatcattttctactttaaataagagggattatttttgaagtatactaactatatattatcttaaaatacacgaatgatatagcttgttaacatgtttcaactaatatatgtgtacacatatcttaggagataatataaaaaaaaaaaaaaactattttgagcttatgaatgtaacttatgaccttaagttccttctaacttatttcaacaaatttaaggtttatcaactttcaccaaaaaaaactacacaattaatcttattacttaattgttatatagtaataaacatttaaacaaataattggtcatgaattcattggaaacgattggttaatctcccttgatcacacacttcgggaagggaatcagtatgcatatgcactggccaagtttggtgcagagaatgcaagttcactgatggtttttcttgagcaacttggctttcttatcttatcccttcaagcatatgcaaagaaatctcaatttcctagagtttagttagtctcatttttctgcatttttttaggttatgtaaccaaaaacaaattaagcaatttaagttcacccaaaaaaaagtatgcaatttaagtcatctatgtaacaatgatatcaacacggtattttcgatacgtttccgatacgggatgtcgatacattacttcaaaaatactaatatttcgatacgttcctgatacgtcttagtattaaataatatattttttatatagagtgtatttcatatataataaaaggaagcgtagaacattaccaatctagtagggtaaggcccaactaagcctagacctatggatacgttgggagaagcagaaaaaaatagtgatacgattttgcgtttgccctaacacaagggagggcatgacggaagaactctctctctctctctttcttggtcttatccatcgcattgaaaagcaacatcatcaccacccccacttcttaccctttctttcataaatatgcatctatgcaacaacatgttcaccaccactagcttattcttcacatcagcctcatcatcttcttcaattagttggaaactcactaagaaagaatgacaaccaagcggcggtggaggagcagcgacagcgatggaggaagagcaacgacaacgatggtagaggagcagcgatagtgtggaggaggagcaacgtcattgtcgaagactttgaaactcttcaggtaagcacgaaatggaggaaggagagcacaaatcgaagaggtaagcaacacaatttttttaatatataaaaataccctttcaaattctgatacgtaaaaggccgtattttttgcgtacccatatcggatgggtgtccgatacgttggaattttttttttggcgtatccgtgctacatagtaggtcattgatgaaaacgtaatgattattattctatatatatttctcatcaacaaataaagtttcttacaatatcttagtagaaattgggtgacttggttgaggggctatgcaaaatatgttatcgtagcaagcgaaagtttattatagatgaatcaaatgatgagtatgatattttacatattttaccaagcgaaagttgttaatgcaaaaggaaaaaagtaacttataaagtttattatatgatatcttagcagaaatgattctgtaagttacttttttccgtttgcattaacaactctataagtttgatttaactcgatcttcgtagaaaataacgaggtagcgtttgcgtgattattgtaaccttgaagtggccttgtaactgagggccttggattgggcatggtggtcaaatttgttgatgagattgacgagttcagccacagtggttgggttccaactgaaccatggagcttcgctccttcttgtttacagttgggcacgaaaggaaataatttagtagtgacggttgttaacgacctaaaacaaataaaaataaaaagttgacgtgagggtattgtgggtactacttacagggaggtgataggagagaggtgagggtatctaatcctccagaggaacataaaaccgttgcatcaatatagtaacgaggttcacatgattcgtaaattaattgaaaacaattggtcaatctcccttcgacacacgcttcgggaagggaatcagtgtgcagatgcgttgaccaagtttggatatgagaatgcaggttcactggtggttgttcttgagcaacctgagtttcttatcatgtgtcccttcaagtgaatgtacagggagctcaatttcctagagtttaatttgttttgtttttctgctttttattatatcctgtaaccaaaaaaaagtaagcaatttaagttcacccaaaaaaaaagtaagcaatttaggccattgataaaaaataatgattattattctaccttatccttggttatatgcatgtttatcgagagcgccaaagcattaatcgatacactttatggagattatgggcttcaagcttacccattatcctagttacattgtgcttttgcttctcagatacctctttgatgagaacaattttcctgatatcttgcttcaacattgggatatatcttggtaggttaattatcatcacaggtccatgaaacaatattggttttgtttattttagagcaaaactaaaataaaattgttaatgcaaactaggaaaaatatcgtaatcatcatctgactcttctataataaaccttttcttgttccaactacatgttccactacagtcctttaccaagccacccaatttttgccaagaatataaaattctttgacatattgattatctccttaactttttgtcagttgataaattatatggtattatttcttcttgcttatgtgaaaattctatcttagcagaaattgggtgacttggttaaggggctgtgcaaaagatgttttgttagcgagcaaaagtttatcatagatgagtgagatgatgattcagatattttgcctagaaaatgtggtaaacctaaggggaaaaaataagaaaattgacagaaataattttgtaagttactttctttcgttgttcactactacaaacagggtctttaacgacggttattttaggcatttaacgacggttcatagaccgtctttaaaaccagtgtcgttgaaaaaaatatttttaacgacggtttttaaaccgtctttgtttcctatttttaacgacggtttctggaaacaaccgtcgtcgtttataatttatttttaaaaaaaataaaaaattggtactttcaaagacggttgtcaaaaacaacagtctttgaaagtatgatacaatgacggttacgcaaataaccgtctttgaatgttttcaaagacggttttagtccacaaccgtctttaaaaatgagattcaaagacggtttttatctagaaccgtctttgaaaactataatcaaagacggttcttgtcaacaaccgtctttgattctcacattcaaagacggttgtgatcaagaaccgtctttgattctcaacttcaaagacggttgttgacaagaaccgtctttgattctagctttcaaagacggtttttgatacaaccgtcttcgaaaatccaaaatgaagacggtttttgtgaataaccgtctttaaagataggaatcaaagacggttttctatacaaccgtctttgaaagtgcttatcaaagacggtttttgtgaataaccgtctttgaaagtcctaattaaagatggttttaatggaaccgtgaattttttttacattatttaatatatgttgatatatatttgatatattttaaatttaatttgttaataaaaattgtaataatatttcatatattttatacagggaaattttaataaaataaagtgataaaagctaaaaataaaataaaataaaactataaagagcataatctaaacttgcaaaatacaagaacaaaatggtaaagattaaaagtaaacatatataaccaagatacaaatataagaaatgtattttaacataagataattgtagcctaaacatatataatcaagtttatttactgcatcataatcattcataaatagacaaggaactacaaatgtcaattttacataaatcagctaattgtagcctaaacagttttgcctaaggaggtgaacttgaacctgaaaataatgagtcaagaaatcgagtttgcttatgacatttttttcctaaatcaagcatcatatagacaaaaacatcacaatattagtatgccaaaggtccaaaactaacatctttagcaatatcctctttcccttttttaaattttgcaagttgctgatgatactcttcaagctctttatccaacttttcaatgaactggctagtatgctcgatggactgctcatacctatatttctccaaggcctggaaaattttcacaataagatagaaatcgtaagtccataagctttatgctaaaagaatacaacccaattctttctcaacataatatattccccatgaaaaactatgaatcagcattttgcagtttttaaacttatccagtctatcaaaagcaccaatctttcatttctcagaagacaaacacaggcttacaagtttatctaaataaaagaggattaatctctcaatagaaaacaaaaaattatgaagttcagttcactagtgtacacgaggcatgtgagagagcatgctcaggtccccaacattactattagcagcaatatgttgaggcataaatccaaagtagtcttcaaacttctatagctagctttcttagtcaaatgcagtgaataataaatgaaatgagcattatgaaatactactgatctatattaaaagaggctataaaagatggaaatcattcctatcaacctaggttaagctcataaagattcaagaaaagatgattgtcataataacttgaattattttttttgagtggttttgatccgtggattatgtcaatcctctaatatattgcaagtttgcaacatacatcacactgtcattcagtcatgttcaactcaaccctcaagtagattatttctacaattctaattgctcaataggagagaaacatcattaattccgtgttactacaaagcattgcccatttcacatatcatagtgctaagaattttggaacctatcatgcatagttacctaacaaatagttacttcgtacatgatgaacacttaatcagcttctttctttatctccacgtacatttaaatctttccttccatgctattatatgagaaatgagaaatgaaaaaatagtaaatatttttaacataaggtcaaattaaataacaaagtaatataaaatagtaaataacagaataatattatttttaaaatagtaaatattttagtaatataaaataatttttatagtccttcattaaaataatttaaaggactcaacacgttgctataaaatataacctgatcaaagacaacaacatagacttgatgaagagaatgagaactgcagaactgattaatctcatgatgaatcttgtcatatatccatgtcttgtcataatgtacagctcagaagtgataaaaattgataaaattgataatagttaaagtaaaaataaagaacacatacagctcagaagtgaaaaagaactgcttcctagaagagtaggtacatcacctgcatttagagcatttccaagatgcatacccagtgatggggaggttgtatttaataacaattgcttcaaaagctttaccaagtgatccttttcaatgtgagaatacctgcataataattaattacaacaccaatgaaactattataaaggaggaagggttcataaataaagcagtataccaatataataattaataattaatcaatgaaggatcataaaggagatgcgatacaaaaatatacctctccactaatgtactgtaatttaaagggaatgatagactctaattaggtgataacaaacagaaaatggccaaaactctaattttgaattcatttatcaaaaaagaatacaagataaaacaaaaagtaacactttcttttgcctgcttgttcccatgattccactgtcccgagataaacaacgataattaccactcttccatcctatcacaccttcatcccaaacaactactcaaattttaattttatctcaaaattaagcaattgagcaagagacatgagtcacatgactaattagaatttatcagcagtaagatttgaacccatgaactccaactcaaagggaaaaaaccttaccattccacagaggcaaccagcgacactacgaccatgattatgcaagtcctaaaatggaaaatagggaaaccccactgtaaaggcaaccaacgaaacactgtcccatattttgaaaaagaattcaatatatatctcttttatttaaaataaaaaagtctctcacttaggtcttactcactgtgaacaaatccttaacaaaaatgtaaatgactaaagtcatttacattattcctcgttgctcaatcttgtaatgaacgacagtcctcacatcaggatcgtcaattttggaaaatgttttttgtgctaagtgcttttctgtggacaaggataagaaacactgatcagtgttagccgtacatgcagacaagcttgcaataggatgtgattatggactttcatggtaccctggtccgttaatcacatttaataaatattaatgaattgtttgcaatatattgacatgtctaaattttagcaacattctttatattatctttctaacactttaattaatgtttgtattaaaaattatctattttgaaaggtttcattttttatttaatgatgattttaatatatgttagttaataataaaaaaatcttacaagaaacaatcattagcattactcctaataaatattactttttaatattatatcgttaagatagtattcaagttagatccttgatataaataattttgataaacttaatttaatttcatgcaaattacaaattaattaagatctcttttcttgataaatcaaagggttaagagtattccaatatctttctatgcataccaagattttcttataatttaatatcaaaatcttaaattagcacaataatgtatgtgattttataactataaaataagtaattgttttagcttaattgatgattttaattaatttcaagtattgagtatataactatatttagttaatttattttaatttaaataaatattttaaaaaatatttattttaaatttaaacaaattcactcactaaatactagtcaaagaaagaacattgttacaaatattattttcatctaactcaagtataattacttgtcgtaaagcacatatatattctaaaaaaaaagtacgtgattgcctaaaaataagtacatgatactttttatataaataaaatatattatgtatactttatgtacgtggagtaaaaaaattattccaggataaaattcctacatattgagtcattactgcagtctaaaatgagtggctaaagttttatctatctatatgattatataatttaaagtgtgtaactttatatatcccattaaattttaatttcagaaaaggaaaaaaacaaaatagaacggatacttatttattttagaaaccaattaaatttactcgtggggaagtaaaatttgtttttctttataataaaagaagtaaaaatttaactagaaagttcacctgatcgaaagtctccatcaggattcactgtcatcatagttggctgtgaagcaagctgcacaatctatatgatgctgttgcatatgtaccttccaacaagatgtgtcaatatgataagataatatagtaagaatgttagatgtaacatatgtgaaataatatctatccatattacacagcacacatgtacatgtaacatatgtgaaatggaaaaagaataacaaacaatctaccggttcatgtgtgctcagcttcagctctgtttctcccattgcattactcatatcctcaagttcaacaagattgttaatttcctaagtttaaaggaagtcacaaagcttagaataatcaaagaaagaagggactagaccataaaacttgttgaagtatatcagagcacacaagagttgaattttaagttttctgagagaaacgtaatagcaacaaaggcataagcaaaataatagaaagtccaggcaatccagaaaaaaaatgagttatgaccgctgatagataattgaacaaagttaattgaaaagaaaaagtctagtggaataacaaattgaaaagcaaagagacctgcatacagttgttctccaagttgcttcctttgtaaacattgttggggcagagcaacgccaaatctctagagatgaagccagttccatccgtgagaatacgtggtttctcattatcaaccataatattgccatttgcatcctaaactcgcaataaaaaaaagaatctgcaagcatggccataaattataaaaaccataaggagacttaaaattgaccttaccttgcaatattcatctggtattttttggacactcacagttgtcaagtcaatgttgagtttcaaggtcttggacaaaatgagagagaacctgaatgcctatgaggttagtacattgcatgaaatgtattttgagtgggactgcgggaggatgcagaaaaatatatgaaactctaaatgatagtatttagtatttgcacaagtatcatacctagccatatacttgtccaaattgggcaacaacaagtgaacatgcatgaataaagttcttgcttcagacactgtctttaaaaactattcagttggcacaaaatatatcagtcacgagaggcttcttaactgtaaaatatattgtgaatgtggggtctcatcacacctagattttcactgtgtaggaagcaaagctttcctaagtggactcagaatccacccatggcatgtgaggctagctttcttaatgcagataaaggtcactcatgctggcttaagagctgcatatatctgtggaacaagagccatgactctgtcatgctcaaccacactctcctcttggttaaacatactgactgtatttttattttaaatatataattcaatgggttggatcactgattaatttttttggagtaagctcaccctcaaccgtctccaatgcaaggcattagaactttgcttcaatgtttccctcaaccgtttgccagcatccacatcaagccctcttctgagtcctccatattccaccactccctcactttcctcaatgccttggttgcagccttcaagagtgctcaggctcaccaacgccgcggttcgattgagaaccagcagcaacccattatggccttgaagattgaggtggagcagctcatagtatctatccttgatgatcctagcattagtagggtcatgagagaagctggtttctctagtgcccttgttaaaacaagggttgaacaagctgtttcaatggaagtttcttcacagcaacaagcttccaaggaaaacaccaccaccaagcttcaagttcttggtggtagcagcggcatgttcccatctggatcttttggtcaatttggggcatcattcaagtctatagaccatgttggtgatcgtttagatgatgtaactagtgttttgagtgaccttgtgagcaagaggagaaacacagtcattattggggagagtcttcctagtgctgagggagtagctaggggagtgatggaaaggttagaaagatggagtgttcaaggagagttgaggtttgtgcaatttgtgagtctacctcttgtatccttgaggaacattagcaaggaggaggttgaaaggaagcttgtggagcttagaaacctagtaaagcatgtcactcctcccttgaaactatttgggatcttcacccctttacagttccagttggtagcttgagccttgctttaaattttgataggtacgtagataattcagtcttctatatactattttctgctttgaatgttattattgtattctaattttagtgatattgaatttggtttttttttctttgtttcagttattttcatgttcagcagagaagcaaggtaacattcaaggacgaatcttttgaagaacgagccaaagtgcgcaagtatctaacttgctgcagagattgctcattgaattttgaaaaagaagctaaaagcattgctagtagttttactataagcaagagagattgcaccactagcttgccaatatggctcaaaaattgcaaggaagagagaagttacatgatggaggatcaggttattattaaaattaaccactcttgcttcaaaataataacaaggcatgcattaatttatgaatgaaagtgttgaaactgatgtttctgtgttttttgttttgaaccaggaaaatgctaagcttagggatatttgcaagaaatggaactcattttgcagttcagcacatggatttccgtccaatcttgtgaaaccatttttgttcatttcatcctctccctcatcccctacttcagtctcttcacatgaaagaaagcctagtttcaatctgagccacctaaactggccagtcatttctgaaccaaaagaagtacctaaagaatgtgagttatacactgaaactactgttagtcatgattcctatgaaggaaacttgataatgttcatgccagagaggaaccatcctaagctagaccttttgtccaatcctaattctagccccaattccgcttcttcaagagatgcagtggaaggtttggacagcactcaaatgttcaagggccataatgatgagaatctgaagattctatgtgatgcattggagaaaaaggctccacaacagaaagactcacaaaggagttaagttgttttgatgtatataaatatgtatgttattgaatattgttatgtgtatgtattgtaattgaattaactgtatagtgcatttgtgtagatggagaacaatgactggtactatgacattatgatgtcagaagaaataaatgtagaggaagaagatattgtctgataacccaaacctcgatctgttttattaggactcccctgttggatagcctttatgcagaggaatggcttacagttcagagacggcttcaccactaggaacaccttagtgccaagatggttagcagcttgttggtctccttcaccaaggtttcagatgggaataagttagaggttttctcacagcagctttgcggcatgagtagtgctgccattccagtcagtggaagattgtttcaaagaaatggaatgcagaagagtttttatcaatgaaggtttttaatcttttgattttttttaaaaaatgaaaagttttaaaaagagaaatgaatcaggccgtaggaaagaacagaactgccataaatggtttcagtgtggaagcctagggtgattgctgcaagataggccaaaacttctcaatggtggttggtggggctcaataaggtagcttaaggtcaggtttgagtgttgaagacctattaacttcatgttaatattataatttgaagcaactttctaaagattaataaaaaaaaataaaattaaaaaatcaacagaaacgcaaaggtgactagatggagctaataaatttttgtttttgggaactggacagcaaaatagtgatggaacaagtcatggaggacggtaccactctgacacaatgtcgaaggagagaaaaatacatgaaaaagatgcttaaacagtgtcttaattacaaaatagtccattttatataagtttattgcaataaatacaaataataataggagattttattcctacatacatgatatgatatgcctataaatcagattctaataatctgatcctaatcagatatccctataattataaagataatcaaatgatatcgtaagatatttttaattctaatagaaacataaatgaatttggaaaacatggaattggaaaggaaaaatacataccaagcatttcaaagagtagtttcaagcaggtaactgcatgtgaaaattcaagtgaatcaccacttatatgattgagtacaatatcaacgagaaagggatagcgttccaatatcccttcttcaaaagttaaaggatccaagaagccaagccttcacaagacatacgtaaaagaagtgaaatgaaactgttataacaaacatactacgctaaatatagatactatcaattttaaaacacacttcttacagtgatttgacaccaatccataaagacacacgatccagttgagttcttggggttgaggtctccaaagccactggcaaagcatctgcctctaaacagccaataaacttcttaagcaatggctgcaaaggttccaagtctgtaggtctcctacacatagacaaacatagatcatatcaaaaaggtcggaatccttctaaatatctcacagcagaaaactatatgtgaacacagtgatgaagacaagatccaacagaacgaacacttctcttgcaaaaaagtaatgcataaactccctggaagaaaatgagttcaccatttaagcaatctgtaacagtgaatctgctagcagaaatacacagcaagtcaaaatattatatcaaccatacagaccctgaaaacatacctcatacaaaacattaacaacttcagcattatcacaagagggattgtacttttcccctgctatttttgtattgatatctttaagatgaaatgtcaccctctcactgtttgctatggaaactacaccaaggctcattggatatgaaaccaacaaggcagcactgctttaataacaacatttttcatgcagaataaaagaacaacacaatcccaataatcacttattctcaattttcccacaactactactagtgtaaatggaacgcccagcaaccatcacaaggttctgaagcttggaaaaagggtcatcatcaaaacccatgtcagatttcacttaaccacccctctgcaccccatattgggctccatacaaggagataaccataacaagggtgaccacaaaggacaaggctaggaagagacccattacagggtgaagcttgaagaagtgatgaaaatggttcccaaatgatttgatcattctgacagggaataagggcgaatttttcgactttcgggttctttttatggtgttcctgagtctaagtcgaaatcggttcttgggtatgcggggaacgacttgggggcttgggacccaaaagggtaactgttcaatgctataaaataaacattaaacgtccattataggttctaacctaccaaacacaagacaagccttcaagtcacacaaatcgggaaacctagcagagaacatgtgaataaccaaatacagaaaccacaaacaagggaagcagaaactcgagtaaagagggttcaagggcttaccttcgctgatagtgagagggcttcgagtaaagtggcaggggttccgctgtgagagagagctcgtgagtcaaggagatgcagagagggagtgccggtgtaaaatagaagggtagggcacaaagtacacgcgcgtttttgtatatagcaatgttttcattttattttttaaatttgaaattacaaataaaacaaagacggttacccaaaaaccgtctttgtatggggaggaaacaacgacagtcattgaaggaccgtcttctttactcacatactacgacgggtttttagaaaacgtcgttgtaaactttgctttatttgcaaaaatgccaccgcaccacttacaaagacggttatgaaataaccgtcgtcgaatgcgcgtcgtaaaatccaccttttctagtagtggttgcactaacaactttagtgtaatttaactaagacttcatagaatagaatggggtagtgtttgtgtgattgttacatggaagtttcttcgtagatgagggccttgaattgggcatgcatgggggccaaatatgtggatgagagtggttagttcggcacgcaacgatggtccaattaaccatgaaactttgctcgttcccatgtactattgcgcaaggatggaaataatttagtagtgacgcttgttaacgacctaaatatttttttttttaaaaaattaagctaaggtaaagggagttgattgcgggtattaggattgggcaaaaaaattcatatctataaaaaaaatctatatctaattcaatctaatctattttaaatccatttaaatgaattagtttcgtatccaaatccatttttttggattttaaatccaatccaattaattggattgaaatggatatggattggatatttgtttggatttttaaatctaattttttttgtcaactttgattgaaactatttttttggtcgacgtcaattaatgatgattttaagccgtcatccttgagcctatttttcgattaatgttggtaaggtttttttagtcaacattgattgagactatttttttgccgacatcaatcgatgttatttttttgtcgatgtcagctaggtttttttgccgatgtctgttgagatcattttttatcgacatcaagtaggtttttcgctcgacgtcgactatggtttttttggtcgatgtcagataatactattttttggctgacatcggttgaaaaaatcatcgaccgtcatcaaccaaaaaaactagttgacgttagccaaaatatttccccaattgacgtcgatcgaaaaaatcctaattgatgccaacaaaaaatatccctcgctaacactagccaaaagaaatagtcatggttaatgttgaccaacaaatcctagttgttgccaacaaaaatatagtttcaaccaacatcagcaaaaaaaaatctaagtaacatcaaccaaaaaaaagtcttgacaaatgttggcaaaaaaatatcaatgatcgacatcggccaaaaaaaccttatcaatgttagccacaaaaatcccaaccaatgtcggccaaaaattagtcacgattgatgttgatcgaaaaaccctagtcaatgtatgtcaaaaaatgtaatgactaaaaatccttgccgacctcaaccaaaaagtaatcctacctaagatcgaccaaaaacattgaccaatgtcaactgaaaatgcactgactaatatcagcacaaaatagtcttagttgtgtcggtctaaaaatgttcgaaattaccttggttgaggtatgccaaaaatacactaaccaatatcaataaaaaaaagtctttaccaatgtcgttgaaaataactcttaaatggataggtactaaattttcactttttagcatttaataactaaaatttataaaaaaaaaaattataacatttaagtggatataaattggatatatccaaattcatatccatttaaatggattggatcttgaatataaattgttttttaaaaatatggatatggatttaaaatccaatccatttaaatagatataaattggatatggattggattcttaaaaatccaatccatgcccacccctagcgggtactacttatggggaggcgatacgagataggtgagggtatatgatcctctagaggtcacaaccgctgcatcagtacaataacgaggttcacatgatttgtgaattcattaacaacgattggccagtctcccttcgtcacatgcttcgagaagggtatctatgtgcatatgcaccgaccaagtttggtgctgagattgcaagttcactggtggttgttcttaggaaatctgagtttcttatcccgtcccttcaagctgatgatagttgttagaaaattggttgaatgtgttttgctttgaaggataggatagatagaatgtatgatgagtgagatagtagtgagaatattgggtaagtatagaaaggtgagaacttagtttacaagggaactagtgtttttatttttgcttgtttgcttgctcacttttcttgcttacataaactacaaggctttgggggtatttataggagtcttcacctcgttaatatgtggtctacatttgtttatctagaaagctctgttctagattattctacaactcctatgtctttctagaataatctacataagtacatttttttcaatgtctctagattcttctaaatacctctagattcttctcttaatttcttcaagcttccataagtttctagaaggttccataagcttccataagtttctagagtattctagaaatgtgcaacattttctaatactcctccttgatgcacatttccataactccaatcatatctcttagtaattcgaaccttgattttggtagtgcgtttgtgaaaatgtctgctagttgttatttctttgtttgcttcggcttccctaatgcaggattctttgtcattgctatagcagacttgttatcacaatatatatctctattgcttgattttgctgttctcccatgtcttcaagtatgtgcttgagccatatggtttgacttgtagttatagttgctgctatatattctacttctgctgatgattgagcaactgttgtttgcttttttaatgcccaagagaatattcctgagccaagtgtgaaagcatagcctgaggtgctcttcatatcatccattgatcctgctgtggaaaataaggaacacttcacacttaaccaagaggggggtgaattggttagtcttggtaaattaaaaatttctttgatgaaaatcagagtttcaaatcagagttttattgccctttggatctttatcacaaaaccaaacaagaatctttatccaagattaatccaagacttgttatgccacaagaacacacatgcaaaacagatttcacacatgtataatcaaatctgcagaatataaatcaaaacacaagatttatactggttcacctcaaaacctatgaggctacatccagtttcttctactcaacactagagtagagttcactattgtaaatattattcttacaagcaattacaaacttctcttcatcaaccctagatgaagttcagagatctaaaactctattagatccttagaagccttacccacactgagaacactactcagctgaccttggagaaaccctatctccacttagagaaacactatctccacttgcaagagaacccacttacaatagaaccacacatacaaagttacaacagaaaatctttatactcacaaagattaaggaaagaattcacctgatgatccaagaatgaaatgcatatgaatgagaatcttaggttgaatgcaaaccaataatgcagaacaactttccttagcctttgtgaaagaatagcttgcttcactaacaccttagtgacccataaatgaatcaatggaagcaagactctatgaacccagaagaatgcctttgtgaatccttggaaagctcttacaatgctcagaattcaaaaagatcaagtactaaatgaatctgtattattattttatcacaagaggcaagggttcaatttatagcaaatttcataacagaattaatcgattaaaagtgctccccatgctcctgtaatcgattaaaacgacctgggaaagttcaggatttcagttaacgggttaaataatcgattaacccgacgcgtaatcgattaaactagacttgaacaaaaaatcctgtttaagtaaaataatcaattacattccacggtaatcgattaagccagagcaagcttaaatctggtttgtgtaatataatcgattacattatttggtaatcgattaaaccagcgtgagtgcaaaatatgatttgaactatataatcgattacaatcaatggtaatcgattaaaccagagtgattataacaccccaaaatttagggaattatagacaattactaagagtaaaatgttaatgaaaggtagtagaaaaatttagggcaaaatgacaagaacgcctctgaacaatttttgaaatgacatttatgtccctagggtgaaaatgacaattttgccctgaacaattctggaaatgatcaatgtatccataggagaaattaccaaaatatccttggacaatttcataaatgacagataggtccctaaggcactaaaagaccaaaatacccctggatattttattaatgaccaaattgtccttaggcattttaacaagatacttaaggaggaaattctctaaatactctgagatgcctaaaaaataatcagaatacccttagggtaacaaatacagaatttccctgaatatttttggaaatgacgattttacccctagggtgaagggtaaaattaccaaaatgctcctaggtcaaaacttaccaagatgactttagaaaataatgggaacctaagcataggataaaatactcttagacaacaaataatcagcaaggttaagggcaaagaaccctaaaatagaatttatacgaattttggaagataagttgaaaagagcttaacctagactatctcgagtatcagaaaattagaggaaaaggatggttataatctatgaagttttttcttaattatagaaggaataggtttcctaaataagttagtatagtaattttagtaattcaaggcaaaatggaccaataagaattgagattaaactattacatgtaaaggaggaagaattggtggatttggatttctaaattaagccttgaccgtatgatacaagatcaatggaaaaagctctaagaaacttcaagaatggacacatgaatgtttaagaggcttaggaacttgctattggtccaaatggaaagctagtcataaatgcttaaaagatatttgaagcaaattttattttgtttccttgagcaaaaaacgtagacatctctaggccttatttcaaagatcccaacggtcaaaggctagatatgtaagttaggaatataccattaaaattttaagaaaatccaatggttaacgaacccataattgttattttacagaaacggatttttaagaaagaagtaaaacacaaaaatctttaaatgttggttactacatgtaaatggaataaacgccaacagaattgtctacacaaagcaaggtagcacgtgaaaataagcaagaagcaaggaaaggtgtggaaaattcatgaagaaagccacttggaagcaagaaattacttagccaatgaaaagctaaccaagtggaaagtaaaagcaagatttttagcacaaaaaatctcactaaggaggtggacgtgcacaagctcttagcagcaccttagggaaagcaattttatatataaaacaagcaaggaaccatggcatatggttaggtaagaaaaccaagaggtaaacgtgcaaacaccctagctttatactatttgatttctaaacactttcaacataaaccaaagggtggccgtgcccttactcccttgtgtatcctatcttcttttcatttaacctccttcgtcactttcccaatataccttttacctaagcaagaaaatcaagactcctaatcctaacaagttcaagtgggaatcaaaaaggaaaaagaaaggaagagttgttcaaatttgagaaagaaagcaaaggtatggggagtttatgatattcaaagtttgaataagattcttatatggttttgaaattaaaatgggataatagactatgttgctataatttggatgatgggctgaaatccttctatgtatctatatctagtttgatgataaacttggttggaaacatgttttattcctagaagaatgttgactttatagaaattaagtcttgtatacaagatgtttgatgaaatgcctcaaagaacccaaaaattgctacatgaaggataggtgattaattagtattaatcttagtcttagaaataattattgattaaataaactaaaaaactaacctaaccaatgaaatttaaagtgatttacaatttgaaaagtggtttaaaattgtttaatagaatatgttcctaagccttgatgtggccgaaattttctatgtctctttaagagtatatatgttgttttgatgctagaaattggtggagaacatgttgatttattcttaaaaatatgttgaactttataaggattaaagtttaaagtagctttctttgtattctatggattcaaggttgcacaccatgtgtttgataaattgtcacaatgaatgaaatatgtttaaaaggtgtttgtttgaatttttattgttggtttgatgctttactgttggatttgaagtgtatttgcatggctgaatatttaaaacaaaagttgtgtgttatttcatgtgttgctgagtgttttctataaaagcccaccatgtgtttgatgaattaacttcaagagataaaactgctctaagtaaatgaaatggttaaattttgatttgttctaagaactatatggagtagactatggttgtatgaccttatgacttatctgagaagaatttaaagaattgaactatggttgtatgcttgggctgtggtgaaaagctttatgtgatgattgaaagaagctttaattgtgatttaaaaagcaaacgccataagttgagttttgaggtatatgtgatttgagaaaaagaataattaaaagatgtgataaaacgaaccattcacgcattttcatatgcatatgcctggcgggggttaatccatggagttgatgccttacgggggttaaaccgtggagttgtgtgtcagatagttagaggaactgagtatgagtgttcagacactgaggagtctgagctggcggggtgcttcggcagtgaggaactcacgccacccatgatgatcacatgcagtgtgggtgactttcctgtgcaccactgtgacaccctgattgatcatgcaagttctggaccattgattggggctatctgactgtggccactgatgttgattttatgataaagctgagatctcagtcatgcatcatattaaaagatgagcatgcatttcatgcaccacatgatgagtatgtgaaatgattatttattgatgaatatatggtgagctgaatatttaatctgggtgctgtgaaataatctgtgaatcaattggtcttttatatatatcttattcaaactatgtttgtcataaacttacccgagttgtgtctgtggttgacacctgtgatgaccccaattcgtttgggctagcagaggaacagtagtagctgagcatggatggtggaatgaagatgtgcatggatgattggaagatgtgatgtcgatgttgtgatgcttgttatttgtggttcttatgtattttggactgtctgtatattattggacatgtattatggactgtattataaactgtatagtggactgtatcatggactgtactcttatttataaatgaaccgtggtgaggaaaaccgtttatactatttacataaaattagcaaacaaggcgaaaagaattttcgtgaaaaatttacaactaagatcattataacacaaagtggacacgaatttcatctaaaagcaatcaagcacgagagagtcaagagagaggcgttacaatggtggtatcatagtcaagagagaggcgttacagtgactgtattttccaaatgagcatgtaatcgattacgacactatggtaatcgattaaagtgttcttgaaaatttttcagaaagcttatgaacaaaataatcgattctttcgatgctataatcgattaaaacagacttagcctatttttccaaaatacttagcttcttttaaagttttaaatcaattacttagattctatatgatgcaatgcttaaaatatatatatgaatgatatgtatgcaaagtttggatcatcatagtgctttcaatccttttacattaaatcacaatcttccatcttcaaatcttgaaccatgttgaaagccaaaacatccaagacttcacatgcttgattcttcacttgtttttcatgtagctctccctcaaatcaacacctgcccaaacactgtcagtataaccaatcagtcttgatttaggagtagactagtaccatatgccatagttctttgttccttgcaagtatcgtaatactcgttttgttgctccatgtgaacttggcttggactctgcatgaatcttgataatagactagtagcgtacataatatcagggcttgtagctattagataaagcaggcttccaatgaggcttcgaatttgtgtgttatttgcacttggtgtgacatcatcccttgttaatcctttgttgctatctagtggagtagctactttcttgaagtcttccatcttgaatttcttcaaaagattagtagtatacttcttttgtgaaatataggtaccttcttttgtttgagctatctctattccaagaaaatagtgcattagaccaaggtctgtaacatcccgagcattgaagagggcggggagtgatcgccggtgcagtgaggcatggacaaggagcggctcctggcaggcttccagcgggaggggtacatgaatgaatcgaatacacacccgaacgagaggaatccagaggttgttcaagtatgagactgtacagttgaggataacttaaaggatttaataggtactacctataccaacacggtgcatctacttttcagtagcctataacataagaactccctctggccactgactcctcctctacatatgactgggagggtccacctctgagatggctgtacccctcagcatgctgactagctcctcctatctggcgactatcctcgccctcaggaataggatgtggaggatcatatcttcgccgagctctcaactcagccatcaactcctcattggccttcatcaaggcctcattagcctgcctgcttgcagctatctcctgctgcatagcggtcaaggcatctatcactgggtcagggcgctcatccgcacctgcctcaccacctaggttccgggtcctcaccatggtactgcacatatcacataaaaagggtgagttgatcaagctcactctcaacagttacacatgcaattaccataatgaacaccctagcacacacatacaacacacaattcaccatatgtacagtgcttccctgtcaaactgctctgataccataatgtaacgccccaattcactaatcagggtcattaccaaacatacaccacaattaaacagataatcaatcagagtttaagcagtttggaagcatatactaaaagtgacatcatcaaatgtcatatgtataacactgtacactataatatggtgaatatacatacaagttcctctgtacagtacaaaactatacaatatcccctcagggtacaacaaaatccacatctaaaacaaaatacaaaacatctgagccacatgctcatgtcctctagcctaaggtgtccatcagcagctaatcctgcataggcttcttgccttgggatctctctgctattctggaagaatcacctgcaaaacatagccccacacaaggggtgagatataaatctcagtaaactcagggcccttgaaggtatttccttcccctggttcactgacaacatatatatatatatatatatatatcaaacacaatcacaatcatcatcagtgaatcactcaatcaatcatcatgcacaatacacctgaccacaatcaggctatacacatccatcagccaaaaccaaggcatactcatggcatacagccattcatcacatcaataactgtcatgcagaggctacatcatagtatataggaacatctcctcacaggaaggctacctctatatactaggcacatctcctgcatgtatccctagcggaggcttcatctagatatataggtacatctctatctcgaggcttcgtctatatatcaggtacatctcctttttggtgaggctacctctgtatacataggaacatctcttatcacgaggctacctctatgtatcacaaggccatctcatcctctacacaatacagttgcctggggaggctacctctgtgtatatgggaacatctccacataggaggctacctccatatcacaggctcatctctcaccaggtctttctcaatctcaaatcatctatcctacgacaataggatactattcaagcacagcatgcataatcaggtttcacattcaaccaggcatgccacaatcagtcacatcataaccatgcatattaatcccctatcatagggttctgttcacatttcaagcataacagattaatacatctcaatttccctctcatagggatcagaacatcagtacacagtatccatatacatgcatacccaagtttcataatcaatcaggcatgctaccaatccacacattcatacatatcaatttccctttctcagggatcaaatacgcatcaattccctttctcagggatcaactacacatcaattccctttctcaggaatcaaatcatcaatcacaactcatagttatacatcatactcacccatctctgggttcagatcaaatataaagcatcagctaccctttcatagggttcagacaacatctaccaatcattcacagcattatacccgttcctctattagtctaaacacatatcataaccataatcccagtggatatatggtggaatgcaacagaggatacacaaacaagaaccaagagcttacctgctctagacagatcaccggctctcccggcctcgtggtcaacaccaccagagctctcacgctcacgtcctacacaagaacaagtatataacatatcagatacggttctagaccgttcaagcgaaagggaactctcattctttctataaacataaactaatcactgtacaagtgatcatctgatcctcgacaggatccttctcagcctatatcaggctatagagcctccaccaagactctaatcaagctatggtcaagcatattcctgcttaaaaccaacttctcataatcagcagtttcaactcacaaaccgcatctacaacatctcatgagcaactttgtcaactgctctaaggtccagactagtcaaatagtcaaccttttatctctgctcatactgactcagagccaaaatcaaacgtcatcaataatgatgattcaaggctctaacttcatcagagtaactttctgaacataagactctacagagtccgagcctaataacggctctaacacctccaaaaacaccccttaagatattcaaaatctaaccaaagacccaaatatagaaccaacggctagagctcgagtttcttacctctgtgtagctcagacacactagggaaccactttccctaagacagctcgctcagccaagcctcctctggtcctggttcttcgattccaaaaactccctttggaatctcaatctcgccgtaagtcgacttttctcgagaatcaagctaagtcactagcttatctcgacgctctggacacttcctcagttgggtctaaggtgtttagatgagaggtgaagaagatatcaagctctcaaagtcgttaatggcggtttctctctttcttcccttctttctcttttcctttctctttctctctctcagccaaatgaaccatttataaaagcctgcccaaggtcccgcgcggttcgcgccaagtcccgcgcggatcacgccaaaggctcgaagaacccacgctattggcgccggagccacgctattagcgtgagatggctgcaaagattggcctatttttagcttcccgcgctaaccgcgccaactcccgcgctgaccgcgccatgagctcggccaacccacgctgttagcgtgagacccacgctgagagcatgaaaaggccgcatgaattggcctggtttaagcatctggcatggatcgcgccacactccacacggttagcgccacatgttcaaatctgttttctcaattcttttctcaagcttttctctaaacatactaagcctaatcattattcttaatcaagggcttaatccaggcttaattacatgcttaaaattcaagacattacattgagcgttacaagtggtatcagagcaaggcctctctaccagtatggtgtggttcgaggacgaactaggcgaaagctggtgggcatgtaacatcctgggcgctgacgagggcggggagtgatcgccgattcggtgaggcatggacaaggagcggctcctggcaggcttccagcgggaggggtacatgaatgaatcgaatacacacccgaacgagagggatccagaggctgtgcaggtatgggactgtacagttgaggataacttaaaggatttaataggtactacctataccaacaaggtgcatctacttttcggtagcccataacataagaactccacagttaagcatgcttgacttagagcgatcttgggatgggtgacctcttgggaagtttctcaagaagtgtgtgagtgaggacaaagcacactaaaaagtcttgtgtttgtatgtatttctcaagaagtgtgtgagtgaggacaaagcacactgaaaagtcttgtgttggtatgtagggacaatcgttgatcttgtaagtggtcgagcgttacaaggtctgtcatctcaaatgtcttatcatatcttcttttaattcatggaccatcttctcattgtttcctgtatagataagatcatcaacatataaggagacaataagtgtgtcagttgtaccttggttcttgatatataatgttggctcacttttactcctcctaaatccttgctcaatgaagtaactgtctattctactatagcacgctcgcggagcttgctttaggccatagagtgctttctttaacttaagaactttgtcttgttaaccatttaccacgcacccttgaggttgctccacataaatttcttcttcaaggtatcttataataaccaagcctaaaaaaaagaatttacaatattctgtcacaaaaagccttagcgacagaattagcgacggaattagcgacggctagttcctggcgcaaatagcgccagatgctgcgccattagcgccaggatggcgccagtagcactaaagttcaccagaaggccaattttctctggaatctggcgtggttagcgccagaaatgcaccgaaaagccatttcccattggaatttggcgccaatagcttgaaattagcgcgattagcgcgggaaagcgggcaggacctctataaaaggccattttcgcgaattctggcccaaaaacttcaccttcttcctcccagcgattccaccattgataaaccttgagagcttcataatccttcagtccttaaccaaaacctttagcttccaatatgaaacttgaaggaaatcatcctatgagctagattccatcatcagttttccctaaaaaccatcaaatagagagatcattttttttagggaactttccaaagtttcgatttcgaagggaaattaggcgttttaatgacacccaagcttggagaagttggcctctaacattccttgtcgatttagaggcaagaaacataaattctatcgtttattaaagaatttattcttgaggtgaatagtgacctttttgagttagagttgaaattaggcttgggtcctttggaaaagtatgcttaggaggttgttgtgatgaaggtttaaccttaaaatatgatttttatggactttggaatttggctctgaataatgtatgagtaggaagaatgttggttaaattggtaattttatgctatgcatgagccttggtgcttttacaatatgtgctcaagagtctatataaacggtgaaattgttgaagtaactgttttagccaatttgataatcattgaaatgtggtatggttagggtgttgaaccctttgaattggttgatgtagagtcttagggagactctagtaccttaattaggatgagatatatcctactgggggtctgtaaatcaccagttaggtgattagtctttgaaatttagaaaaataggttaaatggaaaagaatagctttcctttctttccaactgttgagaaccgatgttgattccttgtgtgcctttgtatagggcgtgacaccgagggtgtcagtggcggaaaccacagttcaggaattgaacagtagagcacggttttgctaggtaagttctttgttcttgggagtgtttccaactacttgagttccaccatactccgagggagtgatggttgcatacatgattcatatgcattgaattggatcttacaactttcctcatgataatatgtatgcatgtttatgtgctttgtgtttggttgcctttcggatacatattctggccagttagataaatatggacctccctaggagtagagtgcaactcctagtcagtttgctcacgtaaagggtgtatgatcccttaacaccagagataggtggtcccgtcgcaattgaagcctattctcaaaggtgccatatacgtgcatccatgcgtaaaggggtagctcccgatgggatggcacagatgtgagttccgatctcacattggggactgagagtcccgatgctgatgatgatgcatctttggcaggcgtagtaccgcagatacacattagagctagagaatgtctctgtgttgttgtgagggccaggaggcctggtgttgtgatgcctttgatgttatgtatcatggaagtgagccagggggaggagaagcctccaaggtccctaagcttactgagattgtatctcaccccgtgtgtggggattatattttgtaggtgatacgtctgggcagagatgatgggtcccagggcgagagactccagtagggacagaatctatgtagttgcttggtagtattttgagaacattgtggctcactattttatgtttatgatgtattttgtacttctgcgagggaagatatgagtgtacacatattttggatcctgtatggatgtgatgtacagacgctatacgtgttgtaccctcttgtaaggatgtgatctgtgagatcatggcacagggtgcctattcttttgtatagccacaatggtggtttttggtggtgtatatatgtatacacccatatagacatatgtggcttttgattctcctgttgtatttgtatggatatattatgtctttacctgtcgttctttatgttatctggatcgtagaggcttgttgtagtattgtggctttcgtttatgtatcgtggatacgtaccatacataatgaatcaagaaatatggttttgaaaggaaatgatgatgatgtcatgttttttattgaaaatgcttccgttgtttttacttattggttttcaattaattaatgcgttaatttgattaaataattgttaatacaccagatgcatacgggggtgttacatatctattgagaaatgcaaactttacatctagttggtaaatcttccacttcttttgtgcagccagtgcaatcaaagctctaattgtatcaagccatgcgaatggggcaaatgtctcattgtagtcgatgccgaactgttgagcatatcccttggcaactagtcttgctttatgtttttgaattgagccatctaggttaagttttgtcttgtaaacccacttaactccaatgacttctttctcttcgaggaagatccactagctcccaagtctagatcttgtcgatcatctttatttcttcttccatagcttttctccatacttattgctttgaagcttcttcatagttttctggctcggtgattgtgaaattgcgtacctggtagatctctgacaatgacttagttcttggtgtcgactctggagatgaggcaagtgattcttcccctgttgcttgtgttggagatcttggttgctcattatcttctttatcttttggtggttctagtaagttgatattctttctttcaacttgttgagcctcctagttgtagaaagcatcttcatcaaactttacgtctcgactgatgattaacttctttgttcttaagctatagactcgatagccttttgattgggtgctatagcctaagaagattcctttttccgctttctcatccaacttgcctcttttttctttcggaatgtgggtgtagcaaatgaaaccaaaaactctaagatgttttgctgatggcttttgtccactccaagcttcgactggtgtcttgtcttgaacgactctgcttggacatctattaagaagatagactgctctacttactgcctctgtccaaaaagattttggaagacctttctccattagcatagatcttgttgcctccattactgttctattcgttctttctagcaaaccattttgttctggtgcatatccaactttaagttgatgctccatgccttcatattcgcagaacttgttgaattcaatagaggtgtattccttacctctgttgtaacaccccgtatgcatccggtgtattaacaattacttaatcagatttgaacaataactaatttaattaaaaaccacggaagcgatttcaaaaccatatttattgattcattatgtatggtacgtaacctcaaataaatgtgcgaataacaatacactatagccagcctcatcgatccaaaataacataaagaacggcatatgcatcaataatatctatacacatatatcaggagaataaaccacatgtatttacatatacatcatcaagacactcattatgtctataccaaagaataagcaccaagtgccacaatcttacagatcccatcctcaagtgagggtacaaaatacatcaaaaccaaaagaagtgagccacaatgctctcatcacattgccaagcaactgcacagagtctgtccctaccggggcctcccgccctgggacccatcatctctgccagatgtatcacttgcaaaataatccccacacacggggtgagatacaatctcggtaagctcaaggctcttggaggcttctcctcccccttggctcacttccatgatacacaacatcaaaggcatcacaatcattcggccatctgaccatcacaacaatacatagccatcctctagctctaatgtatatccgcggtactacgctcgccacaagatgcatcatcatcagcatctgggactctcagtccccagtgtgagaccggaactcacacccgtgccatcccatcgggagctacccctttacacatggatgcacatatatggcacctccgagaataggcttcaaccgcagtaggaccacctatctcttggtcttatgggatcatcagcaccctttacgtgagcaaaccaaactaggagttgcgctctacttctagggaggtccatatctatctaattggccagaagatctattcaatagataaccatacacacaaagcatagaatcatgcatacatattatcatgaggaaactgtaacaaccaattcaatgcacatgcatcatgtatgcaaccatcactccctcggaatatggtggaacacaggcaatgggaaacactccctaagagcaaagagcttacctggcaaagtagcgctctgcagttcaatcccagaatggtggtctacaccactgacaccctcggtgtcacgccctatacaaaggcacacaggcaaaatcaataatcaacctaaccttacaaggcattaagtacataacaacgattctcaaccgttaaaatgaaaagaaacatcattcatttccatttaaacctcttagtcctctatcttaaggttattagaactaaccaccttatagtcaactcacagaccctcagcagggtctatcttggcctaaccaaggcactagagtctcccaaagactctgcatcaaccaattcaaaggttcaacattactaaagcctgaaactcaaggattaacaacatggctaaaacggttactaccacataattcaccgtttatatagtctcctgagcacatattgtacaagcatcaaggctcatgcatgtcctatagtcaccaatttaaccaacattcttcctacacatacatttctcagagccaaaattcaaagtccatgaaatcaatatttcaaagctaatccttcatcataacaacctcctgagcatacttttctaaaggacccaagcctaattccagctctaactcaaatgggtcactattcatcccaagaacaatttcacaaatcaaacgagaaaacttgagtttcttacctctaaacagtcaaggaatgctagaggatcacttctccaagcatgggtgtctgtaaatcgtctcctttccccaccaaactcaagttttgtgaagtttcctagagaatgcgatctctccgtttgaagatttttagggaaaagtgatgaaggattctagctcataggatgatttcctacaagtttcatgttgggtggaaggtgtttagatgaagattggtgaagaaatggagcttccctagtgctctaatggcggaaaaggtcctgatgaagaaaaaggaagggttttggcccccaaaatcacgtaaaatgaccttatatagtggtccagtgaaaataggctttctggagtacttctggcgctaatcgcgccactctggcgctactgcgccaccctctcgtatgtttggcgctactagcgtcggcctcccttatgtctagtgctactcgcgccagacccctttttttccaagggttattatatctgtcactacttatcttcattatgctgtagccactttgcctttagacccgagttttgaatttcttgaaaatattgaagacttacgatttttctcgtaaaacataaacccaagtcattctagtgtagtcatcaatgaagagaatgaagtacctattttggttatttgatggagtacacattgggccacaaacatctgtatggactagctacaacggttctttggctcgccctgaatttcttgatggaaaaggttgttggtgttgtttcccgagcatgcacccctcacaaatgtcggtgtgctccattattggtggtagatctctcatcatatttttctgttgaagaattttcaatccttgtacattgaaatgcctgaatcttctgtgcaatagccacgactcatccacttgcaccttcattgctgcatcacttgcatatctccattgtattggaaaacaacgattctctttcattttgatttttgcaattaagagagatttatcttgcttatcataaattttgcaagaatctccctcaaaatgcaaggattagcctttttccatcatttggccgatgctcaataaattttgatataggttagggaccaagagtacatcgttgatgtatcttttcccctttttggtttcaatggcaatagtgcctcttcccgttgcctccataaaatctccattgccaatttttatttttgtcttgattttatcaagactacataaaatattttcatccttcgtcttgtgattactatagccactatccaaataccatgtatcctttatttcttttgatgtatcttgggagacatagaagagaacattctctgactcttgttcttcagagaaattaattttatgatttagttttaagcgacaaacctttcctacatgtccgaacttcttacaatttcggcactatggttttcctttaaaccaacagtctttctccaagtgactatttcttttacgaatgccacgtggaggaaactttccacctctttctttatgtttttcttgattctcattgtttctagaattttcatttgactttctcccactatctttaaattttctatactgctttcaaatcgcctttctaatcttttttcatgagcctctaaagaacccattaattctggagttgttaatttatctatatattttgactcttcgatagctgcaataatgggatagtatttttctgtgcatgtaattaaaatttttccaacaactttattttgtggaatattatctccatagactcttaattgatttactacttcttcaattctagaataataatccctagcaatcttagaatcattcatttttaaattctcaaacttccttcttaaagtttggagattacaagtgtgtaccttttgatatccttgaaactcctcctgcaacttatcccatgctgcttaggttgagttgaagagcgagcaatgctagagaatctttttgttcagtctccttgaattcctttctcagtgctgcagatagagtggagatatcttcaggactagtatatcccttagtaacgatattccacaaatcttgagcacgaaaataagtcttcattttgatgacctaaaaatcatagttttcaccatgaaaggttgggattggaatggatgagcggaagttatctgccatagtagcagattaatagaagaatgccttatattaatcgaacaaagctctgatgccactgatggtagttgttagaaaattggttgaatgtgttttgctttgaaggataggatggatagaatgtatgataagtgagatagtaattaatgagaatattgggtaagtttagaaaggtgggaacttagtttacaagagaactagtgtttttatttttgcttgcttgcttgctcacttttcttgcttacataaactacaaggctttgtgggtatttataggagtctccacctccttaatatgtggtctacatttgtttatctagaaagctctattctaagttattctacaactcctaagtctttctagaataatctacataagtacatttttttttcaatgtctctagattattctcttaatatcttcaagcttccataagtttccagaagcttctataagcgtccataagtttctagaaggttccataagcttccataagtttctagagcattctagaaatgtgcagcattttctaatacaagtagatgtagagggagcttagtttcctagagtttaattagtattgtttttatgatttttttaagctcctgaaaccaaaaacaaattaagcaagttaagttcacccaaaaaaagtatgcaatttaggtcatagataaaaattaatgattattattctaccttatggttctttatatatggagagcgccaaagcattaatcgatacactttatggaaagattatgagcttcaagtttagctagtatattaggtacattgtgctttttcttctcacacacctctttgatgagaacatcttttcctgatatgcttgctccaactttgggatatatcttggtaggtttatcatcaaaggtacatgaaacatcataagaaaatattggttttttttttttttggagcaaaccaaactaaaatttttaatgcaaactaggaaaaatttgtcatggaacgaagtatgactgaaatcaaacaaaatttgttaatgcaaaaagtaaatatagtaacttacaaaatcatttctaaaaaatttctcatattttccttagattaattccaatgttttcttggcaaaatatcgtaattatcatcttactcttctataataaactgttgcgactacatgttccatgacaatcgtttaccaagccacccgatttttgccaagaataaagaattctttgatatattgattatctcctcaactttttgttagttgataaattatatggtattatttcttcttgttagacgaggcaaatgacgattcaaatattttacctagaaaatgtggaaaacctaaggaaaaaatgagaaggttgatagaaatgattatgtgggcaaaaaataataaataatataaattaattatttaattagcaaaaaggggtgaatgaggcaatatttaggcatctagggcaccctaacacgccctgcctaggcgtgtttaaacacgccctggctaggcgtgttagggtcccttgatgcctatatattgcccattaaaattagtttgtacaattgcgccttctctctataattagtctgtcttctcactagaaagtgatttttctgaagcgaagccctgccgaattcgaagtgcggttgacaagtaattagggttctgtgtagaagttgttgtgcgttaggatctacagcttgggataggatattttgtgaacattagcgttggaaagaagtaagttctaaaccctaaacaatgttgcatattatttaaagttgttagcgacatagctgttaggttcatagtgtctatgtttacgtcttagggtttaggtttagtgttgaaattgtcattagggtttatagggtgattaatgtttaagtgtttcgggttagggtttagggtttctggggtgaatagggattatgtcttgatggacacacgtagggtttatggcgcatgtgtggattaaggggttaggtacgggggtacacacctagggttacacacctagggtttaagtgttacggtgtaagggtttaagggcatgtgtggattagggttaagggccggtgtacacacctagggtttagggtaggcggcttaagtgtttagggtttatggtgtgatttggggttaggtcagggggtcagggggaacacacctagggttgagggtatctgtggtagggtttaaggcgtatgtggtggttagggtgtatggcttggcgtgactggacttagggtgtatggcttggcttgaccggacctagggtgtatggcttggcgtgactggacctagggtttacattgttgtgtaaacaagactacttctttatgctttgtgtctttgacaatattgactttctttcaccatttggtgatttacttgtgagtaactacatctgtagaagtgtttatgtgggttagggtttgtttagtatgtagggtttgtgtttcataatttagggtttcgggtgtttgtgtgcttctgatgtttatttatgttgattgcaggatgagttcaagtgatgcggaggttgttcgtgttgtgtttttttttcaatggaaggaaaattgaagggggaaaaggtgttgtctttgaaggggaaaaaaggatgacacaaatcaaccgaaatgcaacattgactgatttgcatcagaagatacgtccaaaattgggtgtggatggaaacacttgtatcacattactgacggcaagaatatggcagcaagatgaatacatggggtttccaatacaggatgatgaagaattggaaatggtcattgaagaattttttaatcagtcacggaagaaatttttagagttgtatgtggattacaccgtagttgacgaagctgttttacccaggaggtcagttggttgtaattctgcgcatattgcaccatcatatgatgttgtaggtgcaaacatgtctcaggaagattcacatgacccaacttgggttatggatgacgatgaagaagatgatgatgatgaaaatatagcgatggaagatcgtcttcttcaggagaatgccagtgcgtccgataatgatgaagatgctggtgtggatgcgaatgcattccagcaacacactgatgtggggtcgtctgaaatgcggtaccgtgcgggtgttggaccgacacaatcagaacaaccagttaaggtaatttatatgacttaaaccctatgtgatttcgtataattgttgttcatgtatatattttgcaaacccatgcttattaatgtgtgttgtatttaaaggcgatgcgattcttcctttttgggatgggattccacattacacatatatcgattggaatcacccaagcgaagaagattcttattcttttggtggttcagcttcaggatcgggttcagtccaaggtccctggcaaataggggatgatttgtttgttgaacaggaattcccttcgaaaaaggaggcacaaattgcagttaagcgaaacctaatgagggaacatcaagaagcagttgtggttgagagcaagcctgacaagtttgccatgaagtgtgttgctcacaaggatggttgcccttggagggttagggtgtataaaccaatatacggtgagaagtgggtggtttcaagatggggtggaaaacacaattgcctcaacgactgtatatcacaggatcatagacaacttgatgttcatatcattgcttcacttgtagcaggtatgaactcagaatttgcgcttttttgaaaaatattaaattgtgttaacgttaatggtaaatgtgtatgttacaatgtcattttcaggaatgttaaggaggaaccaggtgtgtcaattgcattggttcaggagaggatcaccaacagcttcagatttaaagtttcctattgtaaggcatggtatgcgaagcagagagcgatggcaatgatttatggagattgggaagaatcttatgtgtttttgccgaggtggtgcaactacatgcttcggttttcaccaggttctttttttgatattcaaaccaatgattattttgaggcacatcgactggtcagagggaagcgtgtgtttcagtgaatgttttggacttttagacagtgttgcgaggcttttaagtattgcaaacccgtcattcaaattgatgggactcacttatatggcaagtataaaggaaaattgttgatcgccacgagtcaggatgggaataatgaatgcctgccattggcatttgccattgttgagggggagacgttggaagcttgggaatatttccttgctaacattcgtttccacgtaacccaaatgcaaaatatatgcctcatttcagatcggcatcgtagcattatatctgcaatgcagaaccatgccggttggcaaccaccttttgcgcatcacgtattctgtcttcgtcatattgccagtaatttcaatcaaagattcaagagtgcaagattgaagaagagcctcatgactttgggtatgttcagaattatgtgtaatatagttagattacaaatgtcttaccagctaacgttaatggtattataattgtgcaggttatactccatgtgtggctgaatttgacatagcgtatgaacgattccgctataccagtcctgaggttgcagaatggattgatagcattcctaaggaaaagtggactcgtgcatatgatgtcgaggggagaagatatggccatatgacaacaaatttgtctgaatcagtcaacaaggtgttcaagggagcaaggaacatgcctattactgctttggtgaagcacacatacagtcgattggttgaatactttgtgagaaggggtcagacggcgaccgcacagctgcagcaatcacaacgacattgtaaaaatgtcgttgatgcattgaggcataatcagaacattgctacaggccacaatgtacgcacctataaccttcaggaaacgtcgtttgaggtggccgatggctgggacaggttatattcagtaaacctaactgaccgtttttgtcagtgtgggaggtttaaggccttcaaatacccttgtagccatgccgcagctgctgctttatacatccgtcagaatcctttgcaatatgtggatgatgtctttctcgtaaccaacttggttgaggcttattcattaccttggcagcctattggtgatgaacttgccattccccccagtgaagatccagttatcattcctgacagggcaatgttgcgggcgaaaggtcgtccaaggtccaccagaatctgtaatgagatggacgaagtcgaaacaactcagagagctcgtagatgcgatctgtgcaagcaagttggacatactcgtacagcttgtcctactcggggtggtgtttcttgattctgttattatgtttgcttgataagtgcgtggtgaaatgtatttgattttaaaaaataagcgtaacatgtatgacgataatgttttcgttgtggtgcacatcaatgacgataaaaaatgtcgcgtaaaaatgttgttaatgctctggtgacacatgatttattttgttacaatattattagttaattatgtacattatgagctatattttcgttagttagttacgtactatatgacctaggtttaggtgacatagttggtgacctaggttttatgaccgtaaagatgttgttaagttgttcaatccttaagccctaaagatgttgttaactggtgcaatccataaaccctaaacggctatacaagcagagcgtgtctttacaaatgagcattttttgtgtcactagacaatacacatgcatttattaacatacctaactgaagacccctaccaagggcatgattgaacatgcccaacgaggaagtctttgaacacgcgtaaatacagcgtaactaaatacgcctatgaaatagttaggtgtgactagacacgcccaacttggccgcgattacccctatataagcaacaccgtcggacacaacaagcatcagacgacacgggtgtttcattttgcataccatggcattcttaggagaaacaagcagccaaagcattggtaactccaaattagcatttgtttatcccaatggatctatgaagcacaacgacacgggtgtttgttttcagggtgccagtccaatagcgatgcgagttcctaatgagtgttcatttcagacacttcagagtaggattcaccacacccttctactaaccgatgaccatttcgtggataacatctactatcgacaaccatctctagacgcaggtcagcactatgtttttcattctatcgcactaacaaacgatgatgatgtttgcagaatgttaaggtgtcacgaccaaatgtcgactgctggtcctatagaaatgttatgcaccataaacagaacagccgatgggataatcaacctacttcagtcgaccatcgtccccacgcacgttgcaatgttatattacaacggaagttggaacataccacgaagacgcgattctgtgggttatgcctttactggaaccaacccaatccgatttgaaattccttctgcatgcactattgaaacactgaaggtcgtcatcaagcaagttgcgcctgttggggttccccctaatggaattcacatgtcacaggtggtaagaaaaatgtttttccggcgtccagcacatgcacaatactcagacaccacaatccagtatgacataaaggagttggtaagcgatgaagacgtgttaaggatgctagcgggatccaactactggaaacgtcttggtccaattgaaattttagccatatttagccaaccacaaatcgatatggaataagacatgtacgctgaatatgttgttttcaaattatccttataattaaaaatgcattttcgccccatttttaaaaattgtaatcgtgtctgttatgaatttatggttttcacggcgtatattattgttagggtttgcggggttaacgtgatcaactaatcattagaccgagcggcgtaaacataaatgtcacaaataaccatagtttacaaaatacaatcgattacaatacacaaacaaatataaaacagtaattgcgaataaatcagagtgagggcggtggccacggcaaatgacgtgcctgccgatcaggttgtactcgtcttcgtggtcgccgagaactacctggctcggacggggctggctgtgaaggtcgtggctgagaagggcctgcctgatacgggtctggatgggattggcctgcataagaagggcctgcctgataagggtccagctgagacgggtctgcataagaagggcatgcctgataagggtccggctgggacgggtctgcatacgaagggcctgcctcatacgaatgcacatgaggagatcgacatggtgtgccctgctctgcatacaccggcataggaaactcagaagcttcggtgccatatggtgaatgtggctgccaagcggcacaggcttctacactataatccatctggtcgagcatgtcgtcgaactgtgcctcagtccactcgggctgcatgttcattccacaaccgacgaaccgccatctacatctgcacatgtcattgctgtcgtaacatatgcggcatgggtctgcgatgggcctggggtaggcatttgggcttgggtactgaaatcggcgtagtccatgcccccatgccccccatgcgcagtagcctcgtaatatacgggctgtgtcccatatgtcaatgcaataatagggggcctatagatcccctcagtgcgcggcctcggtcgaacaatgggctcaggaacctgctgcactggtctccgccaacgctctagcccacgaccctattttcttcgccggccaactgcaactgaaatctatggttcggcctcaagctgggattcgggagcatgtgggcctgcttcctccacgtgacagctctcggcgaagacagacattaagcgactgacctcgtcattcgcccaaataaagtcgaaggcctctctatcggggctagttgtcgcgaagtacaacgcctccagcccatcaagctacgattttaaagatatacaaaaaaatgtcaggtgtgtgatgtacgataatcatatcttctccccagctatatcgaccgatgtccgaaaaatcccctgcaagcaacgacatgtatcatgctgcgaccatgctacctccagatcggttgcacagcagccatgctctgataagtcgtgcaatgtgggccttcgtgaaccgcgtcacgtgaacaagttcgggaacaacctcaccccaatgtgcaaaatgtctatccaagaaagacaggcgcaaatatccacctatcagctcggtgtcctcaggttcgtgaccaaacacctcatcaataacgatggatgagagtggtgagttcggccacaatggtggggttccaatagaaccatggagcttttctattctagtgtattgttgcacaaagatcgaaggaaagaatttagtagtgagacctgttaacaacctaaataaaaattaaaaaaaaataagctgaggtaaggtgaggggattgcaggtactacttacggggaggtgacgggagagaagtgagggtactcgatcctctagaggtcacaaccgctgcatcagtacagttatgagatccacatgatttattaattcattggcaacgattacccagtctcccttcgttacatgctttgggaagggaatcagtatgcagatgcactgaccatgtttggtgctgggattataggtttcactggtggtggttcttaggcaacctaagtttcttttcctatcccttcgagcggatgtagagggagttcggtttcctagagtttaattagtcttgtttttttttatcgttttttagctcctgaaaccaaaaacaaaataagcaagttaagttcaccagcaaaagaacctaaatggtgtttttttcaaaatatttaccgataaggggctgtttcacaaatatttacaaaaatggggctgtgtaacatgcctggattagccatgttacaacacgcctagattgggcttgttataacatgcctggattaggcatgttataacaatcccaattctataaataaggtcccccccaccatttcctcactttccactatctctctagaagtgctctgccttctctctagagtttttggtggatattctgtgcagcgaagctctgctgaatttcgaagttgttcagaaaaaatcttgcgaacaagtaagcgctctgctctgccttttagttatgttgttcttaattagttatttatattgttaatgatgcatgtacttatttttagcacaatagatgttaggttacttgataattgttttagtttaggctttaagatatatttattagaaaaatgttaggatgatgttaatttgttagtgacataaatttaggtgggtagaaaattctttaggtgtttggtactgtgcttttggctaaaatgattagaatttaaaatttagggttttctgggcatggttaggtagtgtttatggtttgatgatgtgatattcgtttgtggttaatggtttggttggtgggcatggttacttgacgtttggattagggttggggtattgttgggtttcatggtcatgtgacgagggtgtgcggtttatggtttggttggccttgtatggtatagggtttagggtttagggtttagtgtttggttggccacgtatgtgacgtttagtccagggttgagtttagggttggtgtcatggttctggttgcatggattagggtttggttcagggttcggggtgcggtcattagggtttatggttgtaggctgaacgtggtctagtgtttagaaatttgttgttttaatgatttgtgaatttggaataattgttaacatgggtttttatttgtggtgtatgaagttactgataatatggccgatttatctggatctgattcgccgcactctgtatctgatcatgaggctgagccgatggatccgacatcttatgtggttcctaccccgtacagatggggcgctctgcgtaggcgtacgcagcgcgcccatgtttcacaatctgtgtggaacgagggcacagtacgactactaaagactcgacgtggcaaggcgtcggggggaccagcatatgatgacattcctcaagttgtttctgatatgctgcgggacgctggctttcttcatgtagcacgtatgcgacatattcaggtatgggacatgtcatagtagtaatcaaattttatttaaccataactatagttgtcaattgattcatgatattgttttagattgatgctgccctgattagtgctctggttgagcgatgaaggccagagacccatatgttccacatgccacagggcgagatgactatcacactacaagatgtggctggtattttgggattgcccacgtctggcaatgtcgtcatcggagtgactttgtccgattgggcagaggtgattgaggacgttttcggtcaagaacttgatgacgaaacagagctgaccggtggatacctacggctgacttacttcgataggcattttggggattgggatgagttggacaaagattttgtcaatgtcacgcggtttgcaaaggcgcacattgcccaccttattggttcatggctgctgagcgatcgatctggaggtagcttgatggcagcacgctatatccctttgttggctggggatttcccagagattggaggatacagctgggcatctgccgtccttgcacatttgtttagacagatgtgcgagtgtatagatgcatccagaaaggacattggtggatgccatatgttgcttcagccatgggcgtggctgagattcccaccaattgctccatgtattccgcagcctagtgacccaccagcgcattttggccaccggtatgtgtgactacatgttcattttataacaactgaaacaattaagccgtacattgtttaatgttagttgttttgttaacaggtttaaccgactaccccggcttacctcgcacgagctggtgtactacaggacggccttcgaatccctggatcgggacgacatatgtatagtgatagtttagtaattgcatgttagcattagttgtttatgtcataacataaaagaacctaaatttttttttatgcaggtggtctgggaaccatatggagattaccctttcgttggtgcatctgaccatgattgattgttgtggatggcatcgacgcctattatatgtttccacacagttgaagctgtccagcccgatagatgcatgcgtcaatttgggagggatcagccaatcccacgtcctgccatgaagctgaagggtgtgcacaacttttcacttcgtggaaaacgagaagaaaactgggtgcgtaagctcaggccatttctgaatcgctggcagcaaagggagcagcacatcgaccttcccccccaatccagggccaaatgtcaccaaaccatgagtacatggtatggtacagagaaaatgggaagcggtttaacacaaaggagggtgcgaagatgggtcgtagtgtaagtttcgttttcattaataattattttagttacattaattatcataattgacatagttgacagtgatgtttatatatttgaatttcaatttataggtcgatgggatagagatgctatacttcgccacgcataggcagaatagggcgacgttcgactttgattgggcgcatcaggagttgggtcgcttaatgtctgtattcagacaaagttgtcatgtggtggagtctgaaccagaagccccagagacgcagcttgaggaggagccgcaattgtctcttcaagttggtcggcacagaagggagggacgtggtctggagcgtcgacggagacctattcaacaggtgcctgagcccattgttggtcccgggcctgccactgctggtacttttaggccttcagatgtgtcgtcgacatatgggagtcaggtgttctatcatgatggtactgagcatagtgcctcctactattctgcggatgtgcctacaccggcggacgcatacggtgcagatgtcgactttggggatgtgcccgctggttggatgcatacgaatgtggaacagatgctcatggattttgatatgaccactacaggctgtgggagttgggcatccgatgccatatgttccccaatctgctgagcatgctatgccagtatatgcaaagcatggcactccatgtccaactccgtatgtcccatcgtatgacacaggattttctgaggctgacatgtatcagccagatccttatcaggtaggcccatctcagctagaccccgtagaggcaagcaattcacaacgacctcgaagacggaggcaacctgataggcaagcgcgtcggcaacagtggccaccaccatcttagttttagttgattgcttgtagcattcgtttgtaacacttattttaatgttgtgtattgtaactattatgtatgttacatttgtttgtgttatttatttttcagtgtacgtattagttagcttataattgtcgtggaatgcacgaattcaacacaaaccatctaacacctcacacctcagcccgatttagtattattcaggttgattgtatctgtcatcatcacaggcgtttggcaaggaagcaaagtgaacagagacaaccaaagaaaattgcagctaaggaagtgcttgccaaggcaaaacttgaatgggaaaactaattactcaatattagtgaagtttatgcaaagccttacccctaagtctgtaaccgaagacgttaaccctaagcacagtatcatgccttaacactaaacaggaatcgataaaccctacacagaacgttcatttgtaataagaacaataatgtaaaacaacatattcagtgcacatttctcattccatctgcatgtccggtttgctaaaaatggctaaaatttcaataggaccaaaacgtttccagtagttcgattctgctatgatcttcaacacgtcttcgtcgcttgtcaactcttttatctgatattcgattgtggtgggcgaatattgtgcatggcgtggctgttggaaaaacaattttctcaccaactgtgacatatgaatcccattagggggaaatccaaccggcgcaacttccttgatgacagccttcagtctttccatggtgcatgcagaaggaatttgaaatcgtattggatttgttccagtaaaggcataacccacagaaccggctcttcggggtggttgccaaccaggatgactttgaacagcagatatgatgttccggtggcgatccgaaatgaggcatatattttgcatgcgagtaacgtggaagcgaatgttagaaaggaagtaattccaagcttccaacgtctccccctcaacaacggcaaatgccaaaggaacacattcattattcccatcctgagttgtggcgaccaacaattttcctttatactttccatataaatgagtgccatcaacttgaatgatgggtttgcaatggttaaatgcctcacaacactgtccaaatgtccaaaaatgcgatgaaacacgcgctttgcccgtaccagtcgatttgcaacgaagtaatcattcgtctgaatatcaaaataagaacctggtgcaaaacgaagcatgtagttacaccacctgggtaagaatgcataagattctacccagtccccataaaccattgtcattgctttctgcttcgtataccaggcctttcgataagaaacttgaaatccgaatgtgttggtaatccgctcctgaaccaatgagattgacactaatgattcctccttaatcattcctaaaaaaaaaattgaacaatcacatcaacaacatgctttgaaaacaaatatgtctttgaaatgcatcatagtaaataaaaacataccaacaaccagtgaggcaattacgtcggcatcaagctgtctgtgaccctgtgaaacatgatcattcaagcaattatgttttccaccccattttgaaacaagccaattctcacggaaaactggtttaataaccctaaccctccaagggcaaccatcagtatgcgcaacacacttcatggaaaacttgtcagacttgctctcaaccacaattgcttcttgatgctccttcatcaagttatgcttcactgctaattgtgcttcccttttcgagtcaaattcttgtttcacaaacaaatcatcccctagttgccacggaccctgcactgatcctgaacccgaaccagaaccagaaccgctaaaagagtcttgttcgggtgggtaactccaatcaatatatgtataatgaggaattccttgccaaaacggaatcgcctcagcagctgcacattgaacgtcagttaaagtaaccatatcagctaaaaacaattagacaaccctaacccgtcaccaaaatacccaaaccctaaaccccaatcaaaccctaaacctcaacagcaacccataaaccccaaccaaaccctaaacctaacacaacgcactaaaccccaaccaaaccatctaaacccttcacactttcggttaaacaggatacacttatttaacctaacaaaataacatcatttcatggacattaaaaagcatattaataaacaatataaaacaaattaaatgacaaaacattctaaatcacatcgttagctaatttaccttgttctggttgactcgaagcaccctccacatgatgacgagtttcagatggcccgacattaacatcttcctgatgtacaccagcatcctcatcctcatccgacgcactagcatcctcctcgagaaggcgatcttccattgcgatattttcatcatcgtcatcctcttcatcctcatccatgacccaagtcggatcatgtgaatcctcctgagacacgtttacctctccgccaacaaatggtgcccctccagcagcatatgatgatgtacgatgtggaactgcctggatgggtaaagcaacatcctcaacttctgtaatatccacgtacaactccaaaaaatctttccttccctggttgcaaaattcttctagtaccaactccacgtcttcatcatccattatttgaaaccccatgaacttcttgtgttgccataatcttccagtcaataaagtgattgactggttgatactcagacgtaatttttgccgtatcttttcatgcaattcactcagggttgacgtacgtcgcacagaggttcctcgtgtttccccttcgaaaatcacaccctgttggccttgatattttcttccattccaatataagacaacgcgaacaggattaccacctgaactcatgtttcttgtcactgacaacaccttcaaaaatctatgaaaaaatgaaaaaacaccagaatgatggagtttagtagaggcagagaacactggaagccaatatatgaaggaactggagggggggcttatttatagaattggggttgctgtaacatgcctggattaggcatgttacaacacgcctagattaggcgtgttgtaacatgcctaatccaagcatgttacacagccccagttttgtaaatacttcatgtcacacagccccatttctgtaaatatttgtgaaacagccccttattggtaaatattttgaaaaaaaacaccatttgggttcttttgcctaagttcacccaaaaaaaagtaaccaatttaagtcagtgataaaaaataatgattattattctaccttatccctgattatatgcatgtttatggagagcgccaaagcattaattagtagtgaagcaaagagatgtttcttagagtttaattagtcttgtttttctgttttttttttttatcagctcttgtaaccaaaaacaaagtaagcaacttcagtcattgataaaaaaaataatgattattattctaccttatccttgattatatgcatgtttatggagagtgccaaagcattatttgcaacactttatggagaggttatgaggttcaagcttggccaatagctttagtacattttgcttttgcttctgacacacctctttaatgagaacatattttccttatttgcttgcttcaactttgggatatatcatggtaggtttatcctcacaaatccatgaaaggtcctaagaaacgatattggtttggtttattttagagcaaaatcaaactaaaattgttaatgcaaattaggaaaaatatgtcaaaagaagtatgacttatatcaaacaaaaattgttaatgcaaaaaggaaataaagtaacttacatagaatctgtttggatgcaatccaaaagatcttctaacatcttatctattagaaaaaagtcttctttattttttaagagtgtttgattattaattttttatagcttttacaaaagtaagaactctcaagagacatgtttaaaagttcaaattctcagcttatgtaatggttactattcggaaattcgttccctaaattatgcttggacaaaaatgttatcaaaaattttcaaaatgacaaagcatgtcctacacattttctaaacccttagcacttgatttctctctcttgctcctcagaagttatgcatcttcctcgctcttctgttcctcaatctcttctgttttgcaatttctcttcagatcatccttcttcatctcttcttctttgtttgttagcatcacaggttaacaatttattcattaattgttttttcttctcgtgaaactttgaattattatggattagggttatgctttttttttttcattgtttcaatttcttaagcttgtgaaatgtctctcaatcaagttcatgtgaaaagaaagaaagcataatggtggataaaaatattgagattatgttgaaaatgtgcatagaagaggtgaatgctggaaataaacctcacaaccacttcactaagcttggttgggcaaatgttttagaaaagttcaataaggaaacaaatttgacatatgaatataaacaatttagaaataggtgagattttttaaaaaatgaatgacaattatgggctaagtttattgggaaggacacttgtcttggctaggatggatagaagaaaatcattgctgctagtgatgaatggtgggaagccaaaattcaggtgtgtactattcaactaaaataaaattagtgctagttgtacaattggtcattacatcccttgatctagctgcaaagtttatagagtagattatgctactgttgttgggggtttgtgttatgaaaaggactttctgttgttgatggtgatagtactttctggtgttgttgttctgaaaatgactttctgaaaatgactgatctgaatctatagttatttctttatgaaattatatttttagcacctttagaaaatggcaggtgtgtcttagaaccttggaccagttttgttgtttatcaattcccattctttgttttcattgaatatattttaaatctgtcacttggttttcatcgaggatgtaggcttagtaggtatctaaattctacatcactaatgtacaaacatgtattggttctggcttatgaaagggaacgcatattgtgggttttgttctcattttttgccaaattaaagtctgattttttcttatgatacgtgattgttttgtactgaagttctgatacatatgtgtactgaggtgttcaatttcatcctatggtgggtgggtagtagttggtaactctgggtgttgatgtgtaatatagagattttaggtttcaggaattgtttatgataggtggttttattgaggttttggttatgaatgtaaaagaaacatgttctgtactctgttaagggaaattgagggtggtggttccatttggtcaatatgatgttcagcttataaatttgttgatggcttgttaatttgcatatttattgttgtggtaacacttgtttgtgagtcttggtttttagtttatggttgttaatttgttaaggaagaatcagaagatcatttacaaaatgagtcacagggtgcaagtaatattcaatttcattttggtttgatgatcacaggtccgaagctgatagttacataacatgttaagggaaaaatggataacaatgctcaacagttctgttaaacgagtatataagaaacattgtgaactatttgcatctacaaacattgttgtcttggtgtcattaaaaattagtaattctttctttctgcatgacttaagtgattcagattctcatcctattttattgacccaatcattttcccaaaccaaaaccaccctccactcgcatactccaaattctgaaatataagaatttaattatttcaaccatatttcaaattagtttagaagagatttctaattcacacaaacccttatttcaaatattgttaaccataacatgtgtatccttcccttagtaagaggttcggtcacagacttcgacctcaagttctctctcagttttgattggcgatacgtatgaaatcacacataaatctgtcaagcatggcttcaaaggcaaaatcatcaagaataacaccatgtttatttttattcattgcattaggacgcatgattttgagtttggtaccatggacccatctttcaaaatgatccacctgagcaatcataatttgataagaacataaaacactaatatagaatagataaaacgatatatatgcataaaagtaaatgaaaggaaagaaatgtgatacctcagacatcagttttttacaaaattgcggttgaagcatttccttgaggatctacactttgctgctatgcagttctgtcttatcttctttaagtgtcattttgtttttggacagagcatatatgaattaatagcagtagttgttcatgtttgaaagcactaatttgtttaattagaacatatatgaattataattagaacatatatttgaaaacactaactgctttcaatatttctatatcgcaacattcatatcttaagtttttgttcttattagttactgaatttgtttcaatatgttttataataatacatcaatgtgctggagcaatcaatagtagaatagcacagctgcgactatagtgtatggcattggcatatcataatatatgtgtatgattgttggcacttggctttggctagtaatgagtaaacatcaaacatcaaacatgcgtgcgtgtcccatgaccttctatatatctacgtacaccttctatatatatatatatatatatatatatatatatatatatatatatatatatatatatatatatatacatatatatatatatgtaaaaccaaaaactaactcattttttatgttggaaagtctacggtgttcctcaaattctgatccaatgccttgacaagagctattattctctttaattgcatttatttataattacttgttaagaagcataagttaagaaaaatgttcgtcattcacactttacacactctttttaatatattatttttaattatgaggtgaattttatgtgagcattatcacttaaaaaatctagatcagttattttatttaataaggcacacataaatcgattcaacagtaataatttaataaagagttaaaaaaaacattgctacaaattgtgatggatttttcttatatgtttatagaaaaatagtttttcttccccaaatatgccacttggaatctagatgcttggatatatctacccctcgcagcaaataccaaacctatgaattaaattattggttgacatattgagggagagaaattcctcctgtaacataaaataacttctcatggaataataaactgcggaagtctgaccaaactatttgtaggatcatgtttgctaatggtgtgagttttaattagatttgtttagctagctgttacttaccagcatgtcatgcaattgaaagtgacggatacagcatatcggtctcccatgacgtcagtgacaagagaaggcttttcactctgccaacttcacaaagcctctcaagtttctctattgccaccttgtatagattagtataacaatcaatagtaagcaaaagagagagaagactaataataattatcccttgcttcttctcggttgtgctagcttctatcagatttcaatgtctcatctccctatttgtatgtgaatatgtacatcttagaagttccaagaatatgcatacgtggcacctccccaaattttagtgaaccttgttcttttggcaaaaacaaaaagaaaagggagggaatctaaacccatattctgttatttctattccatagtattacatcgatcatgttcatctcttcttttgtttgtagtatgtgatccaaaactccaatacatcatgtacatatcgaaattattatgcatcagttagttaactttattatcactaactaaatcttcttctaatatgaattagttagagaaattttcaatttttaactttattatcactctttactcttattgtttgtttcaatttttatctttttgttcccatgcccaaatatatatgataattcttattttttgattttataagaggatcctggagtagtaaagtttaaggagcaaaagacctcaaattcttacctgagatgaaatttctctttaaaggtactattgctattagttttgcagcatatgtaccatatgaagattcaagacaaaatgaaggattcaacatacgaacaaaaaagacaaatgataactataataaccaagttttctaaaaaaaaaaaaattaaaattactgtagctgtcactgtagctggcgctgatagcgtgggatctagtgctgatagcgtgggatctagtgctgatagcatagcactgtagctgaaggctatttttcatgatttttggcgcgattagcgccaggaacggcgccgtaagcgccagaatttgatctgtggcgcgattagcgtcagagatggcgccgatagcgccataagtgctctggaaaacactttttctctggattttggcgcgatcagtgccagaactggcgcggttagcgccagaagtgctccagaaagtatatttcctctggaaactggcgcgatcagcgccagaagtggcgcgattagcgccagagcacgtctgggtcagtataaatggccaaatcgcgtttttcaaaaggaaaaaccttcttttcttcttccccagctccattctgccattgttgaagctcccaagcttcatgaacccttgtttcttgaccaaaacacttcctttaacctctaatcttgaggaaaaacatgttgggagcttaaatccttcatcaaaaacccctaaaaagctttgattagagaaatccctttctcaagggaaatctgtaaaactcgagttcggcgagggacgacgtcaattcacggacacccgagcttgggagagtcattcctgagctttccttgtcattattgaggtaagaaaagtgtgtttagaacgttgtggtgatgaaggattagctttcaaatgttagtttggtgaactttgattatgggctctgagacattcatgtgtggctagtgtgtgttgagtcactggatatgttatgtcatgcaagagccttgataatggttttgatgtgcctgagaggccatgtgagcggtgttttgtgggtgaaatggaccgttcaagcctatgtgacttcttgagtcattggactgtatagagctttgagctctatgtgtttggcttgcattgagtctgtgatgactctaatggcttgataagttgagatagacgttgagggtctatgatatgctagtgactgataaaccttaagttagatgacttgaaggttatggagaggattagtgtttcctttcattgtaacggctgaagaccgttattgattgtttgtttgcatgtctggtgtaggacgtgagattttcactgttggtggtcgtgaccacgaagccgggagagccgatattgagctgagaacaggtaagctctttgcccttgggagtaattcccttgcttgtgttccaccatacccaagaagggtgatggttattgtatgacatgcatattgaaagttgtgttactgcttattgaaccatgtgattgatgaacactgtgatagtgttctgtgactgatgatgaactaaatattgtgatagtattgtatgatgtgattttatgagattctctggccagtagaatagggtactatggatccccttggaaatgtgcctttaagtggatgatcttccttgggaaaatccataggtgtccatataattcctgatagaatgtgcccatcatcggatgatctttctcaggtatgggcaggaaaagtcctgagagaatgtgcccttcaatggatgatctttctcaggcaatgtgttatggtttgactgaatagctgtgatgactaacttgtgataaaatctttgatattatgtgtgcatggaagtgaaccagggggaggaaatacctccaaggaccctgagtttgctgagattgtttatctcacccctattggggattatgttttgcaggtgaggctcagggagctgatgacagatctcagggcaagaggcccgcgtagagagagagatatggttctgaaggaaccttaggcatatagtgaagagcctgttggctctatattttgatattttgtctgtatgcctgtattttggcaactgatgagagaattgtatagttttgagaaaatatactttgtatattctaagatttcaccatatatgtatataatatacagattatgctgataatgacaattgatgacgtcattttgtctaaagcttccatttttatgatatatgatatttgctgcgctattctgatataataatatgttaataccttggatgcatacggggtgttacaataacattgataataacactgagattgaagtgaatgagcctgagatagacacgacaactcaaacaacatcttcgacaaaggaaagtggacagaggaagagagaaagagagggtgacaaaagaattggggttgctgccaagctttcctcacaattagatcgtgttattcaaacatttgaatctattgtatctggtaaacacccaacttgcattagtgcatgtgtagcaaagttgaaagatctaccgaaacttgagcgtaggagtggactattttacaaagccactagacttaggaaaaaaagggcaaacatgattacctttgttgctttagaagatcctgaactacagcttggctggatcaagtttgacactcgagcacaaattccttagtttcttctctatatgatatcattgacacttattagttttgcttagctatgaaccttggttatgtcatggatctttgtttttaatattggttatgctatggatcttggttatggtttggctcttgatttttattttaagttgtgtaatgactttttttttccttctacaggatttctttatcattatcatcaaatgactcatcattatcataaaatgactcttcatatgatgatgatgatcacattatgaagaaaaaagtgttgatgcttgttgtagctaatgttaccaattacttcatgaattatgttgtgaaaaatccatgtagagattcaagcatgacaaaccatcattgggcatctgaaattctaaatggtcatccaatacgttgttgtcagatgtttatgaagaaatttgtctttcttgaattatgtgatatcttggaaaccaagtacaacttaaagaaaacttgaaatgtcaaaatttagaaaccaagtacaacttaaagaaaacttgaaatgtcaaaatttatgagcaagttggcttgtttttatacattatgagttaaccaagttcgattcgtaattgtgaggaaagatttcagcattcaggtgaaacaatatctaaacatttccatattgtcttggaagctgtgtgtttgtttgcaaaggacataattaagccttttgatccatcatttagagatactcttgatgagattatgaaaggtgttagatattgcccttattttagggattgtattggtgcaatagatggtactcatctatgagtttgcgttctctctcatctacaaagagtctatattgatcggaaaggctacactaccactaatgtcaaggttgtttttgaatttagcatgtgtttcacatttgtttggacaggttggaaaggttctgcacatgatactaagatatttacggaggctttacgtaaatctgcattgtatttttcacatcctcctcaaggtacttaacatttatattatatatatatatatatatatcattaaaagtttgtattttaacatgtactattgttttattctttaggtaaatattatcttgttgattctggttaccttacttttatgggttttctagggtcatacaagaaaactaggtaccatctccagcaatttagaattgggcctagaatcaggggagagttgaagtttttaattattatcattatagtcttcgaattacaattgaacgtgcatttggtttgtgtaaagtgagatggaagatattgggtaatatgccaccttttgctttgaagacacaaaaccaaatcattgttgcttgcatgtctttacataacttcattcaaagaaatgataagagtgattgagaatttgattcactagatgaatataacgaatataaaaatagtgatgaggaaaataaaattgaccctagtactacaacatgggaagaaccaaatgctcaaagtactttacaaatgaaacgatataaagaatctctaaaaaatatgtttccaacacatttaatttctttgctttttaagaatacaaagtgcgatcaagggggtaggtggaaggatcgtagaagagttcaaagctattgaagatctcaacggtgtgacccttctggacccctatgacccaaccatagacccgagggggtagtggtggcgaaacgatgccattgttgtagttggcgttgttgttggtggtggtgtgcggtggcgtcaatcaattagttgacaagcaatgattttaggcacgcttttcagcacctttagctatagtacattcattatacgaaatcctaacacaggtaacaagaagagtagagtgataaattgggaggggcccttaatgcactggtagaacgatcatactatctatcatttagttatctgtgaataactgaaaatttatttggcctaatttcatgctacataagctttaaactaagctttacttgacatgactaactttcttaaaatgttgatcatacatttaataaaaaaaatccaatgcaatgaccttggtaatcaaaatagcaagtttacttcttagctaagagttgtagagattcctttctcacttctgacttattacagctagaagttgtgtctagctgttggttctatctgctttgatataaaaattcaccagtaccctgcatctaatataaaagttgacaaattcataatttttattttaaaccacgtaaagaaaaatatgcatatttgacaataaagaccaagagaaactcaaatagcatgatccagtggaggggcaacactaaattgaaagttcacatttcataataagacatgagaagagataccttgtagtaatttatctataagacattatttaccattcttattctggtgaaatacaagcagcaatggtccacaaagcaaacaccactattctggtgaaatacaagtatccaataacaacaatgtagaattgtctaaatagagtcattggatacttgaaatttgtctaattcacataaatgattatgccaatattcgataggcaccaagtttttccattatggacctaaaagtttaataacacaaggcaaaagagagtaaagatataaacaatttgcatgtggcaaacaatatatcgctcattatatgtcaaaagaagtaaattaactttaggtcctgtcccacatacaagtatatgcccaattatattaccttcatttacttcaattgatccatttcctttgcaccatggtttcctagcatgcaaaaggtaactgtcaatttcaattagcttcctctgggtgtaacactctattatccaaacctaatacccaaaaaaagaaaagaaaggataaatcatggaatatcatgtgagactatcatctgcaaaatattagaaaatgatacagctaagaatttgcatggcaggattagaatttccttaccaaaatgcttcaattaatacactaagtaaaaattcccttaacacaatcacctataatcttcaaacacaaacaatgtccaacaaccacaaaaaattaagggtgttacaccaattgacattgaattaaaagtggagctaaacgatcaaacccaggcttacaacgaaaatattccacgaacaaagaaaaatctctctgaaatttaagatgttaatgtattttcttgaccattaagataatagttttacttttaattttattagtctgtctatcaatatagtatatcttaactcttttataaacaatggaggtataaaaatgacacctagaaaaacatagaattaaatataagcagtgttttaaagaatatatagagaaatagcaatcacaatcgcattcatggaaacaaaacaaggaaagaggaaaacctttgacacaatggttccataatcagcttcaacttgtctaaacttaggggtatttggaaaggcacaaaccaagagagtgcaatcagagttccaatcaggcttatattatgctcgcatttccatagctcgtgacctcaacatgcccctctacggattcaccaaccttgaaagcacaaaaaccacctgttcatgtccacaaaccagttgctaaattaatgaactaaatttacattcaataacattgcaagcaaaaccaaaaacccacaagggcaccaaaattgttccttataaaccaagtacagaagcttgttgaagcttttagattacaaacttgaggtggaagattttccaccattttgattttggactttgcgcttgttgggtgtcttggcttcaccggatttctcacctttgccatccaaagttggtttctttgcattgttttcgctctcattttcccttgaactcgtccatgatggcaggctccacttggaaccattgttgttggcacttattccagtatcggacatggtaagaactactatgtggagggtgccaaagtaccaaatttgaaacctgcatttgggggtccaaatgaaattcgtaaattggtcaaaaacttcatgggtgaacaaagaagttctcaccaaaatcatggtgtctattgttgattcagatgaagtcaagcatcattgaagatcaaagtaaagagttttgtgctttcaacatgcaaaaggaagctttaagatgaagagttcaaattgatcatgtataagaaaatgtatgatctgataatccaatattgcataacatgcatcattcatacatataggattattaggttagtgggattaatcaaagaaaatcatttagaaaagttaaaaaatgctttaagtttttggaaaaacaatatttcaaaggaataatcgattaccatgttggtgacatcgattattttgttctaactgccttttgaaatcttgacatgatcattataatcgattactcaataatttaatcgattacaaaggcatacattgaaaagttgttctgactgccttaatcgattgccaaatattttaatcgattacacatatgttttgattgaaactatcattcaattttaatcgattacaggaaatcgaaatcgattaattgagctaaatagaaaaaacatgtcttactggcttaatcgattacgtattggtttaatcgattaaactattcgttcttgaagtcttgaacgagccataagcattttaatcgattacaatcttggattaatcgattacataatcgaaataatcgattacaggagctaaattaatcgattatttttggtaaaaattctgttataaatagaagtcactacgacagaaaataagaagaagagaattatcaagtgcttttgagattttcgttgagtgatcattcacaaacaatcagtgctttcattagtgataaaaatctgagaaagaaacattgtagaagcttcatagaatcaattactcatgaagatcatgtgttgaagtttttactttcaaccaaagtcaagaaaagttgcatatctgtggtgtgataatctgcattttcatctatgattcgttcatattcattcatcaatggattatcaggtgatatcttttcttgcttagtgattgggttttacaatttaattgtaatagtgaaatcttgtaaatctattgtaatgggtttctttcaagcatagagatagtgtttctctgggtttttcaactgggtagagttctcaggttgaaaggggtgtctctaaggatctaatagtgttttagattgctgaactttgtctagggttgacaaagagagatttgtaattttgcttgtaaagaatattttgcaatagtggaacttctctctggttttgagtgaagaactggatgtagcctcatagtgtttgaggtgaaccagtataaaatctgtgtgttctttaattttctcagttttacatgcttattacattgtttgtgaatcatattcaaagcacagtttgagatactctattttctggtgctcttggaaggggaagattgattgaagactgattttgttttaaagatttgttttgaatctgaaaattgatttctggtatcaaaagaatttctaataagtgataaagatcctatggctactctgatttaaattttaattgggcaaagtttttcaaccaattcaccccccctcttggttgttttaagtattcatctgtttttcaattggtatcagagctggttcttgtaagttactcaagatcactttttctttccaaaagtcatcatgaatacttcacaaataacctttagagagggtgcctctttgaacagacctccaatgtttgaaggggaacacttcagtttttggaaaaatagaatgaaaatctttattcaatcaaatgaccctggagcatggaatgctattgaaaaaggtccctttattcctaagaaaactgttgctaatgagttggttcccaaagaatgggatgagatgactgaggctgaacaaagaaatgcacagtatgattttaaagctaaaaatatgatcacttctgcactttcctttgatgagtttttcaggactgtgagatgcaaaaatgcaaaagaaatgtgggagatgcttgagattactcatgaaggaacagaagaggttcgaaggtcaagaaagcatgccttaatacatgagtatgaaatgttcaagatgaactccaacgaaagtatttcacagctgcaaaccagatttacacatatagtaaatcacttgctgggtcttggcaaagtatttgatactgaggagctaaacatcaaaattttgaaatgcttaacaagaccatggcagccaaaggtgacagccatcaaggagtcgaaggacctatctaagatgtccatggcagccttgtttggtaagcttcttgaatatgaattagaaatgtcacaactaacattttgtgaagatgcagagaagaaaacaagaagcatagcactgaaggctacagcaagcaaaacgaaaaagaggaagaattaagtgaagaagaggaagatgatgagcaagtgaacttgattgttaaaaagttcaacaaatttatgaagaaaggcaagaataaacgattcagcagaggcaacagaaatagcagcaacaacaacaacttcaacaagaagattgacaacaactttacatgttttgagtgtggcaaacctggccacatcaagtctgattgtgcaatctacttaaggaagcaacaagctgaaggaaaggctaagaaagaagctaaaggaaagaaagcctacatagcctgggaagataatgaatcaactacttcagattcttcaacagagcaagaggaagcaaacttatgttttacatccatcataattgaagatgatgatgatctgctcagtgaagaagatgaggtaaattctgaacttgatcaagccattcatgcttttcaagagatgtatgaggaagcccaaaaacttgcaaaagccaataataagctcaaaggaaatcttagatggcatatagaaaaaattacagatttgcaaaatgaaatttgcaacttgaaagaagaaaatgaaaaactgacttcaagttacaaattgaatggctgtgtgtgtgcttcttcatcaactaatgttgacaagtataaaaagcttttgaaagattttgaagaatacaaacaaagtcaaggtgaaaaatatatgttgcttttagccaaaaatagtgacttgattgatctcttgaggaagttttataaaggcaaatgcaacttagctgaaatgttaagtgtgcaaaagtatgctggagatacttctggattggggtacaaacatggaacaaaatcatttgggaaaacagtttttgtaccaccaaaacagaagaatcaaaagtggcataagaactcaagggtcaatcaatttgctgcatttaaaaaatcctcaaaatctgtaacttgcaactattgtatgaagaagggacacacttcttttaaatgctatgctaggagattctttgtgcctaatggtgattgcatctggattcctaagatcaaaagaaatgctaacccatacagacagacccaaccttgattgggtaccttcaataaaattctaatttgcttttgcaggtgtgtctaagagctagaacatcaatttagtatcttgacagtggatgctctagacacatgactggagacatgtcccttctctcaaatctgacattaaaagaaggaggatatgttacttatggtgataacaacaaaggcaagatcattggtgaaggaaatataggagacaacataaaaaccaagataaaaagtgtgttgtacatggatgggctaaagcataatctgttgagcattagtcagctatgtgataaaggctacaaggtgaattttaacaaagacagctgcataatatcagatgataaaaacagtgaggtactgcacataggtaaaagaaaaggtaacatttatgtgctttcaattgatgatgcattattccataaatcttcatgtcttattagcaaaatggatgaaacttggctgtggcatagaagagcaagtcacatgaacatgcatcacatgaacaagctcataagaaaagaattagtcattggtttacccaaactcaagtttgagaaggataaaatctgtgatgcttgtcaaaaggggaaacaaactaaaaattcttttcaaagcaaaaacattgtttccacctctagacctcttgaactacttcacatggatttatttggtccttcaagaactatgagtttaggaggaaactattatggacttgtgattgtagatgattactctagatatacctggactatgtttttgaaatccaaaagtgatgctttccttgcttttcgaaaattaaccaaacttactcaaaatgagaaaggcagtaaaatagtttcaataagaagtgaccatggtggtgaattccaaaatgatcattttgagaaattctgtgaagaaaatggaatcaaccacaatttttcagctccaagaacaccccaacaaaatggtgttgtggagaggaaaaatagatttcttgaggaaggagcgagaacacttcttaatgaatctaatttacctaagtatttttgggctgatgcagtaagtactgtgtgttatactttgaatagaactctcataaggcccattttaaagaaaactccttatgagctatacaaaggaagaaagcctaatgtatctcatttaaaagtttttggctgcaagtgctttgtgttaaacaatgggaaagaatcacttgggaaatttgatgctaaggcagatgaagcaattttcctaggatattcattgcatagtaaggcatatagagtgttcaacaagagaacaatgtgcgttgaagaatcaatacatgtgatttgtgatgagactaacacctctaaggaggaaaaagaaaatgatgatgcaggtcaactggaaataaccgaaatgaaagatacctctgtcataaatgaagatccaaaagcagaaaatgaatccacaactccagttcaattcagaaaagaatggagaacaacaagagacttatcaatggacaacataataggtgaagtaacaaagggagtatcaactagatcttcacttaaaaatctctgttgtgatatggctttcgtttcacaaattgagcctaagaacattgaacaagccttgtgtgatgaacattggatgcatgcaatgcatgatgagttaaatcagtttaagagaaatgaagtttgggaacttgttcctagaccatcatctcttaaacccattggcactaaatgggtttttagaaataaacttgatgaaagtggaatcatagttagaaacaaagccatattggtagccaaaggctataatcaagaggaaggcatagactatgaggaaacttttgctccagttgcaagattggaagcaatcaggttgttacttgcatatgcatgtctcattgatttcaagctttttcaaatggatgttaaaagtgcttttttaaatggatatattgaggaggaaatctatgttgaacaacctccaggttttaaagattttaaacatcctgattatgtttataaattgaaaaaggcactttatggattgaaacaagctcctagacagtggtatgaaagattaagcaagtttttactcgaacaatcctttactaggggcagtatttataaaaccttgtttatcaaaaggcttggaaatgatttcttattggttcaaatttatgtggatgatataatatttggatcaactaatcatctgttgtgcaaagatttttcatcaggtatgcagaaagaattcgagatgtcaatgatgggtgaacttaccttttttcttggtctccaaataaagcaaatgaagaatggaacattcattaatcagtcaaagtattgtctggaaataatcaaaaagtttgaaatggagaaaagtaaagatgctgcaactccaatggctacatcaacatatctagattcagatgagcatggaatgaaagttgatgagtcaaaatatagaggaatgataggatcactcctgtatttgacagcaagcagacctgatattatgttaagtgtgtgtctatgtgctagatatcaatccaatcccaaggagtcacatcttactgctgtcaagaggatcctgaaatatctcaaagctacaccaagagttggactttggtatcctaaaggtgcttctttaaatatagttgattattctgactctgattttgcaggttgcaaattagacagaaaaagcactagtggtacatgtcacatgctaggaagctctcttatttcatggcattgcaagaagtaatcatgtgttgctttatccactgctgaggctgaatacatatctgctggaagttgctgtgcacaaagtttatggctcaagcaacaaatgcaagattatggagtggaacttaatgcaataccactgctgtgtgacaatacaagtgccatcaatatatcaaagaatccagtcatgcattcaaggacaaagcatattgagataaggcatcattttctcagagatcaggttcaaaaaggtaacataaggtagacttcattgatactaaaatcaattagctgatattttacaaaaccacttgctagagatagattctatacactaagaaatatgctaggaattcttgatgagaataatcttaactagcttatcttgtttgtggcttatgtgctatttgaagagttgataaatcatggataaccattatgtagtaaattgagaaattagctgctaaactgctctgttttgtaaaatgccctgagataatcgattacactgcgtattaatcgattaaatactttaaagccttatactggtatgaattttgtaagtttgtaatcgattataaaaaaggtaaccgattattcttctaatcatcagaagataaaactctctggaataatcgattacactttgaattaatcgattactattgttaagaacaaaaatcaaaatcagacgagtcagtaataatcgattactgaaagctgtaatcgattaccttgtacatgacttgatataaactgtctgtgttaatcgattaccacacgggataatcgattacttagagttctgatacattgttttcatggctatacttaaaataatcgattactgtataaagaaatcgattacaggttgtcttcaacctctgataattgatataaaagaatcgattacctgaaaatattattcgattacgttatttttgaacagaaagctaaattgaactgaaataatcgattacactacgtaataatcgattatttgatctgttacttgaattctgacgcattttctggaattcaaaataggatttttaaaatgcctaaatcttctctctgtcattaaaacagttacaacagctatattttcaaaattctgaacgttaaggagtcttactaagtctataaattgagtctcacatttcatagagtttacacttaaccatttattcctactaaaactctgtctctctctgttacattcctcatcatgtctgaaccaccatcatcaaaaagagttagaaaacctaaaagaagactaggagaatcatcctcaaatccacctcaacctcaacctccacaacaacctgtagataggattgatattggctttcatcagaaaatgataagatgaattacttgcagtatagtgcaaccaaacttgttgttgtacccaaatatattgaggtagactggcttattaggcaaggatttaacttttcaaccttgttagaagaacaaagtctaaagaggtttgtagaaatgaaaggtactttttatcctgatcttgttcgtgttttctacacctgtttaaaaggctctatgcaaggtgacataaaatcaaaagtgaaaggagtcacaatgcatatcactcctgacatttgggaaactgttgttggagtttcttgtgaaggaacaagaagatttgaagaagagccaagtggttataataaaatggagacatacagaagtatgcttcatgatcctcaaatgagacttagaaatcgtctcagtactgggcctatgaaagctgaagataggctgttgcattatctcattacatacatcatcactccaaggagtacaaatcatgcccaagctacagatgatgatttgcaattagtttatgggctgaaaaatcacatacctatgaactgacctctgatttttgctgaaatcatgcttaaatctaaaaggttaacaaactatccttttccctatcctgtattaatttccagacttattgatcatttcaatattgatgttgaaaatgaagtgatagacaacaccctatcctacaatagtaaaattaaggaaaaacatcttacaaagatgggtatgagaaaaacaccagaaggatgggtcatggctgctcaaataggtgttgctgagcaagaagaaatggcagaagactctgcaaatgaaggacagcaagcacaaccctcccaccaagcattttctgattttgaatctcttataattcaaaagatggattctatgctgaagcttcaagaggattttaaaactgagacaaatgaggctttggcagatattaaagaaagattagaagtaattgaggcaaatatgcaagaccaaatctctattccatctcctgagatttagaatttatcagatattgtagtttattttctctttctattttgtaattgctttatcaatagattattgtacgttttattctctgttctttgtttgatcattgtgtctattagtattttttgacttttaacaagccaaatagggggagagtaagatcaaaacttcaaaacagaataagagtaagaacaaattcagattaaaacttcataagattacaataattcagggggagtaacaaaaattcagaaataaaaagatagggggagaattaaaggaaaattaaatttctactagaagaattgaatgttatatactataattgagggggagtaatttgaaatcaaatctggacttgaatgtttaaatactagtgaatattttaacacttgatttctggaaagaatgttgaaaggtacaggtacttgcaaagcttcatcaaagatgatcagtatcaaaatgtttatttgaatcaattgaagaatcagaaatttctcaggactgcatgctcaatcaatttgaagattttgagaatttggcatgtcaaaagacaaaaagggggagattgttgattcagatgaagccaagcatcattgaagatcaaagtaaagagttttgtgctttcaacatgcaaaaggaagctttaagatgaagagttcaaattgatcatgtaaaagaaaatgtatgatctgataatccaatattgcataacatgcatcattcatacatataggattattaggttagtgggattaatcaaagaaaatcatttagaaaagttaaaaaaggctttaagtttttggaaaaacaatatttcaaaggaataatcgattaccaggttggtgacatcgattattttgttctaactgccttttgaaatcttgaaatgatcattataatcgattactcaataatttaatcaattacaaaggcatacattgaaaagtttttctgactgccttaatcgattaccaaatattttaatcgattacacatatgttttgattgaaactatcattcaattttaatcgattacaggaaatcaaaatcgattaattgagctaaatagaaaaaacatgtcttactggcttaatcgattacgtatcggtttaatcgattaaactattcgttcttgaagtcttgaacgagccataagcattttaatcgattacaatcttggattaatcgattacataatcgaaataatcgattacaggagctaaattaatcgattatttttggtaaaaattctgttataaatagaagtcactacgacagaaaataagaagaagagaattatcaagtgcttttgagattttcgttgagtggtcattcacaaacaatcagtgctttcattagtgataaaaatctgagaaagaaacattgtagaagcttcatagaatcaattactcatgaagatcatgtgttgaagtttttactttcaatcaaagtcaagaaaagctgcatatctgtggtgtgataatctgcattttcatctgtgattcgttcgtattcattcatcaatggattatcaggtgatatcttttcttgcttagtgattgggttttacaatttaattgtaatagtgaaatcttgtaaatttattgtaatgggtttctttcaagcatagagatagtgtttctctgggtttttcaactgggtagagttctcaggttgaaaggggtgtctctaaggatctaatagtgttttagattgctgaactttgtctagggttgacaaagagagatttgtaattttgcttgtaaagaatattttgcaatagtggaacttctctctggttttgagtgaagaactggatgtagcctcatagtgtttgaggtgaaccagtataaaatctgtgtgttctttaattttctcagttttacatgcttattacattgtttgtgaatcatattcaaagcacagtttgagatactctgttttctggtgctcttggaaggggaagattgattgaagactgattttgttttaaagatttgttttgaatctgaaaattgatttctggtatcaaaagaatttctaataagtgataaagatcctgtggctactctgatttaaattttaattgggcaaagtttttcaaccaattcacccctccctcttggttgttttaagtattcatctgtttttcatctatgcagttgttgttttacttacatagttacatccaaaatgaataaacttggcaccaaatttgaataaagagaaacaaaacgcaagggaaattctcttgaattctgagattttggtgagaccaagtcacaaagacaaagcaagcagtgcaaaatggggtgaggtgaaaacgggtcccagaagaaaaaagaaggtgacccatttttaaagacgatgagattttggtgaaaccaaatcacagacacaaagaattgtaccattcttgtccaaaaatggggtgaggtgaaaactagtcccaaaccctctggctcaacagccagagcgcagagtgaagcggcagcacgtcaacgttgtggcaggtgatgagggaagggaaggcttcctagaacaggataacctcagactccacaaagtaggttgtggcagatgaaactaaaatgatgtcgtttggggagaaggagaaggtgacttggacgccgatgttgtcgtgggaagagagaacgagtgcggggtgccatttgtgagggaagcgggcggagacggtggcggggcatgtgggatgggcgtgggtgtaggtgggaagggtgagagagctgcgttgtgagagattgagagaggacgcaaaaatgaaagcataaatggtgagggttttcaaagacggtaaaccaataaaccgtctttgaacacttttaaaaaaaccacgcattctggaggcaaaaattaataaataatataaattaattatttatttatcaaaaaggggcaaatgaagcaatatttaggcatttggggtaccctaacacgccctgcctaggcgtgtttaaacacgccctggctaggagtgttagggtcccctatgcctatatattgcttctgaaaatgacatttaaggattccgccttctctctataaagtgggtgttgatttctctgaagcgaagccctgccgaatttgaagcgctgccgacaagtaagtcgatttaactgattgtgcatagtatttagtttgttatatttttaaattagaaaattgttaggatcatatgaacttgttagcgacctagatattatgttagtgagtatggttttagttattccggtttagtttttggggtttatggtgtgattaggggttagggtctaggctagtgattagggttatgtaattcggtgtaggattcgggtttacattgttattagtgtttatggcttggggtacatacgtaggttctgggtttagggcttatggattgtgattagggttgagggcctggggtagtgattagtgtgtacgtaatgcagtgtacatttagggttgacagtgtgattaggatttatggattgtgggtatagacttagggtttatgggtgccggtttagtgttcagggcttatgttgtgatttgggtttaggccctggggtggtcattagggtgtatgtaaatcgggtttagggtttagggtgtatatggggattagggtttatgacttggggtacagagttagggtttgtggatgttggtttaaggtgtaggtcgtatgctgtgattagggtttagatcttcagttatagatgtggggtttatggatttcggggtaggttaggggtttacattgtgattaggatttatggccccgggaacagacgtaggatttattgtttaggatttagggtttaggatgtaggatttagggtagctcagtaaaccctaaagcataaaccctaaatcctatacaataaaccctaccccctaaatcgtaaactcaaaaccccacccttgaactcaacgtagtgactagggagcaatgcggtggtggcacggtgggcacttagcaccgcagtgggcaagagagtaagggttcgagtttgagggtttaggcgcgtgggcaagggagaaaggagtaaggaagtaaggtagcaaagtgagaggtagatgatcgtttaggcgcagacctcttttgggaaaaaattttgtgcaagtcccaccctcgaactcgacgtagtgactagtgagcaatgcggtggtgacacggtgggcacttagcggcacagtgggcaagagagtaagggttcgagttcgagggtttaggcgcgtgaataacctaatgaatgttacatacacttcactaatattgagtaattagttttccaattcaagttttgccttggcaaacacttccttttgaaatgacgaagatgagtctctatcttctaggtgtccaactgaccatgttttaattgcttttctatttcattgagcctggggtagtgattagagacctgttcacatagcaattgtctatgccgatatgatgcttcaagcaaagcttcggtgttgacatagtcatgttggagttgagcaaatcccattttgtcctcctcaaagacatcttagatttacaagttgaaagttgagtttgttgattatctctgctgaaggcagcctttaaaaaagtaataaacaaatgtttcattacaagttatttacttatgacatgactaattgtgatgagagaaaggtatatagcatattgacatgactactattgtattggtggaaactttctttggcactatagttcagggtcaggtgaaacaaaaacacacagacaaataataaccaaagaagaacatgagcacagatcagatagaaaaacaattattggaacaagtaggaatagttatctgtttaggaacaattattggattataggatgggaaaatgcctgtaatgatgacagatagaatcaacctgaggtctttagtgtttcaagctttgtgttggattacggtttagtctgagggcttatgttgtgattagggtttagggcttatgtttttttacttagggtttagggatatcggctaagctttcgggcttatgttgggttagtgtatttggtttaatgtatttgatacataagaaaattttgttcaaatgatttgttaatcgttaatattttgtttaccgtggttttaaatttttgtacatgaagatactgaatagatggctgattcatcctccacatcatcatcgcgatctgcatccgaccatgaggctgagcccatggatcccactgcctatgttgtccctaccccatacaagtggggcactctgcgtaggcgtattcagcgcacgcacatttacaagttgtgtggaacgggggcgtgccacctcaggtattgaagactcgacgtggtaaagtgagcggtggaccagatgcggacgatatacccgatgttgtttctgacatgttgcgcgaagctgagtttcttcatgtcgcacgcatgcgacatatttaggtatgcaaccatgcaactatgaaatgagttaagactggttaatttgataaatgaagttgtttaataatttttatgtatttcagatggatgttgtgcttattagtgctctggttgaacgatggaggccagagactcacaccttccacatcccgcaaggtgagatgaccatcacgttgcaagacgtggctggtattctgggattgcccatggagggcaatgtggttactggattgacgattgacgagtgggcgatcgtcagttaggaggtgtttggtcacaaacctgaggaggacaccgagctaaaaggtggatatttgcgcctatctttctttgataaacattttgcgcattggggtgatgtggttcccgacattgttcacgtgatgcggttcacgaaggcccacattgcacgacttatcggatcatggctgctgtgcgaccgatctagaggtagcatgattgcagcacaatacatgtcgttgcttgcaggggattttgtggacatcgaccgatatagctggggctcagctgtcctttcacatttgtttaaacaaatgtgtgagtgtacagatccaggcaggagtgacatcggtgggtgtcatatgcttcttcaggtgtaggcgtggctgagattcccaccaattcctccagctattccgttgcctacacaggcggactggcattttggacatcggtatgtgtggctatatgttgttcttgtttacaattgtaacaatgaagtcttatagtatactaacattacttattttgaaattaggtttaacgctttaggttgacttaaaccgcatgaactggtcatgtataggatggcattggactcccttactcgaaatgaggtacctatagtagtttttcaattactatacgtttgcatatatggaacatgctatgaactaataaagtgttattttgttgtgtgtaggtcgtttggcaaccatacggggactacgactttcttggtgcttctgagcgtgagcgactgctgtggatggcaactacgcctatcatatgctttcacacagtagaatattcccagtcggatcgatgcatgcgacaattcaggagggatcagccaatcccacgcgctcccaggaagctgaagggtgtgcatgatctttcgctttgggggaaacgagaagacaactgggttcgtaaactcagaccatttatttcgcgatgggatgttagggaccagcacattgagctttcccccttgattcaggggttgctgtcaccacaccatgagtacatggtttggtacagagaacacgggaagcgatttatcacaaagaagggcgcgaagaccgatcgtggtgtaagtttcttcacatcctcatttgtctatttaaattaattatactacatgacatacttgacacttatgtgtatatatttaaaattgtaggtcgatggactggaggctttttacttcgcgacaagtagccccgataggaaggccttcgacttcgattgggctagtgaggaggtcggtcggttaatgtccgtctttgccgagagttgtcgcgtggaggaagcaggcccacatgctcccgaatcccagcttcagcccgaaccagagatttcagttgcagttggtcaacgaagaaaagagggtcgtgggctagagcgtcggcggagaccgatggagtaggttcctgagcccattgttcgaccgaggccgcgcacggagggttactataggcctcctgttattgcatcgacatatgggacacaacccgtatattatgaggctgctgcgtaggggggcatgggggcatagactatggcgatttcagtactgaagcccaaatgcttacaccaggcccatcgtagacccatgccgcatatgttacgactgcaatgacatgtgcagatgtagatggcgggatctataataacctagatttttttataaaaagaagtaaaaggaataaatagcttccttttggtaagtatatagcttatgtgccttcatgaggtgttttagtctagaattgatggttagcaggtgaaaatagcagaattaagccgaacagaaggtaccgcgccaacaagcctatatactaccgggggtacataggctaattctacatgtggcgccaagagcgccacctgtgctggaagttgggaccctatatctaggcctaatcacctccctatgacctttaatccctagagaaacctttgaaagcttgaatccttcaatttttgctcttgaaaaacccctttgagtgaggagtgatttctcagaggaaacactcagagaacttgagattggcgaggacccacgacgtataaaggacgctagagcttgaggaagctgtcctgaggtcttttgagtcgtcactgaggtaagatactcaagtttctccgttaaattttgatcctgggggttttatgaatagtgacccatattagctggggctagaattagcccagggtcctgtagagaaacttgtttagagcgaggaatagatgaaggattagctttcagtttttgattttgatgactttggattttggctctgtggtggcatgtgtcaattatgtagagtcacttatttatgattcttgaacatgccagagccttgattatgtgatgttctgagccgagaggctagtagagcagggctttgagtgaaactcagcccgttctgatgataattgagttgtggggctgaggaaagcttaggatatatataaatatgtagtgagtctgggatgactcagatggcttgtattcggccctgatggaccttgagtgattctagagcagcctagtgtaggctgagtttgattgaaccctaggataggggaattctaatataatatgttttgtgaattgtatgcctgatggcttattttgatatgaaatgtgcatgtgccttgattaggctttgattctgagagtgttggtggcgggagccacagacctgggaaggaactgcagactgagaccttaccaggtaagttcagtgtttttggggttgaactcccacttggttgcataccacactccgggggagtgttggtcatgattcatgatgcatgcatttgctgtggtattgcttgtattgatctggtatgcatctattttggatatatgtatgctatgactgagatagatctgttggccaatagataaatacaggcattgagggttttctgtcctgtatttaggcattgagggttctccaccaggcattgagggttctctgccatgtgattatgcgttgagggttctccacacgacgttgagggttctccgccaggcattgagggttctctgccactagtatcgagcagatggctgctccatgttatgttgaaggctagagggccaggccaatgggccatgtttgagatgtttgcctgatatgtgtgtattatgagttagtgggccagagtgggaatgatttcccaaggactctgagcttactgagatatgttatctcaccccatgtggggttttctatgatttcaggtgatccttctagaagagaagatcagtctcagggcaagaggcccagcagagactaggttgtttgaaggaggagcggcattgagagcttgaaggctctattttgattttgtttctattgtatagttctgtattccctcgagaagggcagttattattttgtttcaccacggtatggtgaagactctgatgtatatggttatgtacagaactatttgggttatgatatgagactttccctgagtatagatctattgtgtatgtgataatctgcctaagtcttgtagtaatctgtcttgatgttatgatatgaaaaactggatcagcagaggcgtgatatatgttatggtttgcgttttaaacactggaatgcattcgcattcagtgtgttgctggaatgcattcgcatatgcatccacaccagcatcttcatcattatcggacgcactggcattctcctgaagaagacaatcttccatcgctatattttcatcatcatcatcatcgtcatccataacccaagttaggtcatgtgaatcttcctgagacatgtttgcacctacaacatcatatgatggtgcaatatgtgcagaattacaaacaactgacctcctgggtaaaacagcttcctgaactacggtgtaatccacatacaactctaaaaatttcttccgtgcctgattaaaaaattcttcaatgaccatttccaattcttcatcatcctgtattggaaaccccatgtattcatcttgctgccatattcttgccgtcacacccaattttggacgtatcttttgatgcaaatcactcaatgttgcatttcggttgattcatgtcatccttttctcccctccgaagacaacacctcttccccttcaattttccttccattgaaaaaaaaccacaacacgaacaacctccgcatcacttgaactcatttcctgcaatcaacataaataaatagggatggcaaaacgagcttggcccaccgggccggcccgcttagcccgaaaaaaaatgcgggctgggttgataatatcaacccgcaaatcaaaagcgggccgggctggcccgccccacaaaattgcgagccaaaattatttaaatattatttaaataattaaatattaaatattaaaattaattaaatatatttaacatattttgaaataagtatattctttaaatttatactcttttgcactctcataattaacttctaagttttaatattaaaatggttatgataatgatactttcaaatagtctttcattactagcatattacacttttggacagtttataaccgtaaatttcatttgcaaatggtgtaattttgtgaattatcacatgacatcatttatttagcattaattttaaattatttatttttatttaactttgtgttttttaattatcatatttgtattttattataattttttgtattttattttttaaattgacttttttaattttttatgcgggctggcccgctagcccgctggcccgcattaaagaggggcgggctagcatttctagcccactttgcaaaagtgggccgggccagtctgccccgcatttttcgcgggcctggccggcccgccccgtttttttgcgggccggcccgtttgccatccctataaataaacgtcagaagcacacaaacacccgaaaccctaaattatgaaacacaaaccctacgtactaaacaaaccctaacccacataaacgcttctacagatgtagttagtccccagtaaatcaccaaatggtgaaagaaagtcaatattgtcaaagacacaaaggcatagagaagtggtcttgtttacacaacaacctaaaccctaggtccagtcacgccaagccatacaccctaaccaccacatacgccttaagctctacgacggataccctaaaccctaggtgtgttccccttgacctaacccctaatcaccccataaaccctaaacacttaagccggataccctaaaccctaggtgtgtacaccaggccctaaaccctaatccacccatgcccctaaacccttatgctgtaacacttaaaccctaggtgtgtacccccgtacctaacccctaatccacacatgcgccataaaccctaggtgtgtccatcaagacataaccccgattcaccccataaaccctaaaccctaagccggaacacttaaaccctgatcaccccataaaccctaatgacaatttcaacactaaacctaaaccctaagacataaacatatacactatgaacctaacaactatgtcgctaacaactttaaataatatgcaacattgtttagggtttagaacttacttctttccagcgctaatcttcacaaaatatcctatcccaagctgtagatcctgaagcacagcaacttcaacacagaaccctaattacttgtcggccgcgcttcaaattcggaaggacttcgcttcagagaaatcaacacccactttctagagagaaggcagacctaattatagagagaaggcggaattgtacaaagtaattttaacgggcaatatataggcatcaggggaccctaacacgcctagccatggcgtgtttaaacacgcctaggcagggcatgttagggtaccctagatgcctaaatattgccccatttgcacctttttgctaaataaatatttaatttatattatttattaatttttgcccattctggatggacttatattaaaaatttcattgatttttaagacagattaggggctatgcgaaagatgttgtcgtagaaagggaaagtttattattagttataagtcaaatgatgaatatgatattttggcaagaaaacatggaaaacctcaggaaaaatatgagaaaattgatgaaaatggttctgtaacttactttatttcgcttttgcattaaaatttttagtataatttaagtcatacttcatgtaaataacgaggttgtgtttgcgtgactgtaacctggaagtggcctcgaaaatgagggcctcagattgagcgtggtgggccagtttgtggaggaatgcagtgagttcagccatggtggtggggttccaactaaacatggagcttcgctcattctcgtgtcaactatgcaagaaaggaaataatttagtagtaaagcctcttaactgccaaaataaaaattaaaaaagaaagagttggggtgaggtgagaggattagcaataaaataaattgaatagtcactatccatggtattaaaaattaaagaaatcaatgtggtttagcatgaccaacaaataacttagccgcttaatcatgtattcagagatttcatctttaggttaattcttcaaataaacttcagtacttcctattcttaactttcaatcgaaaatactttgggttataaaaaaaagtaaatagaaaacatattaactgacgtttttcaacttggaaataaggactaaaagacatgaacattctggtgatattctctttccttttttttctcattgatcaactgtctgacaagaggttctaaccctcttgaggagttttctgttgtggggattttcttgtgtctccatgatggagactccatcatggtcaaacaaatagttggacccaaagcaaaaaaaaaaaaaaaaataacaaactggatcaaacataaatgataattaaccaacaaaattgtgaaaaatctacatacgtttacaaattaagacaaagatgaatcatgaaagcgaattaaaaacattcaatatataatcaacatcgtgaccaactaataaaaattaagaaatgttgaatgaagctgattgagaaaatctaatggttctctgttatttcattcagaatggaaatacaccaaggattagggcctaacctcccaatccagtttctccaatgcctccctaatcatcttccctcctacttaactactatatatatgtagttaactaactccactgtaagtgacacctgttagttacattttacaattgctttttaaacctcccatgcgttctagccccatacacctgctgtagagatggtctaacaatacccccccccaaaagagccaccttgtcctcaaggtgaaaagtaagaatctgttgctgtaaaacttccatttattcccaggtagcttcaaactcagggagatccttccactgaactaacacttcaatttttcctgatgaagaatttcgcactgctttaacctcagcaggttctaccttgagttctagctcatcactcaacattataggtaaaggttgaggtgtgactacaggagaaagagcttttttcaacaaagatacatgaaacactggatgaattttagtttcaggaggcagcttgagctgataagctattttccccactatcttagcaatctgataaggtgcatagaatctaggacttagcttcggcaaaagaatcaaaataatattttttttattaaatatttaccaaaaggggctgtctgtaaaatatttacaaaaacggggctgtgtaacaaggattaggcatgttacaacacgcctagattgggcgtgttgtaacatgcctaatctaggcatgttgcacatgccccatttctataaatagcccccccccaccccatttccttcatatattggcttgcagtgttctgtctctgctaaaccgtctcatattctggtgtattttcattttttcagagatttttgaaggtgttctgagtgatgagaaagatgagttcaagtggtaattctgtttgcgttgtcttatattggaatggaagaaaatatcaaggccaacagggtgtcatttttgaaggggaaacacaaggaaccactgtgagacgtacatcaacccttactgaattgcatgaaaagatatggcaaaaattacatctcaatagcaaccagtcaatcactttactgacgggaagattatggcaacacgagaagttcatggggcttcaaataatggatgatgaagacgtggagttggtactagatggattttgcaaccagggaaggaaagattttttggagttgtacgtggatattacagaagttgatgatgttgttttacccatccaagcagttccacatcatacatcatcatatgctgctggagggccattgtatgctactggaggggcatcatttgttggcggagaggtcaacgtgtctgaggaggattcacatgacccaacttgggtcatggatgacgatgaagaggatgacgatgatgaaaatattacaatggaagatcggcttcttgagaaggatgctagtgcgtcggacgaggatgaggatgctggtgtgcatcaagaagatgttaatgtggggccatgtcaaactagtgatcatgcggagggtggttcgagtcaaccagaacaaggtaaattagctgaagatgtgaattataatggtttgtcatttaatttgttttatattggttattaatatgttttttaatgtgcatcaaatgatgttattttgttagttaagtttgttgactaaatgaattaggatggttgaattttgttttatattgtgtttgtgctttactgtttaggttaaatagttagggttatggacggtttggttggggtttaaggctttgtgttgagtttagggtttgggtgaggtttagggctttgtgttgaggttagggttttggtgtggtttagtgctttgtgtttagtttagggtttggttgggggtgagggtttggttggggtttagggtttggcaggggtttagggtttggttggggtttagggttgtgtcggcaggcgtacatggtgtttagggttagggtttagggttggtcgtgcttttgagttgatatcattaattaaactgacgttgaatgtgcagctgctgaggcgattcctttttggcaaggaattccacattatacatatattgattggagttacctacccgaacaagactcttttagcggttctggttcgggttcaggatcagtgcagggtccgtggcaactaggggatgatttgtttgtcaaacaagaatttgactcgaaaaaaaggtttagaaaaatttgtaaagaaaattatgttgatgtattttttgatgttgcgggttatacaccctctatggtcgagtttgacatcgcatttgcacaatttcgtgagaccagtgttgaggttgcggaatggatcgattccatccccaaggagaaatggacacgtgcatatgatgtggaggggagaagatacgaccacatgacaacaaacttggctgaatcagtgaacagggtgttgaagggagctaggaacatgcctatcacagctcttgtcaaacacacgtacatccgactggttcagtattttgtagacaaaggtgaggcggctgccgaacagcttcagaattcacaacgatattgcaaaaatgtggttgaagcaatgaggcgtaatcaatccctggcttcagggcaccatgtacgcagatataacgttgctcgaacgttattttaggtggatgatgggtgcgacaagtcatattcagtgtcccttgccgatcgggtttgtcagtgtgggaagttcaaggcattcaaatacccatgcagtcatgctgcagctgctgctttacatgtgcgccaaaatcctttttagtacgtggacgacgtcttccttgtaagtacgttggtgcaggcatattcagcgccatggcaaccaataggtaatgaacgggccattccaccgggtgaaggtccagtcatcatacctaacaaatcaatgctgcgtgttaaaggtcgtccaaggtccacaagaatacgtaacgagatggatgaagtggaaacatcccagagacgtatgaggtgtggcatttgtaagcaagttggacacaaccagagagtatgtcctagtcgtggggggacttcatgattttctgaatggttgtattttttttttttgctagtgtttgttaatgtacaacgttatttgatattttgtattaactttttgtttataacgttttaatactaatcatctttgatttttttggttgtctgataatgtaacaatatgttcattacacgttgtcaaacaaggtcttacatcatacgcacaacttgggcgtcattgaagacgcccaagtttgggcttcattcaacacgcccaacttggggtttgactgaacacacctaacaaataggtgtcattcaacacgcccaagttgggcgtgactgaacacgcctaacaaataggccgtcattcaagacacctaacttcggcgtgactgaacacacccaagttgggcgccattgaggcctatataagtcgcatgctcggcactcaaaattcaatgtgtatacgatggcattcttaggagaaaccagcagtcagaacattggtaattcaaaattagcgttcatttatccgaatggatcaacgaagcatgacaaaacaggggtttctttccaatgtgcaactccaatttcaatgcgagttcctgatgactgttcgtttcaaaccctgaagagtaggatgcagcaaacccttgttcttcctgatgaccatgttgttgacaacatctactatcgacaaccatcgatgcatgcaggtcagcactatttttttacttctgtggcactcacaaatgatgatgatgtttgcagaatgttaaggtgcagtgacaatatgtcgagtgctggcccaattgaaattttatgtgccatccacagaacacccgatggcatactcaacctacttcaatccacaatcgttccaacacatgatgtaatgctatattacaatggaaagtggaacataccccccgaagagtcggttgtgtaggttatgcctttactagaacaaacccaatacgatttcaaattccttctgcatgcaccatggaaagactgaaggctgttatcaaggaagttgcgccggttggatttccccctgatgggattcacatgccacaggtggtgagaaaattgttttttcgacagccacgccatgcacaatattcgaccaccacaatcgaatatcacataaaagagttgacaagcgatgaagacatgttgaagatcatagcagaatcgaactactggaaacgtttttgtccaattgaaattttagccatttttagcaaaccggacatgcagattgaatgaaaaatgtgcgttgaatatgttgtattactttattgttcttattacaaatgaacgttatgtttatggtttatggattcctgtttagggtttaggcctaatattgtgattaaggttaaggtcttcggttacagacttaggggtattacatacacttcactaatattgagtaattagttttccaattcaagttttgccttagcaaccacttccttagctgcgattttctttgcttttctctcttcactttgcttcctggccacttccattttgtcagctgtttcgttgacattagagacctattcagatagcaattatctatgtcagctgtttccttgacattagagacctattcagataccagttgaaagtggagttcattgattatctctgctaatagcaagctggttacattgaacaggaccattacgaatacttgtctgcttaggaacaattattggattataggatgggaaaacgcttgtgatgatgacagatagaatcaacctgaataatactaaatcaaagtggacacaaagggcttcagtgtggggtgtttcaagctttgtgttgaattcgagcattccacatacataatagttacactacaaaataaatagcacaagcaaatgtaacatacataatagttacaatacacatcattaaaataaatggtacaaacgaatggtacaagcaagcgactaaaactaagacgatggtggccactgttgacgacgcgcttgtctatcagattgcctccgtcttcgaggccgctgggaactgcctgcctcggtcgggtctgcctgagaggggcctgcatcatatgctgggacatatggagctggacatggagtgccctggtctgcataccatggcataggatgctcagtagcttcgggcacatatggtgcatctgttgcccaacccgcacaacctattgtggccatatcaaactccatgagcatctgatcgacgtttgtatgcgtccaatcagtgggaacattcccaaagccaacgtcttcatattggccctgcgtcggatcagtaggatcatggtaaaatatctggctcccatatgtcgattcaataattggaggcctataacaacccggggcggcaggcccgggaccaacaatgggctgcggcacctgctgaataggtcaccgtcaacgctctaggccacgtccctctcttctgcgatgaccaacttgaagagacaattatggctcctcctcaagctgcgtctcgggagcttgtggtccaaactcctccacctgacaactttgtgtgaagacagacattaggcgacccaactcctgattggcccaatcgaagtcaaacgtcgtcctattctgtctgagtgtcgtgaagtagagcatctctatcccatcgacctataaattcaaattcaaatatataaacatcagtgtcaactatgtcaactatgataatgaatgtaaataacataaaaaaattcatcaaaacgaaacttacactacgacccatcttggcaccctcctttgtgataaacagcttcccatttcccgtgtaccaaaccatgtactcatggtttggtgacattaagccctggattgggggggaggtcgatgtgctcttccctatgctgccagcgcctgataaatggtctaagtttacgaacccagtttccctctcgtttaccacgcagggaaaagtcgtgcacacccttaagtttcatggcaggacgtgggattggccgatccctcccaaattgccgcatgcatctatccggatgggcagcttcaactgtgtggaaacagataatcggcgttgacaccatccacaacaatcgctcatggtcagatgcaccaatgaaatcatagtccccatatggttcccagacaacctgcacataaaaaaaacagttagcttcctttatgtaatcacatgtaccacaagtgcaaacttacaattaataaacaagcactatacatacgttttcccgagtgagggcatcgaaggttgtcctgtagtacaccacctcatgcaggctaagtcggggtaacccgttaaacctgttaacaaaataactaacattaaacaatgtagggcttaattgtttaaattgttataaaatgaacatgtagtcacacataccggtgtccaaaatgggcttgtgggtccgtaggctgtggaatacatggagcaattggtgggaatctcagccacgcccacgcctgcagtagcatatggcatccaccaatgtcctttctggatgcatctgtacactcgcacatctgtctaaacaaatgtgcaaggaccgcagaggcccaactgtatcctccgatctctgggaaatcccctgccaacaaagggatatagcttgctgccatcacgctacctccagatcgatcgctcagcagccatgcaccaataaggctggcaatgtgcgcctttgcaaaccgcgtcacattgacaaaatctttatccaactaaccccaatccccaaaatgcctatcgaagtaagtcagtcgtaggtatccaccggtcagctctgtttcgttgtcaggttcttgaccgaaaacgtcctcaatcacctccgcccaatcagacaaagtcactccagtgacgacattgtcagccgtgggcaatctcaaaataccagccacatcttgtaacgtgatagtcatctcgccatgtggcatatggaacgtatgggtctctggcctccatcgctcaactagaggactaatcagggcagcatcaatctaagacaatttcattaatcaattgacaactatagttatcgttaaatcaaatttgattactaatatgaggtgttgcatacctgaatatgtcgcatgcgtgcgacatgaagaaagtcagcatcccgcaacatatcagaaacgacttgaggaatgtcgtcatatgctggtccccccgacaccttgccatgtcgagtctttagtagtcgtactttgccctcgttccacacagcttgtgaaacatgggtgcgctgagtacgcctacgcaaagcgccccatctgtacggggtaggaaccacataagatgtcggatccatcggttcagccttatgatccgatacagagcgcggcgaatcagatccagataaatcggccatgttatcagtaacttcatacaccaaaaataaaaatccatgttaacaattatgtacaattcacaaatcattaaaacaacaaatttctaaacactagacccggttcggcctacaaccataaaccctaatcactgcaccccgaaccctgaaccaaaccctaatccatgcaaccaaaaccatgacaccaaccctaaacccaaccctggactaaatgtcacatacctggccaaccaaaccctaaacctaaaccctacaccctacctggccaaccaaaccataaaccctaaaacgcacaccatcgtcatatgaccatcaagaccaaccctaccccaaccctgacccaaacgtcacgtcccatgctcaccaaaccctaaacccttaaccacaattgaacatcacatcatcaaaccctaaacactacctaaccatgcccaacaaacccctaaattttaaattctaatcattttagccaaacactacagtaccaaacacctaaacaattttctatccacctaaatgtatgtcactaacaaattaacatcatcctaacatttttctaataaataaatcttaaaccataaactaaaacaattattaagtaacctaacatctattttgctaaaaaataagtacatgcatcattaacaatataaataactaaataataacaacatcgctaaaaggcagagcagagcacttacttgttcgcaggattttttctgaaaaaattcgcaattcagtagagcttcgctgcacaaaatatccaccaaaaactctagagagaaggcagagcacttctagagagatagtggaaagtgaggaaatggtgggggggctatttatagaattggggtagctgtaacatgcctggattaggcatgttacaacacacccaatctaggcgtgttgtaacatgcctaatccaggcatgttacacagccccatttttgtaaatattttacaaacaacccctttttggtaaatatttaataaaaaaatattattttggttcttttgcccttagcttctcattcaactttttagccaatgatttcaacctataaggttgtaatttgagatacacccaatcatctaccttaaaattaacatctctcatatgtttattagcataaactgtcatctgatcctgtgctttcaacaagtttttccttaactggtccagcaatacatctctatcctgagtaagcctttgcacctcctctactgctgtcggaacagtagttcccttccataattgtggtgggtctataccatacaaagctttaaaaggagtaagcttagcttagcagttatagttggtattaaaccaaaactctgcccaactcaaacaagctggccattactttggtttttctcctgtaatgcacctcaaatatgtttccacacctctattaactacctcagtttgtccatttgtctgagggtgataagctaagctgaatttcaattttgttcctgcacacttgaacaattccttccaaaattggcttagaaaaattttgtctctgtcagaaattatggaatttggaaatccatggagcttcaccacctccttgacaaacacttcagttatatcctttgcagtaaaaggatgacaaagtggaataaaatgagcatattttgtcaatctatccactaccaccagaattgcatttttaccttgagccttaggtaatccttctatgaaatccatagaaatatcagcacatacttgtgtaggaacaggaagaggttgcaacagtccagcaagtgatagtgcctggtacttattttgctggcaaatttcacaagtggctacaaatttcagaatatcctgcctcatgccctcccaataaaccagagcagatatcctcttaaatgttctgaaaaatcctgaatgacctccaactacagagttgtggtattcttgcatcagcttaggcaccttggaggacaatttagaaatcaccagtttccctttataccacaattttctattttgtaatgaatatcctgggagtgcatatccattagccaataattcttgcataattatcttcaatttggggttagctaaaatttcaacttcctattccatcagaaaaattaatcatggaaatggtaggaaaagtcattcttcttcataaaacatcagctgctttgttctcacaccctggcttgtatactatatcaaaatcaaatcccatcagttttgaggtccattaaattgatcctctctcaataatctttgatcagttaaaaatttcagacttttttggtctgtcaatatagtgaatcttcttcccaacaaatagtgcctccatttttgcactgctagcactatagccatcaactccctctcatatacagacttcttttgagctgcttcagacaatgtttgacttaggaaagctagtggtcttccttgttgcatcagaactgcaccaagacctttactggatgcatcagtttccacagtaaaaggttgtgtaaaatctggtatagaaagtataggtatctctgtcagggacctttttagttgctatacagcctccttagcttcttcattccacctaaaactgtctttttttaacaactcatataagggtcttgctattttccatagttcttaacaaatctcctgtaatagcttgttagacccaagaatcccctcaaggacttcacatttttgggaataggccagttcctcatcacttcaagttttttagggtctgcagctactccttccccagacatattatgccccaaatactttactttactttgcctaaagctgcactttttcttattaacaaacagctgattctgaatcaataaagataacaactcttacatgaactacctgatcttcttccttactgttgtaaatgagaatatcataaaaaaaaaaacccaatacaaacttcctcaaataaggtttcaagacttcattcattaaggcctgaaatgtggaaggagcattagcaagcccaaaaggcattactacaaactcataatgcccttcatgagttctaaatgcagtctttgtaatatcctcctctttcattctaatctaatggtatccaaattttaagtccagcttagtgaaaaacattgctctttccaattcatccaacaactcatctataataggtataggaaatttattaggaacagttattttattgagggccctatagtctacacaaaatctccaccctccatcctttttccttactgaaataatgggacttgcaaaggggcttatgctatgtctaatgattccagaattcaacatatctttaatcaatttctcaatttcatttttttgataataaggatacctataaggccttatattaggaatttcaaccccaggtttcaattcaattctatgattatgccttcttgaaggaggaagatcactaggatcctgaaatacctccttaaattcctgcaacacttcttccaaccatgtaggtactgagctggtatcttgaacaacctctagattctggaaaaacaccacaaatccttctcctgctcctctcacttctttaacaatggacttcaatgatgcctcagatcttgctaatgcagcatcccctcttaatacaataaaaccttcagcccttgggattttcaaagtcaattctttgaaattggcctttatctctcccaaggaggctaaccattccatcctcaacaccacatcaactcctttcatctcaaacataaataaatcctgctggatttgtagtccctgtaattgcaaattaaccttcttacaaaccccttcacatcttattttccttccatctcccacctccattgtatgaggcatagtgttagtgataggtagctgcaaaatctttactactacagctaaaaggaaattatgggaagctccacaatccactaatgtcatgactttataatcctgaataataccccacaaccttatggatttttttgaagtgaacccaactatactatataaggacaactgcatactttggaattgggtttccatttcctccacttcttcccctgcctcttcttcttcctccacttcttctcccaatatcaacacctgcaactgcttgttaggacacacatgacctccctcaaattttccatcacaacgataacacaatcctttcgcagctttctcctgaaattcagcatctgttaaccttctaaaaggtctgcctctataagaaccagtagtttttacactattagaatcagaattagaaactgattctcttggtcttatagaagatgctttgcttcctggttcctaacttacagttcttgcataactggaagttttggccatgcttcctttatttactcctccagctcccttctccatcaacattcttttcatctattctctgagcataatccatcaactcaggaagtgaatttacagggtgcagctttaattcagctctcactacattcttcaatccattgaggaaaattcctttcaaatactctggttctgtcccttttaatggtcctgcatacagctcaaatttttctttgtattcctccactgttccctcctgttttaggcttaataataattcatagggactttgattcatttcaggttggaagcgttgaatcacaacttgtttaaattcggtccaattagggtttttagccccaatttcccaccattggtaccaattcaatgctttcccctccatagctaccattgctgcatgaattttgtcctcctcctccactcctctcacctcgaaatagcgttctatcttgttcacccaaccaaacgctccttctccactgaaaatcggaatctccaacttccgccacttgtcctctttctcgctaaaatggaaatcgcgattctgcctcttgccgctgtcacaattaccgcttccttaatcggcacgtgccatgcctcagatcgtccccacaagctcctccaactgagctcgcaattcatcacgttcaacatgcttgttctcatacatatatcttaaccctgcgacctcttcacgcgtctacatcatgccttcgaatccacgctcctagaactctactcttgcatccatggctcctcgcgttgagaccatgaatcagcacaggtccaggttcagaatttatgctctgatagcagtgatagagaaaatctaatggttctctattatttcattcagaatggaaatacaccaaggattagggcctaacctcccaatccagtttccccaatacctccctagtcctcttccttcctacttaactgctatttatatgcagttaactaactccactgcaagtgacagctgtcagttacattttacaattgctttttaaacctcccatgcgttctagccccatacacctactgtatagatggtctaacagaagcatggccatgtgttggtgaatgaagcatgaataaccaactagttaggcttgttatgcctagcttcaactaatataggagaagaacgaaaagagtcatagattttgaggcacacgaagaaagaatcaaaagatagagtgtggtattaaagagaattgaatagtattatcattttcttattccttttcaaaatctcaataagaaaaatgttgagtgtggtatataaagagtccaaggcatgcatgcttggcaaatattaaaagtgatagatagtgaattgtcttatcccatctaaaatgtcatctaatttgatattgatatgaagttatgaaagttatcaaagttctaaaaaactatgtatgtctgacttcatctactatctcaaggtttttgatttctttgcgactataattatggtcacatcgcccataaaagttcacagaatttttgggagatttatgactgtatttctgtttatgaaaagtgatgataataatgatggatatataaatgtacaattgtacataaattccagcttgaaatattagtctgtttatgactagcgggaagcgcattcacacttgacttttattgtcacatccatttttcttcttgttaattatttattgagtaaatagttatttttgtatctgaatgtgtaaagtgctgacaatttgtcttcaaaagatgaaaatgcaaattttagttcttgaaagtgaaaaaagtgcaacaaatctatccatcagttaacttttatccgttactgttaatgaaagaacatatgtggcacattcatggacgaatctgtgtgcatttggttagttgggagaaggagagtgtctctagtgaggtgctggaggctgccaggactgcttgcaagaagtacatgacgaaattcgctggaaaggatgcattccacttgagagtcagggtgcatcccttccatgttcttaggatcaacaaaatgcttttgtgtgccggagccgataggctccagaccatgcgaggtgcgtttggaaagccgctgggtacttatgctagagtggctattggccagttcctcctttctgtccgctgcaaggacagcaacagccatcatgcacaagaggccctccgttgtgctaagtttaagttccccggacgccaaaaaattatagttagcaggaagtggtatgtatctggacatggctactaacttgtccacagtagttcaattcgaattctgaaaagtaacttgtatttattatcgatagatttgcacttttttctttcgtatatggttttaactctaggtattattcttttaaattcttgcttagggggttcaccaagtttggccgtaatgattatttgaagttcaagtcaaagtacaggattatgcctgatggcgtgaatgctaaggtaatgttgagctgcttgacaatgcaatatactgtgactgaaactgtatggcacatagatttcatcatgctgaggacttttttacttgttaacttgcatcttggggaatgcattgaactgtgtttctgaatgaaatttgccttttgtcttcagtttgtaccttttattggttactattagtgtgtgtaattgtccttctaactcgcatgttgttttgtgattttgcagcttcttgggtgccatggacaattggctaaccgccaaccaggaagagcctttttgtctattgctactgcacagtgttagttactcagaaatattattgtttttgtctgcacattattttaaaccaagttgagttaattttctttttttctgaaccactttgaatggataatagtaatcttatatgttgttattgttcacttttattccttctctttaggattttatattggattgttggttaccatttgttcgcatacttaatattgttttattagtagtcgcagaatgttgatttcttattattaactctaaaaatcaatgatgcagattattgctttctccaccttactgctctgctgttcaatctttagaaccattgttttatagctgtgcagtagttataatttcttgtgatcattatcttgtcattatgcggaactgcggaaggatatctgtcatggtgatgacagataattgacattttgaccccaaaactgaatatttcttagagaaactgaatgtgttgtgtttattttctatttccattcttttgcaactgaatgacaatgacatatttccctggttattttgcactgtaatttgtggtttttgtttttctctcaaaaaatcaaaatttgaagttggctctgaaaatgggcctttttcgattgaatctctagaagcactaagctggaactggaaaaggattgcttaattagccactcatagctttgtttgtttccccaggaaattcaagggctttagaggatatctttggaagggttccttattggctatggttgtaaaaggatggttttttaacaatttaagtagtagaaaaaagtaataatgaaaattttaaattttctcaccctgtgggtgtggatgtggtggctagtttgatgtttaattgtaatttcttcagttataaattttgaactgatagggttatatcttgaacatgaaccagtagcaactacataatcaaagagatttgcttaacctgggtttgtgcttgattgaattttgctatagctccactgattgctaactgacttttttgtttacaacttgtaccatgtttcatcataagttaccatcatctcctgcaactaaactatttcaatggtaatttaccccttggatccagattatatatatacctgtctttattttctgcaattggtttgaactttgtgttgcttcaatagaaaataagcatttggaaatcgatggagaatgcttgggtaggtaaacatttatgttgactgtagatctgaagcctcattaatttgtaaatatgtcgatgattgtgtatttgggtttcctagagctctgttatcttctttttttctttttttgatgtatgttaattaacttttcaaagcttaaaagtcattgtcaattgcatatcagagttacagactgaattggttctaccgtttcttaaattttcctgtatatatcatggatattctcagttagcatcaacattttatgctagaaaccaatctcctcatccatgctattgtagagttaagcatcttgaatggtctaattgtagcagcatgtaattgttcctagcctctcaaatgtcctgaatgaatgcataacttgctaaaatgttcatgcataacttgtagttaagtagttaagtgactctgagtactttcttttataacctccttggctccttgcatgtgaatatcttggtgtcaccaactcctagagtgctctttttaacatatgttcatttcataatttcattgcaacaagttgttggtaatggtattcatgataagctttacttatgagactatgttactaaaagtaacaactaatgtctctaacaaggaatttaagaatagaaaggtataaaactattgattttcatcttgatctccatcaactaattaacaaaatctttgaaagtgttcaagtatttgattatgctctgaccattcttatgttctaacttgaccaaccatctcacaaggtggactttgttcttaggcatcatcttttaatatttcatatgcaatggtatacgttagtatatttgatcaaacaagcttcattcaatgaagttaaaattcatatatagcttcactgctccagttaaaatctcctattctttgtcactcttttcttttagcttattctctacactggcttccaacaaaagtatttttttatagtcaatttgaacatatctttaacagaagtgcaatattcttcatcttgaatcatagtgtgataatatcatgttggataatttacgtttctagttgattgatacttttcatttttatttgattaatattttctgtttttatttgattgaccaaatcaaataatatttgatggcttaggcccagtccattgtaaactcaattcatcctataaatagatgagtaagggtggaggcaagacacacggaaatttgagagcctcaagtgacagtcttgagtggcatattttagcgagcttgcatgctctgcatttgagagattcttagagagtttgagtgaaacactctaggtttcgtttaagtgaccaccattgttggagaggttgagtgtaccaccacattggtgtattttttgattcattgtaacccataattgttatagtggattttgattctggactaggtcccatgagtttttcttttctcacattaagaaaggttttctcacgtaaaacatattgatattgattgtttctctcgctccctttggattttattttcgcttccgcaatttgatatttgagggtccaagatacccaacagtggtatcagagctcgggttcaacgggttctgaaggaatcgagatggagaccagcggcataactcacgacggagatatgttcaagttgaccgcagataacttcaacttttggaggtcgatgatggaggatcatcttatctgcaaggatttatatgatcccatagtctttgaggagaaaccgactggcaagtcggacaaggattgggagatcctaagtcggaaggtcgtggccactattaggaaatacattgacaaaagcctttttgagcacgtgtccgagttcacaaatgcgtacgagttgtggaacaagagtccatgattcaaaagaagactcccaggaacaaagcacacctgatccgccagcttgtgaagctaaaatacaaggatgacatgagtatgatcgagcacttcaacacctacaaaggtaatatgaatcaattgtccaaagccaatatgaaaattgatgacgagatgcaggctttgttgttgctgagttcgttaccgaaaagttgggatactttggtggtaactttgagcaactcgattccagaaggaaaattgacgatggatggcgtgacagacaaccccctgaatgaagaatccaggagaagagaacgaggtgtatctagcacgtttgaggctaacgttgctgaaaacagaggaaagactgactctcgggatcgtggcaagagccaggatcgaggtggacgagataggtccagaggctggtcaaggccaaagcatgatttaaagtgcttctactatgggaaggtaggacacaagaagtcagactacaggactctgcagaatgatgaacagaacagctatgtgaagccggatcaaattgttcccagaagaagaagtgatcagagtaccacggcgatggctgccaacccgaatgccgagatattcctcctcggtgaggaaatgttgaacatagcccatgatgactgcacctggattgttgactccggtgcctcgttccacgtcaccccacatgagggattcttctctacctacaggaagggagattatggtgtcgtgaagatgggaaatcagatgaccagcaggattgttggtgttggtgatgtaaccctgaccacagacacaaggtgtcgggttacgctgaaggatgtgaggtatgtacctgacatgcgtttgaatttgatctcggttggaaaactagatgatgttgggttactaaattactttggagaaagtagatggaagctgaccaagggaagcttagttgtggcccgaggaaagaaagaaggctccttgtatgtcatgcaaggaaagaccaatggcagggaagccaattctgtaagggatggaccaagcttggagctgtggcacaagcgcctcggtcatatgagcgagaaaggactccagattttggagaagaaagagctattgaccgggttgaagggtcaagtgttggagagctgcttgcactgcctagcaggaaagcaacaccagatttcgtttgtgagaccggatcaacccaggagacggaggtgtatacttgacatcgtccatactgacttttgcttcatgccgaagagatctcttagaggaacgtgttattttgtctctttcattgatgaccattctcgcaaggtgtgggtttacctgttgaagaccaaggactaggttctccaatcattcaaggaattccatgccatggtggaaagggagactggcaagaagttgaaagtggtcagatctgataatggtggtgagtatcgtggtccctttgaagcttactgtagagaagtcgggatccgacttgagaagacgccccccaagactcctcagctgaatggacttgctgagaggatgaaccagactattgaggagaaggtctgaagtatgctatcgaatgtcggactagcgaaagcatattggggagaggcagtgagaatagcggtggatttgataaatctctcaccatcgagaccactggatggagagattccagaggaggtctgaacaagtcggagagagacctatgatcacctaagggtgtttggatgccgagccttcgtgcatatccctaaggatgaaagggcaaagctggatgcgaagacgaaggagtgcatttacctcggttcgccaaaaaccgagtttggtttcaaactgtgggatccaatcaacaagaaaattgtgaaaagccgagatgtagtcttccatgaggatgagaccatccatgacatctcgaagccccaagtccgggttactgaccgaagagaagaacccatccctcgtgaaagtgctgaagcagggggagaaactagtgaggaaatcactgaaggtgatgttgaagatgatgaccagcaagaagctgataatgtcgggatccgagttaagaatgaagaaccgggttctgaaggggctgagaaacaacaacctagataccccactagagaaagaagatcttctacaaggtttccacttgatgaatacatcgtcattgttgaagacggtgagcctcagagttatgataaggccataatgagctcggaaaaagaagcgtggaagaaggcaatgcaggaagagatgaattccctgcatgaaaaccagacttatgagcagaccgagatgcaaggctactcggatgccaatttggagggagattccgactcgaagaagttgacgactggatatttgatgagatatgctggaggagcaatctcttgacaatcaaaattgtagaagtgtgtagcactttcaacgactgaggccgagtatattgccgcaactgaggcgtgcaaagagtttctgttgatgaagagatttctccaagagctcggccataatcaagataagtatgagttgaagtgtgacagtcagagcgcaattcatcttgtgaggaactcgacgtatcactctcgcaccaagcacattgatgtaaggtatcactggatacgagatgtggtggaggatggaaagctcacacttgggaaggtgcacaccagtcagaattggtctgacatgatgacaaagccggtaccagcaataaaatttgaagattggtatgaaggagctgggctgaggaactcggcatgatgaagccgaggtgagaaggtcgggttgttgaaattgaagacctcggtcgcattgaaaaaacggaagagggagatttgttggataatttccatttttagttgattgatactttccgtttttatttgattaatagtttctgtttttatttgattgaccaaatcaaataatatttgatagcttaggcccagtccattgtaaactcaattcatcctataaatagatgagtaagggtggaggcaagacacacagaaatttgagagcatcaagtgacagtcttgagtggcatatttgagcgagcctgcgtgctctgcatttgagagattcttaaagagtttgagtgaaacactctaggtttcatttgagtgaccactattattagagaggttaagtgtaccaccacattggtgtgttttttgattcattgtaactcatatttgttatagtgaattttgattctggactaggtcccgtgagtttttcttttctcacattgagaaaggttttctcacgtaaaacatattgattgtctctcttgttcccttttgattttatttccgcttccgcaatttgatatttgagggtccaagatacccaacatatgatttgaaccaagcaagtttgataccattgttaattaggaaatgttagatcaatttctcttttcatcatgtggtctataagatgggcaataagaaaatagatcaaaaagaaataacaccaagaatttttaaaaattaaggaaaatctctcaacatgagaaggaaaaattgcagtacctcttaattcaaataaaagcctcaattatgaagtaagattacagtggcttttgcttgtcaatttgattcttctaattatcacaggttttttattagtttctctaaacatcatgaattcccatttaatttttctaaatgttatgcgttcttatttgattcatcattcttaagagacatgtagatagatacttaatagacagcataaatgaaacacaatggaaaagattttttatgagaactaaattgtattttcttaaaaaaaatgggagattaaattgaaaatcaaaatatttaaaaagattaaaattatatttactattctttttaaacaatgtttacacccccacccacctttattatatttattgtttttcacatttcaatttcttaatgcatgattgtattgagtagttgaaactacacttggtggaagcaggttaagtaaactaactaaactgctagttgtgggtggttttgttcgagattttccatggtttgttggtatgattctaatctgatttagacctgctgtaattttaatttttaggtaagtgtgtactggggttggtctaaattcactgattataggagttgtcctaaattcaaccaaacggttgtacacttatgtcttgttgagttcataggaaatttatttaattattaaagtaaagtataacttttgtacggacggctaatattagttgcatagttagcaaaaaaatttagtacatgtttggcatttttaagtgatgctaaattttattttatgtagtatcatattttatttttaattctaattaattatataagtatataattattaaaaaaaatttccgtcatttaataattacaaattttatttttaagtagtatcataactatcattaattccaaagtggctccattgactagtacctatgatcaaataggtactttttttatttttattaaacagattatttttaattataaaaaatggtattcatgctcaagtcaaaacaatcgtataatttataataagaagaaataaaaaaatgtatgataatatgatgaaaaacataaaaagaacttggtgtaaaaaaacttaatcatgtgcattttcaatgtaaaaaaattagtttgtgaattaataagaaattattatttgtatgactttataaataattattataaaaattatactataaaactgttttacacttttagtttttctacaaaaatattatagaaaataaataaagttattctttgtaaaatgttaatgtacatcatattcacatgtatacacaaaaagatttataaaaaattgtgttttacataaagagtttaaataaattcagtgacaaattgagttttgatgtatttttcaaaatgttcatcttcgtacaaaagtaatagccaaaaataactattcaaaaagaaaaagaaaaccttctgattttgacacatgaaaaaaaataatggtaaaaactaacctgtgagcaacctagttatttttatcatttttcatacatcaaaagtatttgtttcttctgtcaatgtgaatattttattatagataatctatgaccgaaaatatatttataaacgcttattgatgagccttgaaatccaaaatattcaaactttttatgataaaaaaaaaaaaaaaaaaaagataaagacatccgttgattgatgtatatagtcaacactaacgtaatttttctgatttttcatcattttcttcattcatattttttccatttcctgttttattaaattttacttttacaacgaaaaatctttcttctttgttaagagttgcacgccatcctctagagtactaaattataatctctgatattaagtattaaggaaagaaggttaagcattaagttattaatccggatgaaaatatggtctcaaaatgggttatatatatttagttatttactaatgacatgttcatttgtgatcattttaaattattttattttctttttttaattaaaacaaaagaaaaattctcaaaaaaaaaaaaaaaacaaaagaacattaaaaaattaatccatatttgaattaatttattttaaaaataaatattattttgaaaaacataaaaaaaaaaacccgtaatttaaaactgaaacaaataacacatgccaactgagtttttcccaaagttacgcaaccaagctcaagattttcaatgaaaaacaaaatcgtgaaaacagatgtgtgagcaacctataatttttatataaatattaaagtatggtatcttgtttttttcctttttatttaatttgggaaaaaggtttatatacctgctttttgtaagcagctgacaaagacttccgttgacatacagccaaaactaatgttagttttttctgttgcttcatcattttcattgatacttttatttctcctttatattaacttttacttttcataagaatatcttttgcatgttcataaccttttacttttgtcctgaataattcgttcgttaattaagtgttccaaaaactagttcaactcagtttagccaacttggtaaatcagtcttacaaaatagatattaattaagtcctctcatatgaaaaaaaagtattatgatcccttaattttcagtaaacattggttcctattattactgtttcttaagcttcaattctgaaaaacttaaattaagttttaatctctatccgtctttgtatagagctaaaacttaagattctttggtttaacaaagtgttttctattttcatttttatcgtgtccatatgtttgtatagaaaattgtggaaattttttttttattgtttttgtttttattttctatttttactcttttttcctgtacaaacatcaacaaacaagaaacaaaataaataaaaaaaaaagaaaaaaaaaacatttttcaaaccaaacaatttatttagcttttttttttttcttcacgcaaagactaattcttagattaatgtcatctttataggaacttagctcaacatacaaaatatttaatgtaaagctagtacaacctaataattaactcaaataacttaatcacaatgtcatatttatgcatgagaaaattgaacttataaacatatttaagtaacatagttatctatcatctgtattgatgatatggctcgcgtttaatattatgaagatctcccttaatctaaaacagaaacaatctagtctaaaaacaaaaaaagtcctgtggtagcacacaacagacacaaagcaaaagaattacaaaagaatactgattttggcgacgtcatatcagaggtggtggtaggttccaatttggcaaatggttgcactcaatatttcaaccgtgtaaacttaacgcgttgaataatcccatacacgtcccattaaaaatgccattgccatcatcatcaaatacccaaacttccaatatctttaatttcatcaaattcactccattaacattaatgccataacataattcattgccatcatcatcatctccatgtcctaattgcttttgctttcaatattcattcattatcactacacaaaaactatcagctcactcaactgtgccttatcatgccctcagattatgataaactagagccacttcatgcaaccccacaaacaaatattaaccggtcacaaaaaatgttaagtccagaaaacaacaccctcaaggtgcatgttgtggaggccatgttgttgctacccttcttcatggttctttgaccaggatttgtgacacaaagtggtggaacaacctatgccaaaatgggacaagaagaaaaaccaagcagatcaagagttcttgtgttgtgtttcatgacatggagggtgtgcaactctcttccaagattggaaaggacagcaacattaatcatccaaggattttcagctatgctgagctctacataggatcaaggggtttctctgaggaggaggttctaggaagtggagggtttggcaaagtgtacaaagctgttatgcctagtgatggaacagcggtggctgtgaagtgttgcttggcagggaaaggtggtcaatttgagaagacttttgctgcagaacttgcagcagtggcacaccttcgccacaagaaccttgtccccttgaggggttggtgtgtttttgaggatcaactctaccttgtgtatgattacatgcctaattcgagccttgatcgtgttctgtttcgaaagaacttgaaggaggagccacttggatggatgaggcgtaggaagattgtgaagggtttggcatgtgcattgcactatttgcatgagcagttggagactcaaatcattcacagggatgtgaagaccagcaatgtgatgcttgattctcattacaatgctaggttgggggactttggcttggcaaggtggcttgagcatgagcttgagtatgagtatgagacaaggaaagaatcaacatcaagaaagtttgagcattttaggctgagtgagacaacaaggattggtggaacaattggttacttgccccctgagagcttccagagaaggagcattgctacctcaaaatctgatgtgttcagctttgggattgttgtgttggaggtggtttgtggaagaagggctattgatctcacataccctgatgagaaaatcatcttgcttgattggatcagaagacttagtgatgaaggaaggcttgttgctgctgtggacacaagggtaatagatggttcctacaaggtttttgaaatggagcatttgattcacataagcctcttgtgcacactccatgaccctcaattgaggccaagcatgaagtggattgtggagacactttctgacatgtcaaacaagttgccaacactcccttcatttcactcccatcctatgtacatctctttgtcctcctcttctgagactagtccaaacagcacaaaaggcactggcacaaggtcaggaacagaaattgctactagcactagcaatcatactagttccaattccaaatttgtcacagccacaggagagactatatatgcaactgctgaagctaaacacaaaaacagtggaactagctcttctaagagtagcaagagagtgatgcatcatcagccatcatttgttgaaacacctagggagataccatacaaggagattgtttcagccacaggtaacttctcagagtccaaaagggtggctgagcttgactttggaactgcataccatggcatccttgatggccactaccatgtcatggtgaaacgccttggcttgaagacatgccctgcattgcgccaaagattctccaatgagctaaggaacttggcaaaacttcgccacagaaatttggttcagcttagagggtggtgcactgagcaaggagagatgcttgtggtgtatgattactcagctagaagatttcttagtcaccaacttcaccatcataacaatggtattataaatggtaattctgtcctcaaatggcatcataggtataacatagtgaaatcacttgcatctgctcttctctatctgcatgaggaatgggatgaacaagtcattcacaggaacataacctcttcagcagtgactcttgaacctgacatgaccccaagactaggtagttttgctctggctgagtttttgtcaaggaatgagcatggacatcatgtaatcaccaccaggagcaagtcggtttgcgggattttcggctacatgtcaccagaatatgtggaatccggagaggcaaccgcggctgctgatgtttatagttttggtgttgtggtgcttgagattgtaagtggacttaaggctgtggattttaggcaacctgaggtgctattggtaaagaaggttcatgaatttgagatgagaaagagaccagttgaggcactagcagatataggactaaatggagagtacaattacaaggaactaatgagattggtaagcttaggagttgcttgcaccagttctaacccaaaattaagaccaagtactagacagatagtaaacattcttgatggcaatgacaaattaatcatgggggagaacatggagagcaaggaagattggagagaaagaaatgcttgctctttgtcattggttaagagaatccaagctctaggaatacaatgaaaagttgcataagaaaatgaaggaacaaaataggaaatattggtttgtaacatagagaaaccttgtttgtaacataaagagttttattttttacattgtatctttgtgctttggctatttttcataggggtggccattggtgtgggtcgatctgatcaacccgaaccaaacagaaggggaaaatctgggatggttgtaacatatatgatgatatgtaacttagagaaagctggtttataacatagagagagttttttttataatttgtgctttgggtatttttaagcttgttactttttagctatgcttgattgtatataacagcgagaaggttaatgcattagtgtatttttctgctaaagcaggacttattctatactttttagtttttatatatacatatttagacatccatatttttcaatgtcaagaacatattgtatacaattttgccataataaaaatttcaagagaagggaggaaaagattctgatttgagcaaattcaaggctataaacattcaacacaatgtaacatcaaacagtcttatatgcagtgtaactctccttgtgtaattatattcatccaaatcaaaccattttttttttatgaaactgaaatgggggatgaatcatgaaagtgaccttcctattcttgaaccaatccatttcttttgtgaggacgtttaacagaagggaagtcaaagcaaataaatggaaagaatgagggaagaaaaatggaacagtattaaaactttctccaagctttgttagcacaatagcacctcccttgatgcatgagactatacacagtgatgaatatattgtctccggttgttaaaaaaaggagggactttttttttcaattttaattagtagcaataagtaataaagaatttaaatttcctcaccttgtggctgtggactgtggtgactagtttggtgtttaattttaatttcttccgctataaattttgaactgataagtgatatggttgtatccggaacctgaacactagcaactgcataatcaaagagatttgctaaactcaggtttgtgcttgattggattttggtatatgctttccttctgagactatgttactaagagtaacgactaacgtgacccaattaagaatagaagaagggtatgaagctattgattttcaactcgatctcctaattatcaagacctttgaaagtgttcaagtatatgatcatcctatgaccatttttatattctaacttgaccagtcatttcacacggtggatttgttcataggcatcatcttttaaatcatgaattcgagtattgtccatgattcttatacaatgttataggttaatatatgtgctcaaacaagcttcattcaatgaagttcaaaatcatacatagtcattgctcttcagttaggagctcttattctttgtcaattttccctttttgctttattctttcttgtttgtaatttgtttgtgcaaatctttgcaataaaattgattctctatcatcagcttccaacaaaagtaattttcttaagtgaatttgaacatatcttaaacacaagtgacaatatattctttgtcttgaatcatagtgtgataatatcttttttttttattattattcataagaattgaattcaggtaccaaagagttctctttatatgtggtttaccatgagcaataagaaagaaataacaccaagaatttttaatatgaaatatccctcaacttgagaaggaaaaattgcagtacctcctaattcaaataaaagcctcaactaagaagtaagattacagtgacttctgcttgttaatttgattcctctaactatcacaagtttttcatttgtttctctagatataattgattcccatttaaattagtagagttttctgctaaagctggacttgctctataatctatactttttatacatagatattcggcacatccataattctcagcatgaagaacagattgtatacatttttgccataacaatttcaagagaatgaaggaaaagattctttctgatttgagcaaattcaaggttatacacttatacacgttcagcacaatgtaacatctgtctttctatgcagtgtaactcttcctatgtgatgttaagtatattcattcaaatcaatcccaactcttttgatgaattcttgaaccaatccatttcttctgtgagtaagattgacagaaaagaatgaggaaacgaaagcgaaactgttttaaaactttcttcaagcttttttagcacctcctctgatgcatgatgacattatacacagtgatcaatataacattttcaagatcaagtagaaatgcacaatattgagattctgctgaatacgtaattagatgatggagattctaatagagttatcagatgcatgtaacttttgatgaattttttaaggaattgtcaccttagtaaaataaacttttccgcaaatttacacttggaggaccaataaacgtgcactttcagaaaaccaatgcaacaagagtctacaaatttaaggaccaaaactgtacattaactcacactaaatgcattaaattgtatgcacctgccggcatccacatcacagtaattagaaattataaagagagaaaaaagagagttacatacattaagcaaccaaccaactaaacacaagtcgacagtttaaacacgaagaaatcatatataacctccctcttcttccacattctatcaatttaccaaatgataaaaaaaaaaaaaaaaaaaaaaaaaaaaaaatctatcaatttaccaacatcatacgtgcttacaattaagcttcacaaaatccttgaataccataaatttgcaaagcatttgctatctaatagtaattctgatcaaacacaaattcttcaaattttcgtgcaatactctttgtgttcaactattatcttaccccagagatatgatagaaaatatgatataaaatataataatttttggttttcaaggaaataaagcataacttgaattatctaggatcattttggtctttaatttaaaaacgtagaaaaaattattaatatgatagaaaatataataattttttaagtaaaatattttacaccacaataaaattatatattttaaagaaaaaaacataatataaattgactttgtttttactggtcaatcaaactcttacacgaactcatgcgcattgctaaaaaaaaaaacgaagtaaaaaaatactcattttcttgtaaattaacttcagaaaacattttctttcgaaacatttataaaataagccgaaatttggaataaaaaaatactcattattcaacattttctaaagaaaataaaaaaggcaagatgaaatcacagtaacatgaattgtattgtcatataataatcattaatcacaacttctttctgttgttttcttcatttatcccaatcccatcgtctctgatagtttaggtccctcttcaatcttcgtctcatttcacgtccctccatctttttgtttcttttacaattctcgttgtagaacttacgttagctgaaaatgaacagatcaacaaaaacaaagcaccctagtaaccttagtttttttaaccacatgcacccaacacctgtttcaaaattaaaatataaataaattattatcttgaaacaaaaataataggtgagacccattttttaagctatatagttaagcaataagatatatttttaagttaattaattgacaagttttggtgaaataattaatttataattagaattagaatcacggattcatgcatatatatgtggtgccccttgttctctagatgtcgattcatccatcttggggatagtttgatagctgtttccatagatctctatacagtaataaaacaacatttttctgcctacgtgtccagttgtggtgcattttcagctttggaatccaagctggcaggctcacaagaaaagttagcttgggatgctacatggcagctgtgcatttggtctcattttctcggccattccaagcctctgttgggacatgcaatccactgactagctttgatcacacactcttcatcattcaaatgagacgaaatgcagaggtgttcactggtttgcagatgtcttcagtggtttgcagaggcttttatttacgttacctactgttttgtggttcaacaaagctagatgttaactctgttacggtatctcacacagagcttctctttcccacgcctcttcatcattttcgtgagcattttcgtcttccatctcctctgtttgttttcttggttgttttgcttttgcatgtataaaccaatgccaaattctgcttgtctcattcttcattgtcatcgtttttgtgttggtgttgatacaaggtattcatccccgtcccaaaattgatatgtatatggtctgtttattcatttatatggtggatatgctttgtctctttcttttcttggttcttatccttttgcatgtatgttcgatttatgtctgtttcttttttgggttcttatcctcttgcattagttgttccagcagtttttgttgatatggtacttcacacacagcttctgtttcccacgcctctgcatcattttagtgagcattttcctctttgatcttctctctttgtttttatggttcttttgcttttgcatgtataaaccgatgccaaattttgtttgtctccttcttcactcacatcgtttttgtgttggttttgatacaaggtattcatcaccgtcccaatattgatatgtatatggtctgtttattcgtttatatagtggatatactttgtctctttcttttgttggttcttatccttttgcatgtgtgtttgatatatctttttgggttcttatgcttttgcattagttgttccagcagtttttgttgatattcatgttttttgtgttgtgttataggctaacataaatagattgatccagtgagatttggcataagctcaatggcgggtggtaatcaacaaatcctacttatttatttaaactgtatttgtctgatttattttggctgattatataagattacatttatgagtagtaaccacatcatgttgtttgttcaacaatagtgttgcgtaggctgaatttgatatctgaaatcaatgataaaaaggaaacatggaaaattgttgtgcaggttataaacttgtggactattcccagatcaagtaggcatactgttgagcttatattaatggacaaggaggtatggttatttacaaatgagaaagcattttgtgactatgtgctgctgttagtttatgatgtcaggcaagttattaaactatgacctgaaatgttccttcgtcagggtggtaaaatactggctcagatgaaaaatgttgatatggaaatggtgaaggacacctttgagattgggcaaatttatgttatccaaaactttgaagtcgaaaagaatagtggtcactacaaggcaaccaaccatgcgttcaaaattaacctgcttaaagccactaaaattacaccatatgacctgcctgaaatgcctcttgccaaatactcattcacaaagtttgattcgattctggatggctctgccacaccagactatttaataggtacatagggttgtaattgtttaattatcttctttcctgtattttttttttgtgcaggtgcttaattatgctttatggttgaagatgttattggtgagttaattgaaattggtcattggaacctcgatgggaagccaaagaaagtctcttttactatgaaggatgaatggtatttttgactgcctcgaccagttttttaaaagataccacacctgtttttatatctgatttgtgattttttgtgtggttattatgtttcagtgggactgatataaattgtaccttgtgggaggaacatgctatcaaacttaaggactgtcttgataaacataagactggacctgtggtattggtgatcactatggcaaaaatcaaagaagctagaggtttgttgcctatggcaaatatttgtttcccttgactaaatcacaaccctcctataacacattatttcaataggttatacgaaccatttattgcagttaatttttctagcagttagctgttctttctgtggcaaacctgttggggtgaaagtgaaattatttgtggttttcatgatgacagttctattggtagcatttttcaataatgaattgtttatttaatctttgatgtttgttttactttagacccagcttttccttattagttcttccaaaaaatatatatttctagctgattatgctgtaatcaacaacctgttatgtttaatatcagatgctgtggatgatgatagtttgatcaattttggcatatttgttggctactggctgttgcttgaacaaatgattgtcgaatgctaaggtctgaaaatggatcttacttaaagtgatgaacaatgagaaaactggtcatagggttggttggtaattatcatcattcaagggttttctaataatttggatcgtttggtacctgacataaaatggcccagatctaatagtgacaaatgagccaggacagtcttaaagtagtcactggccattagctgttggttcacagataattatagaatctacagtataataactgggaaacagatagtggattaactttgttgtttgaatacaggtccttatcctatttcaatccaaaattcgatgtatggctctcagatatttgtaaatagcagtatgaaggaaatcattgatttcaaggatcgattgatgaccttgtaattatccaatgtctcatgttatttactgtttactacaataatgttatagtttgagttatgtttaatttaattatacaggatggatccaacccagtcaacactgggttcctatacacaaacctctagccagatttcgggttcttctcagtattcaaatggagatcgtttcctgcacaatgcaaaaatccataatttatttgagattgccgaactaaaaaaggtgcatttttaaccttatgattttctttatttatattttttctcgagctacattcaacctttgtcgtcacctctattaagtttacaacaggaatgtatggttgtcactgtgggtaccatccagaagttgcttatagcaaatggctggtttatgatgcatgtcccaaatgtaacaaaaaggttgattcattggagttgcctgttatttgtggtgggtgtggtaatcaaagtgcagccactatgccgaggtaggctcagttagagattatttatgtacagaactcattttctctaactgaaaattctctaatttgggaatttgtaccataggtatcgtattgatgttcgtgtcactcaacaatctgaatctgccattttcaccttgtgggatcggattcatattcgttaattaaagagatgcagatgagataataaagaagattattgctgaggttattgatgatctaaattttatatcacaataatatatgttgtcaatatgataactgatttggtggactgctgtgtaatgtaaattacatttttgttatcgtaggaaggagagtttgatgcaagagatgtgccagaggctctggatcgtatgctaggaaaaacattggcctttaggttcaaatttgtgcctggtaataaacgtcattctgtgtcactaatatccgaagatgaaatggtagtcagcagtgtaatgtcacgactttctacaattcaggtaaatgtttgtttatttatgttacaacttttgtatatgggttgtgaacagtattataaatgttcagtttgttacttactatatgatttctttgtattatgttcaagtatgaagctgatctatccatatctttgctgcagcaaaccaatgaggttgttcataatgtcaactgttggttcttgtggtgtttgtattttcaaactaaatttcaggatgccaatgattaatcaatatttattgtattttcgtgcagcataccttctcagccagtggtgattctgatggaaacctgaatgagtgcatgacaccggcaaagcgcaatttgctgccatctgattctgaattggatatcactgcttttgaagatttgtcacaaattgaaatgtcttctactaaagtggccaaacatatcaagactgagtgacaaattcttgaattggcgttgcattttgtgccatttgatgacagttatgtctttttttgcattaatcaagtagacattgtattgggattaatgaagtatgcaatgtagctattacagacatgtgacatatttgtgtgcttagtaacagatatttataaagaaatgttatctatattaatttgtagtttttagattgtggttgagtaacatcatctgttctaatttactgcagctatcatatatgtttagccttggaaaatgtccttaatcaatttattgttaccttcttctgctcaacaattcctgcaagaattcagctttgttgccattgaaaatatactcttatttttaatcctacttctgctgtcaatatacttggtgtaaatatctggggaacttggaccagttattataggagagaaaaacattgtttaccatatccttaagcaattctatttttaccttctgacctgacaagcatataaatgtgcttatttttcatactgctgccacccactggctattttgactatcatgtttcatgtcgtctgattgaagttaaactcacaatagtttgatgcatgccatatatattttcagaggaattaaaaataggactgtctcttaattgcttgcaagtcaaaatatcgagtcatgcatgttgcagaggagtgtatttttaatcctacttctgttgtcaatatacttgatattgggtatggcctgagcctaataaaatggtcaaatatcaagtccaagctgcatcagattcaaaaatcagcaatttatcaatacaccaaaagcctcttcatatcttataggtgttgaatcattcatattaatcaatagttcatgaatatatttttatagttttgctgaagaccaaaatttagacagcttaacacattaaacttagagatcataaaaacagaaccccaagataattatctatatcctgaaggagtaacttataccatgtttactatattttgatcaactgatgcaacctatttgattgaaaatataatgtatattgtatactgctcttataatgtaggctatttaaaagaaaataatgcttacattttccaagtataatgtatactattgccaagttcttctatctaagtagtcaaactcagagcattgaagtttactctgcattgtagtttctgaatctcaacaagtggaccattatttcaaagtctagcatttgttctatttaggtgtatgaccttgtgtttcaataacagaggaaggagttgtttaagtagttaaggacaattagttactaacttgcaataaagaacccagtcaaaatctgatcacgtcaaagataatgtgaaccaagcaaaatagtaattaataaaaaattaatgtataactaactgattgcagtcagttcttttgctgcataaatccaccaaataattaaaggtgttaaagtgtttttcgtatttatctctgcgggtgtgaagaatgcatgattcctttggtcaggatatcacatttctggttcaatgaacagtactattgcaaaggatatgaaaaaatgtttcagaatattttttgggaggttgttaagagtgatggatgtcaggcaatattccgatttgtgcatgtttcgctcagcaccaaggatgcaatcataggataagtgaagttaattaatttaaattacttttttactatatcataatgtaaattattttagctccatttttttaatgatagaaattacaattatcatttactgtaaaaagaattaaaatataattatatatcaaacaatctacaacatttgttttttattagatattaatttgttttaaacttttatcatatcaaataatggataaataacaataaaattatgtggtgacattttaagcacagataaatttgttaatagttttgtaatttaaatttaatcaagattctggttttttaaaactgtttctatttaatttgcgtattatggttatctacatagtaatatttaatttatatatttattgaaaaatgattgtttgatttctttgttataggataatcaaatataattagttaagattactttattagtaattttgtataaatcatgatttaatatcagttattcattatatgctaatttgtcacttaaataaaatctcaagcattggatggttgatacaaatctgatgttattaacctgttacgccagtaccatacaagttaaagcatactggttgcttataaaattcagagtaacttgagaggtttaaatcagtgattgcttataaaattgaaaacaaattaaaattaattaaactatatttgagatacaggttacagtgcattacaaaacttcaatttattggctgaaatatgaaggtgtatgcaagttatcgttaaatgtgtaaagatatcactgataagaaaaccagcaaggtaattatgatgatagcagaattgtgcactctgtaaacctgtggccaatcatgatacgtaacccataacccctaaaatttgttgatgattgacaagcaagtactgctgacttctagttggttgctgctatgtgatttcatttgttttgattggttatttaaagtagataaatgccatgactttgtactgtccacttatttggttcagcaggaaattggtcaatagattagaaaaagtacacgagtgccattttgttattataatattatgtgaacccaaattaaacaaaaatactcagaatcaatcattgccaatttttgctctgaaaattaggatttcaataccactgtccaatacctcccattccttgagtattacatcaaatgcaaggctcatagaagataagcaactttccatgctaagttaagcacactaatatccagattaatggttctgttggaactgtttataattttattgtgaaagttgatcatggaagaagacagttgtaatgcaaagatttatgctaaacaagcaagattaaaacggaggctcatattaagagaaaggagtttcagaaaatatggtcataacagtggtcaaagcaaccacagtgcagatggattacaggcacaaaacaatggaatgtccattaaaagattcaaagttgttaatagcatgctattagcaagtgcttctgaaaccacagaaaaccagttcagggctattaacattgaccatgaacaaagaaatgagtcccattatcagccacattcaatctgtgaagagacggttaaatatacagattaggttttgcatgatacaaatgtaaccattaacagagtggggactcaaagtgcaggtaactataatggtcatagtgcctattagattctgtaacaaatttgaataataggctacctgtactcactggttatgtgtaatttaaaaggtgtggcattatagtttgattgtaatattggtaaattgtatttgaaatggaacaaagttagcaagatattctcaaaccagtaaacagtggccatgcattatgttaagatatacgattaagtgttttttcattgatactgttatgatgtcaaacttaaggtgtgtcctaaagattttacctaaaaattatatgttgaagctgcaaggttacgtcgaaggaacataatgcgaggaaagcgtttattaaaagttaatgaaacaatttctgcaatgccgaacaatagcaacaaaaataaaggtattgaatttttccattgataaaaacattctattatttctgtgacaagtgttgaggtaaaaccctaactgtttgacctgaataatacataatttttacattcagcaggaacattatgcatagaacggatggataaggtaacaaatggaaatatgaataatactccgccacaatccaatgattttctgaacaggagaaagatatatttcaggcagcatacagcagtgaggcgcaatttacttgatgaatttgttgttgcctcttcaataaaccaaacggagcaaactgttcaaaatgataacagcgctcaaactgaagatacagttggaggtaacagtaatggtaacattagtacttattcatgacattaacatgtttcacttttggtgtttaattgagggttttctttgtaagatggtttagacgaatgtgattaacgataatgagatgttggctttgtacgcagatttcatttatactcaattcacaggttccttcatgtgtattatgcagatagtaatcaggatgtacctggtccatccacggaagatgcagtttcagatagtagtgatgattattctgaccatattgggacaggtctagatgtgtatgactaattaaaatgtttgcattacatttgtgtactgtgttttgattattatttgatttgtaggatatgttgatttgggagatcctgctcaaatgtgttcctactgtgaagctgctatgtggagtgcagaaagtaccaataagagcaaagatctgagtaaagccagatataatctatgttgtcggggtggaaggatacaacttccttttcttaaaaatcctccaaggctactgcaagatctattatgtgataacgattcaagagaaagtctaaattaccaagacaatatcagatcttataacatgatgtttgctgtcagctcttctggggccaatatagatagatctttattaaatggaaaaggcccaccaatatataagattcatgaacaatcatgccatctaattggtagcctactacccatgcctgggaaacctccaaagtttgttcagctatatatatatgacactgaaaatgaaattcaaaacagaattggggcagcaaggttagctctattttgtcaatgttaattatgtgtggtgtgttacacatttaatcgaaatccaaacatgacatctggatgtgtattctgttttttagatgggaaaaacggcttgattcacagcttgtagcaaaattgaaggacatgcttgatacgcacaatgtgtttgctaaatctttcagaatggcaaaagataggtataacagttgtcaaacacagaatataaacttgcaattaatttcagatagaaaaaaggatgggagaatatacaatttgccaacaatttcggaagttgctgcagtcattgttggagacgcaactgaacctataaacagggatattattcttgaaaaacaaagtggtcgactgcaaagaatcaatgagcttcatccaagttatcttggattgcaatatccattgctatttccttatggtgaagatggctaccgcaatgatatcaagcacagagatatgcaaggctcaaatcagagaacgagaaacaaagtgactatcaaagacctattatgctttaggctacagtctagaaaacatgaaggtcaaacattattgaggtccagaagattgtttcagcaatttattgttgatggttacactatgatcgaatcagagagattgatgtttataaggactcatcaaaagcaattgcgttgtgataaatatagtacattgattgcttctcaaacctcagaacagcggcattcaaattatgggaagcgtattgttctgccttcatcctttgttggtagccgtaggtatatggatcaattgtactttgatggcatggccatatgtagccaagttgggtttctgttgatttgtaggtgtgtctaagagcaagctcatctctttggtaccttgatagtggatgctcaagacacatgacgggtgacaagtctctgatcaagaatctcacatttaaagaaggaggttttgtcacttatggagataacaacaaaggaaggattatgggtgaaggaagcattggtgacaacttaaacaccaaaatcagcaatgtactttatgtggaagggctgaaacataatttgcttagcattagtcaactatgtgacaaaggctacaagatttccttcaatcaagattgttgtttgatttgtgatagtaagagtgataaggtaattcatataggtaagaggaaaggtaatgtgtatctattttctattgaccatgctttgtttcacaaaactacatgtttattaagtaaattggatgaaacatggctgtggcataggagagctagtcatataaatatgcatcatatgaataagctaattaagaaggacttagttattggattgcctaaactcaaatttgagaaagacaaactgtgtgatgcatgtcaaaaggggaaacaaacaaaaatctcttttcaaagtaaaaacattgtttccacctctagacctcttgagcttttacacatggatttgtttggtccttcaagaactatgagtttaggaggcaattactatggacttgtcattgttgatgatttctcaagtttcacatggactttgtttttgaaatccaagagtgatgcttttcaatcttttcgaaaactagccaaagttattcaaaatgaaaaaggatgtaaaattgtttcaattagaagtgatcatggtggagaattccaaaatgaagattttgaaaaattctgtgatgaatatgaaataaaccacaacttttcagctccaagaacacctcaacaaaatggtgttgtggagaggaaaaacaaatcacttgaagaaggtgctaggacacttctaaatgaaacaaatttaccaaaatatttttgggctgatgctgtcaacacagtttgttacaccttaaacagacttcttataaggcctattttgaagaaaactccttatgagctgtacaaaggaagaaagcccaatgtttctcacttaagaacctttggctgtaaatgctttgttttaaacaatggaaaggaatcacttggaaagtttgatgcaaaagctgatgaggctatatttcttggatattcattacaaagcaaggcatatagagtttttaataaaagaaccatgtgcattgaggaatcagttcatgtaatatgtgatgaatctaatccctcaaaagaggaaaaagcttatgatgatgatgtaggaatttcatatcagattactcaattagagaaggtatccataaatgagaaaaatgaatcaagtactgaagaaggttcatcagcatcaaaacaattgcctaaaaagtggagaaccacaaaggatctttcactagacaacattattggtgaagtatcaaagggagtctctactggatcctcaactagaaatttgtgttgtgacatggcttttgtttctcaaattgaaccaaaagatatcaatcatgctttgcaagatgaacattagatgcatgccatgcatgaagaattaaatcagtttaaaagaaatgaagtgtgggaacttgtccctaaacctccatccattaagcctattggtactaaatgggtttttagaaacaagctggatgaaagtggaattatagtcagaaacaaagctagattggttgcaaaaggttacaaccaagaggaaggtattgactatgaggaaacttttgctccagttgcaaggctagaagctattaggctactgcttgcttatgcatgtatcatgggttttaagctttttcaaatggatgtgaagagtgcttttttaaatggctatattgaggaggatatttatgttgaacaacctcctggattttctgattttcagcatccaaatcatgttttcaaacttaagaaagccctttatggtctgaaacaagcacctagatcatggtatgaaagattgagtaagtttctacttgatcaatcttttataaggggcaatgttgacaaaaccttgtttataaagaagcaaaagaatgatattttgttggttcaaatatatgttgatgatattatttttggttcaactaatccaaagctttgcaaagatttttctgcagcaatgcaacaagaatttgagatgtttatgatgggagagctgacattctccttaagattacaagtcaagcaattgaagaatggaatctttcttagtcaatccaagtattgccttgaagtaatcaagaagtttgaaatggacaaatgcaaagatgcagcaacaccaatggctacttcaacttatcttgattcggatgaaaaaggaaagaaagtagatgaatccaagtatagaggaatgattggttcattgctttatcttacagctagcagaccagatataatgttaagtgtttgcttgtgtgcaagatttcaagctaatccaaaggagtctcatctttcagctgtaaaaaggatcatcaagtatctcaaggcaacacccaaagtggggctttggtatcctaaagatgcatcaatcaatatcattggctattctgattcagattttgcaggatgtaagcttgataggaaaagcactagtggaacttgtcatctccttggaagttcacttatttcttggcattgcaagaagcaagcttgtgtagctttatcaactgcaaaagctgagtatatttcagcgggtagttgctgtgcataaagtatttggctcaagcaacaattacaagactatggagtagagttaaaggagatcccactactatgtgacaacacaagtgccattaatatttcaaagaatcctgtgatgcattcaagaaccaagcacatagagattagacatcactttataagagatcatgtgcaaaaaggtaacattaaggtagaatttattgatacacatcatcaacttgctgacatatttactaaacctctgtctaaggatagattttacactcttagaaatatgctaggaatccttgatgaacataacatatgctagcatgagtatgatatggtttatgtgcaactttaaatgcttacttgcctttatcattcatagtactaatataaaaagttgtattatcatcaaaatactctgattcaatactctaaaagctgtagtgttagtgttatactttgtatccaaaactagcaagttgtgcaaaatgataaaaaaaattctattttctgcttctcgtgctgtaataatcgattaacagtcgggataatcgattatcttcattaaaacccaagttttgttcgaaaattaagccattgtaatcgattacccaagttttgtaatcaattacgcttcacaaagcttaaaatgtgccactctggagtaattgattacctattgggataattgattacgacattgttaattcaactttgaaaaactaagtcgtgctggaataatcgattatcacataagctaatcgattaaattgttcatactcaaggtttaaaatcattaatggtcaaataatcgattacattagcattataatcgattacatatcatcttcaacctctggccatatgtttagtaatctaagcatagtataaaataatcgattacatttggatataatcgattattaggacggttatctgaaggtttaaacgtatttatctgccgtcaaaactgaccactcagtgtctatgcaacttccaatgccttaactcgttttcaacagttacatcttctgagatgttgactactgaactgcctattatcccttataaatagctattgccagccttaggaatatctgcaccaagcctccctttatctcttagtctgagccttcttattcaaaccactatggttaaaccttggaagcctggagaattatcttctcaggaccttaaggctgagaccatgctagagcttcaaaaggatatcaaggctagattgtatggagccttgaaagccattagagagagattgaatattattaaagaaaaatataaaagggcacagcatcagcaaatattctagaattcattagattttgtctgatttgctttctagaattaggattcacttgatttggattttgctagatccgctctctatgtaataaatctagatttagtgtttgtctgatctgctttctatctgtaattctcagtttacatcaataaaaatcctgttttgtgtgtactctgtttttctgttttttaattcagcatttaaatgtactcctcagcttctatgaatgaaatttatgctttctgttcatcaattatccgctgtgcattcaatttttgactttaaaaagccaaatagggggagaaaaattgaaaatcaaacgaaaacgcaagtgctctgcatcatactctgttcacctctgtttttcgtgctattttttaatcaaaatttcagtggcatagattgagaaatttagggggagttaagacttgaaaatgcttgttaaggatacatatataataagaatgaataatgatcaaagcttagatatctttaacatttgttcttggaaagaattttttatttttcaggtgataagcacaagtacaaaaatactggaagctttctcattcaatcacaaagacccattgtttttcaattggaaatttggcatgtttaaagccaaaaagggggagattgttgatttgagggggagctgaatgaagatcaagtgagatcaaccaaggttcaagacttggaagttttggctttcaacatggttcaagcattgaagatgttgtttgtgatttaatgtaaaaggattgaaagcatcatgatgatccaagccttgatagcattcacgtatcatttaagcattgcatcatagagaagttaagtaattagtttaaaacttaagaaaaagctaagaaaacagcatatagtcgtaataatcgattactggcttattctaatcaattattttgttcttaagactcctggaaaactaaacatgaacactttaatcgattaccttaacggattaatcgattacacacatctcaacatacttggaaattggccttgtgactgctttaatcgattaccatgatgttgtaatcgattatatgcttacttggaaaactcagtcactctgccttaatcgattaccaatggatgtaatcgattattcttcacaaacatgattatagcataggactgccttaatcgattaccaatagatgtaatcaattatccttcataaacacgattttagcataggtctggtttaatcgattacaattgaatgtaatcgatcacacttcacattcagaatttttgcccagactggtttgatcgattgcgcatcgggttaatcgattatttcacccgttagttgaaatcctgatcctgcattaatcattttaatcgattacaggagcgtggggagcgcatttaatcgattaaattcgttacgatttcaactataaataagaccctttgcctcttgagcgaatagaactaagagagattataactgaagtaattttttgcgaattctgagtatttcctaaaggcttctaagggttcactaaagcttcatctgggctcttgagtcttgcttccattgatacattaatggatcactaaggttgttagtgaagcaagcttgttttgttacaaaggcttaggaaaggtttctgcatcattagtttacattcaacctgaagtttttcattcatatgcatttcaatcttggataatcaggtgaattctttcctagctctttgtgggtattttgttttctgcagtaactttgtaatttgttgattatgttgtaagtgggttttcttgcaagggagatagggtttctccatgttcaactgagtaggtttctcagtgtgggtttggcttctaaggatctaatagagttttagatctctgaacttcttctagggttgaagaagagaagcttgtaagtacttgtaagaaaaatatttacaatagtggaactctactctagtgttgagtagaagaaattggatgtagcctcatagtgtttgaggtgaaccagtataattcttgcatcttgatttaatttctgcagactttattggttctagttaaactctgtttttgtgtgtttaaatttgaagcataacaagtcttggattgatcttggataaagatattcatttggttttatgataaagatccaaagggcatttttaactctgattttaaacaaagaaatttcaatttcctatgattaaccaattcacccccccctcttggttaagtgtgagtgttccttattttccacagttttctgatctgttcttgacattgacatgtaatccttattggcctaagattcaaagggttgtatcaccaatgaaactaactgcggctgatcgccagatattgtgagcagggtttttaaacttaagcttgatcaattgatggttgacttgaaacataacaaagtcttaggcaatgttgtggcatgtaagacatttagaaagctttgcacatgttaaatgtattgtagatttatatgttctatgctgttaaaactaatagtagtttgtctgcagatatttacactattgaattccaaaagcgaggattgtcacatgctcacatattgcttttcttgcatccttccagcaagtatctgtctccttcagatattgacacaatcatctcagctaaaattccagatccggctgctcaaccagaactttatgaatatgtaaaaaatcacatgatgcaaggtccatgtaggcatgctaacacaaaatctccctgcatgaaggatggaaggtgttctagattttttccaaaaaaaatggcaaactgataccgttgttgacctagataggtatcctatatattgaaggcgtaatgatgggagatatattgaaaaaagtcatgtgccactaggcaacagatacgtagtgccatacaatgcaatgttgttgttaaaatatcaggctcatctcaatgtagaatggtgcaatcaatcaacatctatcaagtatctcttcaaatacatcaataaaggctatgatcgtataacagctgctctggttcctgtgcaaaatgagttgggatcaatagagcaatgtgttgatgaggtcaaacactatgtagatggtagatatatttctccatgtgaagcagtgtggagaatattctcatttcatatacataaaagatcctctgctgttgaatgactatactttcacttaccaggtgagaattcagtaatttttgaagatgatgatgacatggatacattgctctcaaagccgaccgttaaagactccatgtttacatcttggttacatgctaatagcatttatagtgaagccaagaatttgacttatattgaattcgttaaatgttttacacatgttgctaaggacagacgttggcagcctaggaagaaaggatacacaattgggaggcttaactgggttcctccaagtactggagaactgtattatcttagaatgatgttgggagtggtgaaaggaccaaccagttatgaacaaattcgtactatagatggtcagctctacccttcctttagagaagcatgttttgcaatgggattcttgcatgatgacaaggaatacattgaggctttgagagaagcatacctttggggttctggccacttcttaagaaggttgtttgttacaatgcttttatcaaatagcattgatagaccacaccatgtctggaatgaaacattttgttatttaattgatggcatcatacatgaccaaaggaggattacaaagataccgggtataaattagtgttttgtcagttttcatatgaatttctttttctgttgcataatcataagttgtattttttattcctagatttgcagcttccaatagaagacttacaaaacttggcactgctagagattgaacaaatactgcagtccaacagaaaatcattgaaggattttcctaccatgccttttccaaatggtgtttcgaacacctattatggaaatagatacatatacgccgaacagtcatatgacaaggagcaattgcgttctgattttgaaaattatgtttgcactctaacaggttatatatcaacatcctaattaattaggatgatagctgactgccgttgtgcaatacatcttgtattcaacattgttttttgtttaattccatttcagatgagcagagaagtatatttgataccatcacgagtgcagtgactaggcagcaaggtgaaactttcttcctctatggccatggaggtaccagaaaaactttcatgtggaaaactttggcctctgcattgcattccaaaggagaaattgtattaacggttgcttcaagtggtatagcttcattgttgttgcctaatggcagaactgcacattccaagttctctatccctgttcctacactacagcactcaacttgtaatatcaatcaaggtagtgaattggttggtctgttacaggcaacgcgtttaataatatgggatgagacaccaatggcacataaattctgttttgaagcactggacaaaaccttgaaggacataatgtgtacatctcctgaaggaactttgccatttggtggaaaagttgttgtttttggaggtgacttttctccaaattctagcagtaatacctagaggcagcagatcagatattgtttttgctaccattaatgcttcgtacctatgggaatactgcactgtgttaaagctgaccaaaaacatgcgcttgcatcttaattcggattcaacaaatgcacaggaaattagtcagttttctgagtggcttttagctattggtgatggaattctaggcacgggtagtgatggattttatgacatagaaattccatctgatttacttattacagatttcactgatgcaattgattcaattgtcacacatacatatcctgatctccagcaaaaatatcaagatgaatcatttctgagtagcagggctattctagcttcaacaattgagattgtcgacagaataaatgatcatgttctaagcattataccaggtgatgaaaaagaatatctaagctctgattccattgacatgacagatgttgcggaaagtcagccttaccaatcagttacacctgaatttctacactcattaaaagcatctggaattcctaatcatgcaatcagattaaaaataggcactcctattatgttgcttaggaatctagatcaggcggaagggttatgcaatggtacacggcttattgtctcaaggatggctaatcatgttattgaaggccacattatctttggtaaaaacattggaaatatggtgtacattccacggatgtcattatcactatcagaatctccttggcctttcaagctaatcagaagacaattctcaattatagtttcgtatgctacgacaataaataagtcgcaagggcaatctctagatacggttggcttatatctaccgaatcctatttttagccatgggcagctgtacgttgcattttcaagagtcacgagtaaagctggtttaaaagtacttattcatgacaaacaagggaagcaacagaatgttactacaaatgtagtttttaaataggttttccaaaatttgtagtatgtaagaacttggtaccaatgtctatgaaaacattataatagttacctgttatacttttggtcttgacattgctgtaaactctgtgatattgcattataactgtccattgctgtaaactctgtgatactgcattttggatatgcattcatacaaattagtcttaacatttgttctttggtagttgattgttttgtggtgttagtattccacttccccaattttgaacatggttgcttatagtagtttttgctatgctgcagccagatttcaatattggtggcacatgtttctcacaccaattatcagtgtacgactttatctaatctgttaacacaagggtgatggcactacctgtctatgaatttggcttctgttaacacaaggatgaatcttagtattaagagtctatttcaaaatatataaattttattggattagacaaatactacatgatggcagaagtgggtgatggatgtagagcaggaagctatagaggcttacaagcagattgataaattgaagaagaaacatgacaatgacattaacacacttgataagctacttgtaaaaacatgtttgcctaattacgaaatacaacctactttggatgactttgttacgcctatttgtgaggataccagtgtgacaaactatgttaatggtcaatttgagttcattataatatgttgcgaggaatcaatatccttaggactttgggttgttgacattaacgaatttttctaagagcttgggttctaaaatgaactatgtgagatagcaattttaggaaaaataccaaataagatttaaaaataaatcaatagttgattggtagttttagtttagaagttcctttgacttctatactgccagtagacactcattctgtttatagagaagacaggcatagcctctgaaatcttatacaaagattaattagtttgattgccatcacagagagcaatcgtccaatgtttttacccttgaagactgatttcatggatattaggatagtacaaaattgatctggagctcagttttccaagccagtgccaatagtgaaccctagctaaacatcatatgccacatatcatttaagaaatttattcaataattaaagatattgcatttcctctcatttcatactatgttattgttggctttagttgagtataatatgttagaactcagtttcagaacatagaaataaatgattgcttttagttgtgtggattgttattgtttgagacttgcatacattgctgttccagccttacatacacttgcattagtgcaagggaataaaaagtgacgaattatgaatatagagctccaaaacctttaaatacaagctataattttcatttagtttattgtttggcaagtatttattgtcatagctactatctgcagataaatatagatttcctaaattctaataaattattacattaatatatgtggtgagagaggagcatcattgaaagataaataaagttttagccaggcagctgtcaagcataagttgcatctaactactaatctcctcatactccattatttcctcgtcttgattcatgccaattgtttgatttcttgtactttgaaattaactgctcttttccttgatcagatatcccattgcttccatcaattattatacttctacctgcaaatagtcattgattaagaaataatccattttattggacaaaagatgagctgataaaagaaaataccaaagtgaaagttcaattaataatattaacacctgctccgtgagtatagttatcctagttgctcaatcgtttgccatcactcttctaagctccttcatactgtaaattaatcacaatagacaacagagtgtctctaattaaaagtcatgtttaaagagtatatataatcttattgggtgatatatttacttatgatgctttttttttattttgtgttacttcttatttgtatgacaaataggaagagaaagagtgcacaaaattgataaaccacaggttttattttggcacaaaattgataaagcttggtaagttctacaagtgtgatgcatgtttcaactttcaattgataaacctcagtatttgtgctggtctgttccactgacttagtaatacttgcagctgaagtagcaaaaagccttgataaagttgatggtgttgtggaccatggtgttgtatctaaaatccagttagttttctctctttaacttttatactctttaaataagtagttgagaatcactctgattgaactgaactaaagataagatggtcattgcatcaaaatatcttaacagagcttttagagaaggccaagtctcaggttaatgtgttaaagaagcaatattagcaacttgctgaagttgttggaagatgccctgggcaatattataggtgattaagttcactaaagagaaactgtttatcttctatttatttttttgtgtatgtaactttttttgtgtgtgatgtaggtatcatggtgattggaagagtgagacacagtctgtagtttcaatgcttacatttatgccttggtttgaaacaggaagccttcttgagcacaaggaggctgaggaaaaacttgggtgtatgttttaatactctcgtgttagttattggcttgtcaatcaatgttttattctttaggtatgtatgcatgtatgcatagattgatttcattaagcactattattaacgatttactaattttcaaatttactaattgaatacattatgatgtcctaagcttctaagcggcaggggaatgtgggtttcaaactggtatcttttgtaaaataagcttttgcatgcaatgctagtagtgttttgtccctaggcaaagtattgaaggacttggtatgtaccatattgtaatccaaacattacttcttaacgcagagaagggaaaataaaaggaacctcatatattagtcattaactgtacagctttcaaatggttgttctgaagaacaccatatcatgcaattatgcatgtctgcatgttgctatatgaaagaaacagccattgttattttcgttgtaaagaaggtcctgctgagtttattgttatttttggtgtaacaaatgtcctacagaatttgtccagtgctacttgctactggtctagcatttggcattcagatattctaaatctaaatgaatggtgcactttaccttggtgcagaatggtaagatcaagggactggattcttacatatataatttataatttattttataggtacttgtaagctataaaaatctgaaccattgattgtccaattggtgggtatcaactccatactttaaaatttaaagtgtgccccaaaagtaccaaaatcaaaagattatttaagctggaatacctttgaattcactgttttacatttaagagtcttgcctcatgtaaatttccattaacacgagttttaacatctaattgggatagcttatcttttggacagttaaattttccaacctttttcaatgttgttctaaattataagaggcattgtgattgaaattatgatcgtaataaacttctatagttgatagtttgtatcagattagattattggacaaatagttcacagttgaccatttatgtcaatttatttgtttatcttctattcttctatatgcaccataaccattcatgtcttttgtgacttggaataagtggaaacaaaatgtattctttttttccctccctgttttttgctataatgctaattactttccacacatagtcactgagatttttaagttctatatgcttattgttcttttgcagtgaatagttcagaatttggcctagatgttgaagattacttaataggtgagtcttctaaacatgtaattgcattaattgtttttgtctaatgatcatttatggagatgaatatgattctattgcatgctttcttaggctagcttccttcagggagtgttgactaatttaaatatgattgtcattttgaagaacatgggtgtggcagttagaatcagtagggtttccaaggcaaaggagctcaataaccaaatgtgttatgttataatgttatatttagtcattgctcattaatacaaatgattcttaagtcttttactctgattaaagaagtcaaccaaagtcctccaacccataactcctttaaatgattgggagaatgattttctgttaaacctgatctgattttgtgattcaggcaatatttctcttccataattctttatccaatgccctattttatgccttattattctaaatttataattttttttctcacataacaacatagatattttaatttttttgaatttaattcaattataatgataatcggtataatagtctttaattaatatatttttaagaaaataattgtttgaatatttgttataggatcacaaaagttattattttaaattagtttataataatataataaataaatattttttttttatgattgagattaaaatttaagtttatcaaaatatagggccatgacctccaattatttgttagaataaacagattataactgggcaaaaatcacaaaagtcaggaagacagcaaaccacggttaaattaattttaaattaaaaaaatattttaaactgcttttatgcctttcaaaatttaaacggatgcaaaggcaaactgcaataggaacagaaaggtcacgcatagcctttggaacttattcactcaagactcagggcagagcagagcacggtgggaaggatcgcttgggcaaaagcgcgcatcaatactcaagcaaccatccactctctatctgtatatactttgtttattcgtttatatagtggatatacactgcctctttcttttcttggttcttatccttttgcatgtatgtttgatctctatctgtttcttttcttgatttttctccttttgcatgtataaatggataccaaattccgcttctctacttcatcactctcatcgtttttgtgttgattttgatacaaggtatatatgtggtcataatggttctctgtttcaatgtcgcaatataccttgtaattggatgttttgaattgcaaatatattaaataagtttttaatatcagtgtttttaaagcaatctataattttagaaaattagtttgccttaaagcttttgcctgtcattttcctatagtgtatggttgataattgttatattatttaccatttacgagtatcaaccaattcagagtgcatgcttgataggtctacaaatttgagtatagtttacttccagtataatactcttgaaaataattggtctcacttgataccatcaaaacttataaaatccaccaccattactatcaagagtacatctcaagttcagcaaacaaataagagtcagggaggaggaaatattagcagtgatcataagaaaaacttacatcttttttgtcagacagcatcacagatggatctagtacactaagaccagcaacaatatagacacacacatatacacacacatagacacacacacacacacacacacacacacacacactgataatggttctttgtttcagtgtcgcagtataccttgtacttggatgttttgaattgcaaacatattaaataatttgttcttatcagtgtttttaaagcaatctataattttaaaaaatcagtttgccttaaagcttttgcctgtcattttcctatagtgtatagttgataattgttataggaaaaaagctctttatttggacaaagaacatgggacaggacctaaatcgaagtgggtgactgaaatggtctacaacttatttgaaatgcaatagttgaatctcctgcaataattacaaaatctgtccaattgttttcatctggagagcctttaaggagtctttctaattgttactttactgcaaatgaagtgcatgttggatctgtaattgaaaatgctactgcacaagtttaatgcaaataacattttctaacaatgacgtgtccagttgtggtgcattctatgatagtcataatttaaatttactgtgtctattttatctattaaaattagtatgttgccaagtttgggctccacaggaagcattgccaatttgtgctctgaaaattaggatttcaatatcaccaatttgtgctctgataatatatctacatattttaaagtgagatcatcttatttgacacattttttagatcattgacttgtgcctcctttcacagttttgttccacttgcaagttatatagttaataggtaatttgacaactaatagatcttatttatatttttttccaaaacatttgcatgcaggattgataaagaacttaggtaaaccagtgttaatgtttgttttttgtaacttttttaaaattacaatgatagtctttcaaagtctccttctctgccatttattcttctcttcctaaatcatgtgccttttaacccaattgataagtactgtcttttttcaagtcattaggaatggatcataatcaagttaatacaaaagaaatggctgaacaaatgatgcagattgaaagaacatctgaacactgtatcaacactgtacatgttacagatttggtaagctatcatgatcatttagtttaatgtacatataccattatgtagataactgattgcctattggtttttatcatacatgtagccatatgcagagattcctagaagctgggcactgaaatggaaagaccagctggatgagacatggcatctaattgatgctaatggtaatcatcatatggtaaagtacaacatgtgtcagaaaaatcctcagattcgcgtaggttggccatcagttagacaattttatcatcttcaaggtaattttcaggtaacactaacacattatggagaattagtgttttttattactgtatttaaaactgcctctgagcccaaatcattcccaaaatggcactccctttacaaacaaaatcctgagagttctgttttccgtgtttggctgaatgagtataaggtttctgtaagtgcattggtaagttttagctaaatactcaaatttttatttttttaatgaatgcttactacatatatctgacaacattctttcgtgctttcaggatgttcccagtgaactgtattactaccttaaggatacaggtttcacaactgtttgttttgaagggacagctgtatgcaagattgtatttaaccactggagaaaaagcgctaaattaggtgctggttggaagacttttgcacgagcaaacaatttaagggctgatttcgagtttattatggaatttccctaccaaggttgcaacatagctcactggtggatagcttgattgtaacaaacaactttgaagacttttaacttttatattttcaatgttaatagaaactttatgcaatagtgacaagttgttctagactacctatatggtttatatttgtatggatatatatgtatatatatatatatatatatatatatatatataagttggtttatattttatttgtctttttgatcaatcttaacatgcttaatgcgataatgtgcacttcaatgtataactaacccgtgcgtatgcgcacgggtcctgtactagttgtcactaaaacaaatggacgcattactatgttgctgctctaattattgttttttttttttacttttttgatcgctaaagaatataaatgtcagatgaatcatagatgatgcaaaaatgaaaatgtattttctttataaaataatgaaaaaaaaggtgatacactaaataatacaaaagaaaattatattatcatttataataaatttgttaatttttataataattacttaaaaattatagctacaatgatttttaattaattaataatgtaattattctaaattgttagtatataataattaaattctaaactattttttattaaaaatctaaaataatttactcatcagagtacaaataagatataatattttaaaatttattaaaatagataaacaacattttattgttttcattttctaacaatagacaataaacagtaaaaattattatctgaaaacagtaaaatagataaaagaaaataaataatatatgaataatgtaaagtagtttcacattttcatatatatatatatatatatatataataacaaagtactataaaaaagtataatattttttcttataataatcatctttaaaaattatattaataattaattttattcacggttgtatcaatttttacatatccattacatcattatttcttttaaatttaaatatatttttcttccttccttatatatttacaaagtttagatttcatctttaaaagaattttggacctaaaaaaattataatttgttattttataacttagagcaaagctgaatttacatttataacttttttacatgcataactgatatagaaaatatatatatatatcaattatatatataattaatgtgaaaacataattattatagatacaattgaatcttgtttaagataaaaatatacattgtcattttataaataaaaaataaacaatttttttagaacaaaattcaaatttattaagaccaattgttagttttcggatgagatattcatcctattaactgtgtggacgcatttgtccaattgacaggataaatattttaatttgttttagaagacattatatattattaaaccaaaataaatatattcttaaaattttgaaaatataattataacgatcacagattcacagttttatgacacttcatcgtatgatttctctgctgatgacacaaatgtcagattgacaaagataccagatccacacaagccagaaaaacaacaacaacaatatcaagttccaaaccaaacaatcaatacaataaataaacaccataatgcaattcacataaaacaattttttaaattatacaaatataaaaaagagagaaaaacaagggaatgtgaataggtgtcacagaatacgcaaccctgtgatctcctgaaaaacctatttcttcttttgacccttctctcactcctcagtttgttacctctttctctctctctaaaaattatttctctcccctaaaaaattctggtttctggttacctctcactcttctcttcttcccccccccccccccccccccccccccctctcctttcttcttttttattttattttatttctgctttctcacaaaacaaaaccctactcacactcccactctcttactctctcagtctcaaacttgcgctaatttaccattctgccccctttttcggcgtcgcagtatttgatttttttttcggtttttgagagcattgggatggtttcgcggatctgcaagtttggttctttcaacgaaaattgaaagagagagagagattcggtttcggtttctctctgcttttcttcttcttcttcttcttcttcttcttcttcttcttctgttttcgtttgtgaaaactgtgtttttgtgttgttgtgaggtttggaatatatgtccttcaatcaatcaaagtccgagaagaacgacgcggtttaccgaaaaaccgggcgatccgccagcttcaatcagcagagaggaggctcctacggcaggggcggcggcgggaccgcgccatcgagcaattcactctcctttagccggaggtcagttagggtttgccaatttgtgtctgtgtttttgtttttatgactgaattttgaatctttgattgatgttgttagaataatgttgatggtgtagattgggattttattttgtttttagaatttggaatttggaatgttgtttatagagtaaagtgtagtggtaatgtgttgtaaaaaaaaagaattgattaagtgttggcattgtgattgtgattaaaaatacgcaacaaattataatcaattgttgtttgtagagtagtgttctgattgcttttttggagttggatgcgatttagagtgtgaagtgtggtgttatgatggatgaaaggaattgctgttattgtgattgtgatgaaatctatgttgaaggatgtagattgggatttgtttttggaaactggatgtgttaatgtgttataatattacgtgttggcattgtgattgtgatcaaatgtaacaaattataatcaattattgtttgtagattagtgttgaaggatgtggacaatcttttttttttttttttggaatttggatgccttttaaactatttagtgtagtgttatgatggatgaaaggagttaaatgttgacattgttattgtgataaaatatataacaaattcccagccaaaaaaaaaaaatctatacctttaaactctattctacaaacaataattaattacgtgtttgagtgtaaagtgtagtgctatgatggatgcaaataattaagtgttgacaatattattgtgataaaacataagtatgtaacaaattagaattatttattgtttgtacaatagtgttgaagggtgtagattgggaattctttttacttttttattttgtggaatttggatgcattttatattgaaaagtgtagtgttatgctaagtagcaccgacatgactcttcaataagtctatcttaaaaaaatatggatttcgacacgttgggacacttgagacacgttttaatattaaataataattttaatttatatagtgtatatttcatttaatattcaataatttaacaaaaaaaattaaactaaactaataatatccatcaatgtaacaaaaaaaaaaattcaaagaggaagcatgcgttgcaagtaaacatatataaagtgttgcatgaaacatttgggatataggacacaaatcaaaagattatgataaatcttgtgcattaaaaaagaagaaagaagataaagaacaacaaagtttcacaaagaatagcattgaacattgccacaattaagagattaaaattaaagaagaaaaaatatcattgaaatttacaaaaaaaatgtttatatatagaattaaaatcaatttgaacttcctaacaaaatttaaattatcatcaaatttattgagattacattagttaactaaatacaaaacataaagggtaaaaatctccttcggcttcacttcctttaatgagaaacattattgggtacctgaagataaaaggtaaaataagtaagtagcagaaaaagaaaaaaaaaatagtgatgaaaggaaacgatggagggaaatgcctgacttactttaatgagaaacattattgggctgacataagcagagggatctaagtaaaattgggagtgagtgagtaaagtgaaggatggaatctgggtctggcgaaggggaagagcaacacgtgcctttgagggggagagtggagtggtcagatgttacttgggttcctcaaaacgacagccctaacccagtcgttccgatccagtatacagaagagttttcccaagttatggattactttcgcaccatttaccttgccgatgaacgctcccctggcgccctcgctctcactgccgaagccgttcaattcaactccggcaactacactgtatgtcaagttcgatgtaaatttgattttaaaaatatcctattgatgcttactgaaaggagattcggaagaaagaattgaaaaggatactcttcacttccttcaacctacgctccattttctccttcgcttttaatttgattttctttcatttttatgaaaattccatttgaccgtgtcagacacggtctaattcgcgtgtcgaaaatggtcaacgtgttgggtttgttgaccgcgtgtcggacaccgtgtcgaacacaacacgccctgtttttaatgtgtctgtgcttcacaggtgttatgatggattaaaagaattagttgttgttcatagaatagcgttcgaagtgttgacattgtgatagaatagacatgtatgtataacaaattataattaattgttgtttatagaatagtgttgaagggtggagtttggaattttttttttttttttggaatttggatgtgttttagagtgtaaagtgtactgttattatggatgaaaaagttaaatgtacattgtactagtgtatactaaattatgaagctgtgaaaatcttttttttttctcttttttaaatgaaagagttgtcaaattctcatttttgtgacatgtggtttgatgatttgttatttgttatttcccataccatcatgagtagtgttttttcattggatttcttttttcttccatacttttttttttttattgattctgtgtgttgcttgttctagttttaacaagaagtctaataatgcacaaggtgggcaatctagggtacacccccagggcattcaacagagtccaatagtgcatctactgcccgaaccattaatggtacccctgtacagccacaattacatggtaaggtttaagaaaaatatttatttatttttgaaaaaaaatgtgattcttctcttcattgctttttagtgtctggttatgttgttcagttttcagtagaattttactgtagaaggatttgtggatgatccttccctctttattaaggaagaatctgctgatgttgttgaggttattgaatgtttggtaaattagtctctcatctttttttatggaattcattcatttatgttgtatgatagaagcatcagatgggccagctacaaagtcgtctgaatcatcagctgcacataggagtgctggaattcttccaaaagctccagcttctctacaggcgcccttgatttctgatccagtcccttcctcaagccctgctaagggtatgctagtactgtaggtttttgttgtgtactgtgtacattagatgtgattaacaactcttttgtagcttgagtcatagtaaatagtcttcttggataaagattttccttattattaacaattagttgtgttgtgagacgtgagtatctaaatatttatatctgtcccaggagatgcatctaaggcattcccttttcaatttggatccattgctcctggctttgttaatgggatggcagtaagtttcttgtataataattgatcaatgtctggcacattacatattatggaactttagggtgagtaattgatcatgttcttgttcttgtatgcagattcctgctcgtacaagttcagctcctccaaatttagatgagcagaagcgtgatcaggtatgcaatttattatttttcacctctttttccttaatgtttgcattatcatacagagaggtacagccactacacacctccttccaaactaaagagcatttcttttacattctattctaggaacatgatctggtttagattttagacatagaatatgagaaaggactgctattatgctttttgtatgtcttattaatatttacattattagagatatcagtattcactaattgaagttgaacttgttttatgtcttttcatactaatgaaagtttttgtttgatgtataattccttaactttcaggctcttcacgatcctcacaagtctgtgccttcagtgccaattcctcctgttccaaagcagcagcaaccacctaggaaagatgctggtgtcactgagcaatctaatgcaggggacagttgggaaaatcatatagggtttaaggcaaaaaaggatcctcatgtgtcagctttgaccccggcaagccagatgcctaagccctctgttcctgtaactgggatttcaatgtcaactccatatcaccagtcacatgctcctttacagtttggcggtgctaatccacagattcaatctcagggtatgtcaacagcatccctccagatgcctataccgatgcctttaccaattggcaatgctacacaggtgcaacagccagtttttgttccaggtcttcaacctcatccaatgcatcctcaggggatcaggcatccaggccaaaacatgagttttgctcctcaaatgggtcgtcagttaccccatcaattaggtagcatgggcattggcatcggtcctctatatccccagcagcaaggaggaaaatttgctactcctcgaaaaactactgtaaagataactcatcctgagacacatgaagagctgaggcttgataaaaggacagatgcatattcagatggtgggtcatctggtgctaggtcacatcctaacataccttctcagtcacctgttaaatcatttccggcttctcatcctgcgaactattattcttccagctcacataataccaattccctctattatccacctagttctcttccattaacaagtaacccgatgtctcctaattcgcagccaccaatatttaattatcctgtgaatcatggttcgcaaggcgtgaatttcatgaattcatcatcacgtggttccccacctattaataaaactccaacaggggttgcatctctgaccattaagccaagtggtatgtctgctattgtggactcatcagtgtccaattccagtatttctgatgttcaaaatacagaatcccctagttcaacagcatcttgtgatgctagctcctctgtgctgcaaaaagggtctgaaacttgttcagaagtctttttacaacagcacaagttgtctagtgattctgtcccagttgtgtctaataatgaaggcgggagggaatctcttagtaggtccaactctttgaaggataagaaaccagggaagaaaggtcaattatcacagcatcaggtatttgagtgaattattattcagatacacacacttaaacatagtggatgtactttttagtatgcatgtgacctttgtgtgcatgagtataatgtgtactttgtcttttcccacaggtttctgtacaatctcccacagcggataatgtgccttctcatgctgttgaccgtggtatatctgatactggagtttccaaacctgtaggaactaaaacaaaccattctgcggaaattaccactgaagaccttccaacatctaatacaatacctagtagcacttctactgctgaagtgaaaaccaatgggtctgcagaagtttctgcttttgtatctggtgcacaaactgttgacagagtgcacaataataatcctgataggatagataaattagctgaaggtaaacaactaaaacattatgatgaaagtgatgagccatcatcccctgaaggatacaaaccaaatatttactttaatggaacagaaattaaactaactgaaaaagatgctgcaattgtaagcactgtcttaacctataaaattatacaacggaatactggatgaatctgcaagttataatgcaaaatgtgtaataggtgataatttaggcacatgtactactaccacattgcattattctagggatgtctcttttagcagaaataatagtgtagttactaatggatttctttcaggaaaatttggcatatcagatctgcagtctgctgatcttccagagacaacatcaatgcatgtcaaggatgcttcagagaatactggcggtgagtcaggtaccaaggatagaccaactatagaatcaaataaggtgaaaactacatctaaagggaagaagaaaagaagagagatacttcagaaagcagatgctgctgggtcaacgtctgatctttataatgcatacaagggacatgaggaaaagaaaggtgtcttaagttctgagagcacagaaagtaccactactttgaagcagttgccaaaagatactgctcagtcagatgctttagcaagtgaaaaatgtggtcacagtaaagctgaactcgataactgggaggatgctgctgacatgtctacccccaaacttggggttcatgataaatctcaacaagttggtgatggaagtggaagtacagccaaaaagtattcacgtgatttccttctgaaatttgcagagcagtgcactgaccttcctgaaggttttgaagtcaccacagacattgaatctttgatgagtgccaatattggtagtcctagtcctggaagaattgtagatagaccaggtgggatgtctcggatggatcgccatggggatgtggcaatggaggatgacagatggagtagagtttctggtgcttttcgttctggacgtggtttggatggcattggaggtaatgtgggattccgatctggccaaggaggcaattttgctgtctcaaggaaccctcgtgcacagacaccaccacaatttgttggagggatcctttctgggccaatgcaatcagtgggaaatcatggtggaagaaataaccctgatggggagaggtggcagcgttctgctagcttccagcagaggggtttaattccttctccttcccaaactcctttacagatgatgcacaaagctgagaataagtatgaagtgggtaaagcaacagatgtggaagaggtaaagcagaggcagttgaaggctatcttgaacaaactaactccacagaattttgatagactttttgaacaggtgaaagcagttaatattgacaatgcagtcaccctcactggtgtcatctcacaaatctttgagaaggctctgatggaacctaccttttgtgaaatgtatgccaacttctgtttacatctggcttctgagttgcctgattttagtgaggacaatgaaaagataacttttaaaaggttattattaaacaagtgtcaggaggaatttgagaggggtgaaagagaagaagaagaagcaaataaggctgacgagggtgaggttaagcagtcttctgaggaaagagaagaaagaagagttaaggcaagaagacgcatgttgggtaacatcagattgattggagaactatataagaagaaaatgttgacggagagaataatgcatgagtgtatcaagaagttactgggtcagtatcaggatccagatgaagaagacattgaagctttgtgcaagctaatgagtactattggggagatgattgaccatccaaaagccaaggaacatatggatgcatattttgaaaggatgaaattattgtcaaacaacatgaatttatcttctagggtgaggttcatgttgaaagattccattgatttgagaaagaataaatggcaacaaaggaggaaagtagaaggtccaaagaagattgaggaggtacatagggatgccgctcaggagaggcaggctcaagctggtaggccaggtcgtggtcttggcaacaatcaatcagctagacggaatcccatggattttggtccaagaggttcttctatgctgtcttctcccaattctcaaatgggtggactgcgtggtcttcctactcaagctcgtggatacggtgcttctcaggatgctcgatttgaggaacgacaatcttatgaggctaggaccttgtcagttcctttgcctcaaagaccctttggagatgattctataaacttggtaccccaaggtggtcttggtaggggaatgtctatgagaggatcaacagcaatttccaagttgctaatatctgatgttcttcctgtccatggagactctcatagaatgaatacaggtcttaatggtcacagcaatttatcagagcgcacaccatatagctcaagggagggtcttgtttcaagatatggtactgttaggtcttcggggccatctgcatatgatcaatcaagtgctccagagcataatgtaaaccatggtaacagagacttgaggagtgatgatcggaatcttgaacctactgctcatttgcaggggtcaatggtctctaagaatgcttcttcagagaagatttggccagaagaacaactgagggacatgtccttgtcagcaataagagaatactacaggtaatgtttttctgtggtacttttattcatcgcatagtattctatttttttatttttatcgggggccaaatttaatcgttagattgtagaattctattaaccaagttagattcacaatgtatgctgatgcaggcagatgtgttttatttttctatctttttttttttttttaatttatactgatgaatttgtttccctgttttcttgtcatttaatcatttgactgaaatttatgcaattttcagtgctatagatgagaacgaacttgctttatgtgtcaaagatttgaactctccgagcttccatccttccatggtttctctctgggtcacggattcatttgagagaaaggatgcggaaagagatcttttggccaaactacttgtcaaccttgtgaaatctcagcatggaaccttgaatcaagtccagctcattaaagggtaagatttatttaataaccatatagtgactagcagagagaatacattcattgtgaagataaaggtcatatgattcattcctttgtatgttttggctaggtttgaatctgctctcggtacattggaggatgctgttaatgatgctcccagagcagctcagtttcttggcagaattttcgcaaaagccataacagagagtgtagttactttgaaggagattgggcagttaatacatgatggtggagaggagccaggtagcctcttagaagttggacttgcagctgatgttcttggaagcacgttggaagtaattcaaagcgagaagggggacacggttctaaacgagatatgttcagactctaacttgaggttggaaacttttcggccacctaatgctaaaacatcaaggaagttggaaaaatttatttagatgctagtgatgcctattgtatgttttttttttttttttttgtgtagaggggaaaaattatttggctagtgcttttttgggggtactcaattttgcagagaatggttttctccgtgagatgggtggatagggttttatatatgggattttctgtctttatattctttttccgacatcttcactgcaattgtaaaaggttcaattgagcatcagaaattttaggcgtagttgcgacgcctgcttgatgacctttacatatttctttgtagatataaaaagttcaatgagcatcaagaattttattttcttatcgtttttggatgtatttcattaatgcttgaaaaatgaaatgcaatagagaaaataagagaaagtagttttatgctaacattcaattacataatgtggatgataaatttgttgatatttataataattatttaaaaaatcatagtaagtatggtttgtgattaaataattgtaaaattactttatattgtgaaacttaaactcaggctataattttacttggtaataggttgtgacgaaataatgtgaatatcaaagttactctttaagtattaattattttgagtaattttgtatttttattatttattttttgaaatctaatggttgtaatgagtagtttaaatacaagtttttgcttaagaacaaaatgcactaaacataaaataaagtatccaagcctgaatagtagaaaaggattttttgttattatcatttcattcattaaagagttaaaagtaagaattaatatcggtgtagatatatgtagtcttcacaaatattaatgtttcaaaaactcattttattgttttaatatattttaaatacaaaatatattctttttattccgtgttagaaacacttcattattactatcaatattatgtcagttgtcatgtttttcattgtatttctcattgtattttttgatattattatgaataaaatgtcttcctaagttgtctcctctcttaaaaaaaaaaaaagagcaaactacctgttgcacggctacaacatgattttcaacaattttattttattttattttttattttattgtattttctatgtttgtgtttttcgatcaagtaatccgtttgtcccaaaacattttttttatctgcttccttctttttggtacaacctaaattgggttcaaatccttaaatgacccaaaagttaggggcatctactaaataaactatacagtatatgaatttttgaaaatgccaaaagtgttctcagtttgtttattacctggtgcttctctcgttgcttagttgttttggtttttttgctgctccttgctcaattgatcttgtggttgcacattagaggtgttggtgttggaggatgtagttgggggtagtggtagcagcgttcagtggtaacagtcgccggagaggccatcgtgggcggtggctgcgaggtaagaagtctgaagctgctgttttctaacaaacggattacttaatccataacaagtatacagattaagtaatccgtatgaggctaactgattgagtaatccgtatgaggcttagagattgcctaatctgttgtggttgcgcattggaggtgttggtgttggagggaggtagttgggggtagtggtagcggcgtttagtggtaacagtcaccagagaagccatcgtgggcggtggctgcaaggtaagaagtctgaagctgttgtattctgacaaacggattacgtaatccgtaacaagtatacagattaagtaacccgtatgaggctaacggattgagtaatccgtatgaggcttagagattgactaatccgtaagaagcttgcagattgcctaatccgtaagcctcgtatggaataataaatctgtatggtttatacgaattatctaatccgtataaggcttacggattaggcaatctgtaaacttcatacggattagtcaatccgtatgagggttaaattatttttaaaaaaatttaatttaattttagaatgaattttgttgtttataagtcaaaataaaagagtttaggtgtttctaatgtgtataatattattatgtgtatgttttcaaagtgaaataatattaattttatttgttaagatggacaacgacgactgcatatataatagtatgatgtctgaagaaattaatatggaggaagacattgctgaagaagttgatgcgtttgaaaatgtcaattgttttgttgattgtttggtagcattcaataccaaagaggtatatatttgatttaacatttagttaaagtagttaaatgattgagtttaactatacacaaatgataatacccaacaatgaatgttccatttttgtaggtgtttgtttcccatgaggatgtattgaaatgggctcgaagtgttgcatttgataatggttttgtagctgtcataatgaggagtggcatggcaaatggaaaactgggaacaacatcatatgttataattggctgtcaaaggagttgaaagtatagatcaatcaaaaaaggttttgtacctacaacgggtagcagtagaaaatgtgaatgtccgtttaagctgagagcaaaacccggcccaggaggtgaagggtgggttgtgaaattaatatgtggcatgcataatcatagtttggctaggtcattatgtggacacgcatatgctggtcggctaactaaggaggaaaaaatcattgttgctgatatgacaaggtcgctggtaaagccaaagaatattcttttaactttgaaggagcacaatgccaataattatacaactttgaagcaagtgtacaatgcaaggtatgcataccacacgcagataagaggtgataacactgaaatgtaacagttaatgaagcttcttgaacgtgacatgtatattcattggcgtagaatgaaagaaaaaaatgtggtacgtgacttattttggatacatcaagattcagtgaaattgagcaatgcatatcatgtggtgttcttgatcgacagtacacacaaaacaaacaggtacaaacttcctttacttgacatagttggtgtgacacctactggtatgacattttctgctgcctatttagagacggagcggttaaacaatgttgtgtgggcccttgaacactttagagggatatttctgaagagtgaatttttcccagaagagattataactgataaagattcagcattgatgactgctgtgaaaattgtttttccaatgtcaaccaacttattgtgtcggtttcacattaacaagaatgtcaaggcaaattgtaaaacttacatacgccaaaatttggcatgggactttgtcatggaagcttggggacccttattgattgtggtactgagaaagtttatgatgaatgtttgaagaagtttgaagttgcatgtgcaccatggtctgcgtttgttgattatgtgaaagaaacacggttggatcctcaaaagaaatttttttaatcgcatggacaaataaagtaatgcatctaggcaacactacaacaaacaggtagcaatttatttatagtaggttacattgtgtactattgaacaacctatttattttaatgtatgaacatttcgtcactaaatgcagggttgagtctgctcattggactttaaagaggcttctacagaataatgttggagacttatgtactgtttgggattccatgaacaacatgatcaccttgcaacatactgaaataaaaacatcaatagaaagaagcacccatgtcatcggacatgtatttagagtaacattgtacaagagacttatcggcatggtgtcgcggtatgcgttgaactagattgctgctgagtttgagcgagttcattatgcaggcaaaaatcctgctcgatgtggatgtgtcatgagaactacccatggtctcccttgtgcatgtgagttaactaaagtagttgttggtagcataccgctttcaagcgttcatgtgttttggtgaaggttaaatttttccgaccaacgaatggatgacatggaaattcacatcactgatgagatagaggcaatctccaatcgttttcagaagcttgacatgtgtggcaaaatgacgacgaagactaagcttaaaaaaattgcttttcctgatcaaacatcgatgaatccttccctagaaaaggtgagaacaaaaggtgcttcgaaaaataaacacacaagacacgagagatcaaccaagcgggatccatcttactttgaatatgttgatgaattacattctgtgcaaaatagttgctccacacgaaaaaggtatgcttcctcatctgatcgaccaatgaagaacagaaacattcctatgctagatcaatttcatccttttatgcagaagttcgttgttaacatcacttatgttaaagctgatgataattgtggatatcgtgtaattgttgtcgtactaggttatggtgaagattcttggcctttggtctgcaatcatttgcttaaggaactttcagaatggtttgatcaatatataccattgtttggtgggtttgataggtttgaacagttaaggcagtcccttcttgttgatggattagcaagggtaagacggtagtttcacaaatcttttactaaggtatgtatgatttgttagattcagatatcgaaagtaataaaatttgattgtgtaagtaacaatggataagtgaatggatattaccgacatgggttatgtcattgcttcaaggtataatgtcattattgtttcgctttctatgcaacaaagtatgacattttttcctctcagaagtcaacctcctaaagattcatctattcatcgcatcgtttgtattggtcatgtgtatggtaaccattttgttcaggtataacaagcaccattaatcaatatacttttattttgtttgacattggtcaatatgaatttacaacaaacattgtatttgaaacaggttgaactgatagtcgactgccctatctcatgcactacattcttgtgggctacacactgctcaaatgaggcaagacattggcaaattccatacattcatcgaatgaggctgtactcagatttcgttaagttaccaactgaatatgtcgatttagaataaattccttttggtgtactttgttaaaacgattataaagactgtgtctgacaagaatatattcaaaatctaacaagttccatgcaatgcttataaattaacaaatagtctgccaatctgtttaaatacaaaaagttaaaattaaattttaaacacaaatgatgtaaatgtatcaatcaggcaactcgtctcctaactgagtccctcaatctactcgtgcgcacaaagatgtttccacgctgtgtcacactacgtgctaatcccaacaagtgctgcatagatgagtatgcctctatgccaggaataacttgttgtgtgtcaagcatgtatttcaacctgtctgctagcctcttgcacataccctgttacaatataacacaacatataacacagtcatagtaatcaatattgcatcgtgacttcatataacttttaaataactaaaatatccgatatttttaccactacatgtggagtagtgtgaccatcatcagaagctggggcatgtgcatctggcgcagctggtgtgtcatccttatggctggcagggggtgtaggattatcctgtaaaatagtagtgactctcaaaggatgtcgtgtcggctctccagcctttagcgagcttataaatgaatgtgatacccgatagaaccacctcatatagtcactaacacactgactaggatatgtgaccaaatcatcagtgctaacattgtactcgaagaagtgactccatcggtcatcgatatcttcggtggacaaagatctaggaggagaactgtgggatcttttgaacacacccatattgtcgcatgacccgctctggtaaatggcgtaccatgtgtggcccccatctaatgtacccagagtgtaacgaaatcgtctcgaaatccatgtgtgcacaatgatcccaataaggcgtccagactacattatcaagactcaacctatccagccgcctacgataggttgaaactggtaaagccttcgtagctctccatcagcatgcatgtggaaatttctcctcgtactcggcatttggcatgacattcccaatggtcgggaaatgttcatacacccagcactgcagcacaacatataaaatgaattaacaacattcatagtattaatgtcaacataagtgaagcaacaaaatattcatgtgttgttattacctgtatcaatgaaatatatccggctaggtgtttcccgtaatgttgggatgcatagtttaagttgtcgtaaatgtaaactagtgcggctgcaccccaagcataccccgtcgattggtcaagatcgcgaaatgcgtccaagaataccacactgatttgtgtggcactcttgttcgcaaatatagtgcaaccgaccaaatgcaacaaataagctctcgcaactaatatccactgcctagcttcacacttcgcaacatataagtcgcgaagccaagacaatcgaacatatgccccgtggcattgttctgtctcagcttcagcatcctctattgttacctccaacaactcaacaacgagtgttattgcctcccccacgtcaattaccttatacgtctgtaagtttcccatgattgggagatgtaacaatgccacaacatcgtccaaagtgatgctcagctctccgatgggcaagtggaagctactggcctctgggtgccatcgctccacaaacacaaaaagtaatcccttgtcaccagtgtccacagaagaggaaatcaacgggtttaacccagtagctgcgacaaacccttcaatctcgagtgctggctttccaaactttgttaccttacggccatgggacgccaattttaactctgcctgttcttgcaaaaatgtttgtcagtaacaacacatacatagaaaaataactattaatttgtatttacttaaacacatcaatacctctccagcccacactcttagtgtgacatggttagcgtaatcagtcaaaatcgaaggatcttccggcccacctgggaagcattcagactcggtcccaacatcctcatgcactggtacatgttccggctccataactcgttcctcaacaacatgttcctcaggaacaccctcagttgcccgttgtcttcttgcaaatgcagtaggccttcaacgttcaccaccctgttctatagcccgacacaatcctcctctttgttcttgccataatctataccatttgttaatcaacatagtcataaacttaaaacaaacaaataacaaacatatatacatagcattggttacatattcagtcaatcttattttcatatcatgaatctatctactttcttcaacttcgttgaactcttaatcaaaatataaccaactaccatataacaatacttaatgacatgcaaattgttaactttgttggccacaatattcaactcattatgcttatacctgcacaatcctaacttatcacaatcccaacttattacatcaagcaattcaataattgcttatacctgcaccaaaaaatagtgtgtctactcaatgcacataagtcaccaatgtgaattaacttgtaataaacttatatttgaatcttgcctgttgggcaacttgttcaatacttatatttgaattacttatgctttagtttcaacaactaaagaaaatgaccatgtttcttaagttgtaaatatcgaaccattagcaatgtgatggacttgatctgatggctgcattttcttcaactatttcatttcacattttcaatgagatctaatttgtaacccaataatattggatggaaatatgccgattcatataaacatcatgtttgcacagttgttgacttttttgccttgacattcaatattatgcagtacttgttttacaattaattgaatacaactatggctcttgagctacaaagaattaactggattcttattgttggttaacctttcatgatgatgagatgataggctttttccagttaaaaattgtgagagaggcacaacacttgaggttatattgtcagtttaatttatactttacagtagacctacttggacgtagtttacaattagaaggaaatctggactaacaatttgtaactacaaaataagctactgcttcacaacaatagttctaactttctttcactttaataaactcttaaaatatcaaatttcatataactatatgtaatattgtcaatgatacacttacatcacaagcaactatatatgacatacaatgctgccttatatcccctaataaccaatccatttacagccattcaaatttcaacatcctaatatacataaattaatcagattttaacaaatttaaaactatttttaaggttttaagttccatacggatcacctgatccgtatgaagcttaaggattgtttaaatatgtaaggtccatacggatcaggtaatccgtatgaaccttatggattacacaatccgtaaggtccatacggattacatgatctgaaaggaacttacggattgtgtaatccgtaaggttcttacagatcaggtaatccatatggatcttacggattatccaaaccgcatgttacatatggattaggtaattcgtatggatcttacggattatacaatccgtagtgaccatatggattatctaattcgtatgcaccctaaaaccttctcacggattaatcaatccatcacatcctcacggatttatcaatccgttcgacacaaggcctcaccttcgtcgacggacgcgaacaccgaccaccacctccaacgtgaccaccaagccggaccaccaatgctgcctgactctactgcctacttcaatgacgtcggagagctgcggaagaatgtgccttcagatacgtgtaggagaagaagggagattcatagaggaaaacaaaaagtgtttcttctgctattcttgtttttaaaatttaatgaaaataattaaaagggtaattgtaaaaatgcattgtgtctatataatatataagaaaagaaaatatatagtatatttagtagctgccaaagttaggtactaactcacaagagatacatgttaaagtcatgaataacttctgcataaacaaatagacagaataattagtgttgacttgaaggatgtgtacaataaattaattaatttctagaataacattatataacacatcgccttctgaaaacaaaagaatatgcatataaaacaaaatctattgaattattacacgaaaaaatagttagcaaagagctgatgcatataaaagacaagacgctagccgaatcatataaaggacaagaatattcaacatgataattttcaaattaacttgataatgttagtctttcataattgctataggaatagcgaatatttaacaaatttttttaaattaacttggtaatgttagtctttcataattgccataggaatagcgaatatttaatataataatttttaaattaactttgtaatgttagtctttcataattactataatagaaatagcgaatattcaacatgatttttaaattaaattggtaatgttaatcttttatatttccgataggaatagcgaatattcaacatgacttttaaattaacttgctaatgtcagtctttcataattgcgataggaatagaaaatattcagcatgacttttaaattaacttggtaatgttagtcttttataattgttataggaataacgaatattcaacatgacttttaaattaacttggtaaggaaggaaaggcaaggccgaaatcatgaagacgtttaaacaagagaagtactttttgttgatccttgttttgttctttcactccttttgtgttaatggtgcgcatttggtgctgatccatggagcccttcatggtgcatggtgttggtataaggtggttagtcagttgaaatcagaaggtcataatgtcacaactctagacttggctgcttctggtatcagtccaaagcaggtgcaagaggttaattcattttcagagtacaatgatcctttgatcacattcatggcctctcttcctcgagaggaaaaggtgattcttgttggtcacagtcttggtgggctatcagtatctgttgccatggaaaaataccctgaaaaaatcactgctgcagttttcatcactgctactgttgtctctcaaaacctcacctacctaggttatcttcaagaggtactattctgactagtcacatttacaaccaattatctaagttttttcacttcatgtttgttggctcgtccaaaatcatgttgaaatattagttagcgtgattttaagtgtatttttttgttattatattattggttcaaaatatttagtggcttatcaatgattaatctttgtaagagaatttgacttatcaactttcatgggattttcttcttttaatcattttttttttcatttataatgttcgaatctgagaccttatttaagagaactgagtttagtgccacttggactaaagattttttttaatcatattattggtacaaaatatttatccactttgcctatgattaatctttataagaaaatccaactagtcacttttatttgggttcttcctttctaattaccttttttttctatccacaatactagaacctgagatcgtatttaagaaaatcaagtcaaatatcatttatacaacaacttgtatgtgtgtttcaatgaatattagtaaatttatttacaataaagttgtttttggttaaaatggattttgaagtaatctaatttatatttagatatttttataattaaataaagttaataataaaactgataagttttttatcctacaaaaaagctatttaatgttgtttgaacttataatcaagtgcttcattgacccaacctagaatgtagcaactaattttaaacctattttaaattgtgatagtgaaaatgtagttaaaattaaacgacttccatctgtcgtgagttttgttatttgtcattttacgcatcaaaacactgtttttactttttatacaatgaaaaacatattaagtcaaaattctccttagcatttatactttaaaaattaaaattttggttcacatgttttttattattggtgaatttcctaccttacgctagggtcataggttacgtaaagatagacaaaaattactaattataaaatggcaaatgttaatcactaatttaaaatattgattaaggaactaaaatatttttttatcaaaattatgcaaaattatgttgtacataactttctttacgcactcatataatttccattataaatatttctttcttttagttctttaactaatgttttaaagatattgattagcaaaatcaatataaaaatacaaaaactaaaataattatttttaaagtatagggattaaagtctattttaacccacaattgagggacataaataaattttacccatttatatattgatataaatgcattgaaacattttattaaattactattgtgaaaacatgacaaattgagaaatttatatatcactcatttaggttcgaagaagattaggccctgttttggaggaacaatatttcatattggatgtaccagctaacagagctccgttcctctcatcgcttggagtcgatttctttacaactaggttgtaccaattatcacccgctgaggtaaaaattttcaaatgaatttcaatacatagcctttctatatgttttgattttaactaaaataatataatcataccgcaagatgtttatttagtaaagaaaaataacctaatttttttaggatagctactttaggaagagttttacactgtgtttcctaagaatacagaaggacaaattgactaaggagggaatggaaatgataagtaaaaataagagagtcttactaaccaatgttattaatacattggttaagaaatttaaaaaaaattattataaaaattataaaaaagcataaaagaatcatggactcatcagaacataattttgtacatcatgctaattttttttagttctttaatcaataccctaagtgtactgtttaacatttttcaaaagattttggaaaattaacccatcattcgttcgataaaaggagacaaaggaaggaaggtgacccacatatgggtccatcgtttttttttataggttttattcatttttggacggaaaatgaagagaagcgtgtcattttaatacaatgagaaagacattactatctccgtctctgattatctcttggatttattttttatcaaaatattttaaacgataaataaaagataaaataaatccattctctctctcttgaggattgtatgagataagtattacacattaattaatgacttagttattttagtctctcaatttgtgggtcatattttttagtttctcaaattttatcagtccttccaattttgaaaactattctttttagaccctctgatcagtgtgtgcaaaataaagaataataaattgataatttattttagatataaattctggcaattaaaaattaaaaatcaaatcctgacgactaaaaattgtcacatagtcaatttattattcttcatttgagaaagagactaaatttaagaattaaaaaaaacatgtaaaatttaaaggactaaaataatatgattcccaaattgagtaactaaaacaataatttaaaccttaattaattatgaaaaagtaaccaagaatatctagaacaattgattgtttaaataattgtttatttaaatttgtgagtcttataatatcacataatttaaaaaaaattattcaaaaatttacgcaaatgccaaagtcaagttgttagagtgaatgattaatttgaactacattaaattttataattaaaaaataattctttaattgataagaatgaattaagcaacttatttataaacaactcacttaactaaggcattgtcaagtcatttatttcaattataaaaaattattaagcaaatgttacttaattttaagtaattcatgaagcacctacattagagatgctgtaagtaaaataagtgagatgatgagtttcaataattttaaagatgattttgaaaaaataatataaattgttaataaatttaatattactaattaaattaactaaattttgtaaaagataaagaatttgaattagttattgagttttataacgaaggtagtattatttggtatatcaaattttattctttatttaggattatgtcgttaataaatggtatatatatatatataaacaattgattaccattttaaatttattgtaatatgaacttgatttgattttgataaagttaatcttttgaatgtaaaatgtattgttcccctaggattaaaagtatggtttacttattattggattcaaactgatcaattaggtactatgcaggatttgacacttgcttcctctctggtgagacctttacctccatttgcaaacgatgttgaattattgacgaaacaaactgcggttaccaactacaagaatggaagggtatctaaaatcttcttaattgctgaaaaagataatctgctaatagaggaccttcaaaggtggacaattgaaagcactggtccatatgatgatgtagaagttataaaggattcagatcatatggtcatgatttccaaaccaaaagagcttatctcgaaactgttaaagattgcttataaatattagcctttaaatgttagtaatgaaatgcgtgtatcataaaattataaaaacatgtttatgggccatgtatcataaaaataagtacccaataacttttaatcattattataactatggtacttatttatgtttaattttagttaatttatggatgctgtaaaatatttgacgtagttattttaatttaatgacttattgctgcagtaattaattagtttttacgatgcatgggatgccgaattttttaaacaatgtaacgaaacgggtttagataacattgtatcaaaatcttcttttacattgaaaacattacaagaatcttgcaattatcgtattgagttttggtatttaacacaagtatcatgttgccaaacattatgaacccttttatacattgaactgcatcgaataagcccaaatagtgaattgattaatttaagctgtaaaacatgaattgtgttcaatctcccaaaatacactgtctcttttccattcctctataaggcttactattctttttaggagatctataaggctaactagcttcctcttgtaacatataaaaaaatacattgaaaatttggattataagaaaaatcttgtacgttacttatgaggggaaaaaaaattctttttgtttcaaatataaaaatgaaaatcaaatagatgtactgaaattaggctaatgataaaaagccttgagtaatttttagaagttcaaattaccacaataccactattgtatgaaatgaattaattctagaactagggccaacaattctcaaataagaattacttcactacaaaaaaaatcaaaatttttgacagacgaaattcgttgctaatacaaaaaatccgtcggtaatttcaatttttcgacggatttcagaccggcataaatcagtcgacaaaactgtcgttggaaatttaaccgaagaaattttgtccgtcggaaaaatctaacggtaagtatctgtgaaaaatttctaacagaactttttgtgggaaatttccaacagaaatatctgtcggtaatttctcacggattcttctttcggaaattatcgacggaagtatctgtcggtaatttcccatagatcatttcttcggaaattattgacggaaaatatctgtcaataatttatgttcaaatatattgcatttaatttattttatgaatatttttatttatttatattatttaacatcattataaaaattaacacataattttattatataaaggctccaattcatacatccaaaagaaatgttttaacaaattaacttaacttcgaaataaaattaaaataaaattaaaataaaagcacaatgttcgatatgtcaatactaattttgggtttctaagtcaataatcaaaatagtcattgttagagtgtctttgttggtcatcaagttgttgttgctggttatctggtggttgatcattgttttgttgttgttagggatggcaaaacgggtctggcccggcgggccagcccgtttggcccacgaaaaaaatgggctgggttgaagttttgaacccacaatgattaaacgggccgggccaacccggcccataaaaatgcaggccaaaaccgggcccgggccgggccagcccggtgggctagcagcccacaatgctaagtcacttacaaagctgtgagacgtgagtggtgagtgcacttcctaaggctttagtgaataatataataataaattagatagatatatattgtgtggctgagagagagtgaaagtgagagagctgagacatgggactcgtgagagactgagagtgagacctcagacctgagattagtgagtctgagagagaagagagtgagaggctttcgttccgccttccgtccgagcttctgccaacctggttgcttcatcatcgttgtcgagcttcgcggtgggcggtggttaccgttctcgttctctttcgtcaacctcggcctcggcggcagtgaccgttgtcgttctcgtgtcggcctctatgtgccttttccctttgaccctttctcactctctactaaggtacgaaaactggaacctctatgtgccttctccttgtgtgttcctcgacctcgaaccccttttactcaatctcctttattctcacttttcaatccaaaatcgtttactgcaactgattttagggttgccctttttctcatttttcttcattttttatttttcctttgttaattttgatattaatatttagggtttcgtttccctttatcagagtctctctgttggtgatcgcgatagagtgttggaactttttctcaggctgttgcggtggaagattcgatgattaactgattatgctattaatgtttttacttgaaatgagtaaatttgattttcatttcggttatgaagttgtgtcatgtgatggattatggattagtgggggaattggttctgttatgtttttggattttgtctccttgcttaagtttcaattgctgttgttattcctctatgtgttgattccattttcatgtgatatgcctaataacataaggacataatgctgtttgtttctgaatttcttgaaagggagtaagacttcatgtgatatgctctattttctttcggttgttatttatgtcaacgactcttgttggttgctttgtaattttcatagttcaagattgctgttatctgtgatgtgtcttgtagcttttgggtagaaaatactgatcaaacaaagtaattgcattttaatgtataattagaatgtgaatgcatctctgttattagaatgacaagatatattaaataagcatatgttataacttataatgaaattagtgttataaaactataaaaggttgatgaaggagtatgattgctgcagtattagaagtatcagccattaatgttttgcttttacgcaaggtgctgcaatatctctttagtttatagatgtatcagctggttgcattgcttctattaagcatatttttatattaaaagcattgttataaccaattaatgattgtaggtttatgtttatctattttgcccacttttatatcagattttcctgatttggagcatatagatgccttataaaaattgtgcacgtgtaaaatcaatattatttggacaaaattgtgtactttaaataaaaatttataggctggaactcttttttttctatttttttttaatttttaagtgggctggtgggctggcccgctagcccactaacccactataaagtggtatgggccaggattctcagcccactttgtaaaagtgggccagcccggcccggtccgttttttatgtggggtgggccagcccggcccatttggggtgggttggcccactttgccatccctagttgttgttggtcatgtaattgatcattgtgttggtgttgttgctggtcgggctgctgctgctgcatgatgttgcacgcttctagaggtagaaactaaagtacaactgattgaaatactcgcatttattcctttaatagacacaacgcctcctttgattgacgcaactcctcatttgattgacaaagctcctcctttatttgattaatttctgctgaatgattcacatgactagaagatccttgcaagtgttgcatgaatgtgtcatctccacatttataagtatgagcaagatctccagtaccgtaaagacgtcccttatgcataggtccagttgttgcaacccaacaccgagtcctaagtctttgttcttcagcagggtctaaaggagtctaaaggagtcatttcagattcaccaacacttgattgaacatcaaacctagcttgagataaattgtttccatagatcaagttatgattgttatacaagaactattaacatagtacattaattttattgtgttgtattagtggaaaggcaaacactattatacatgtctgttgtgtcaattatttacaatttgggctattccacctgctgaagaaaacaaagaaatgggggcaactcacacttgcaacaagcaaggttgagagtgaaaaattaataattgcaatccaaacatgtgtgcaaacaaataaacacattccgatcacgttgaaagtgaaaacataattaaaaactaacctctagccattgcaagctccaatgtccatagaccttagacagctttggcttttctaaaccttcacttactcaatgtgatggtattttattttctgaaggagcagtaggcttagtgagtatgactagaaacaatgagcaaggcttcttatatagaactctactcatcatggagttcaaactgtgaagaggttagtgggaaccataaaatctgcacatgatctcattcataatgttagtattgatgttgggttgaatatagcttataaatggagcacatacggtaacaaccttaacataaccgtttccactctctcaaaatgaaaacataaaaggatatggtccctaaaatatagggaactgccaacattctcccttttggtccatttatcccattatcaatcataaaagaaactaaatatacgaatcatggtgataggtcctctaataatgagtattatctcctatgtatcacaatataagtctctcaacactagctcttaacataatgaaaaaaaccacatgtttattctaggtcaaaactaaatgacatttctaaaaatgaataaatatgtacacaaaataaatgagaaaatatcaaattgaataagagtttcatcaaaacaataaatgcacatacaatgaatatcacatcatggaaccaagtctcattcttactacatgatccttaaaattattcggtggcatgcctttagttaaaggatcaacaatcatcaacttagtgttaacattttcaatgaccactttattttctttaacatgttctcttatatatgactaaatatttaatgtcgatatgcttacttcgatttccactcttgttgttcttagccataaataccacaacaacattgtcacaatacaactttaatgaactagaaataaattctacaagtctaagcacgaatataaactcttccatcatacaacatgcgaggtagcctcaaaacaagaaatgaactcagcctccatagtggaagtagtagtcaaggactgctttgcacttctctaagatacaacttcaccagctaacaaaaaaacataaccataagtatatcttctgggattaatgcaacaagcaaagtttgaattagagtagataatcacctccaaatatcatcaattcacatatacatgagcatgtagtgctttgttccttgaagatatttcattacgttctttgtagctttctagcggtcaatacccgaattactctaatatcttccctaaactccaacaacaaatgcaatattaggtctagtgtaaacctgagcatacataaagcttccaacagctagcatatggaatatttttcatgtgattccactcaaactcattttttaggcattgacttaattcatatctatcacccttcacaatgggagctacactcaatgaaagttttttcatgtaaaacctctctaaaactttgtttatataggtcttttaagacaaatccaaaatgcctcgagatctttctgtatggatcttaatgcatataacataagatacctcactcatatccttcatatcaaagttctttgagataaactgtttcaccttatatagcatactcatatcattagccacaaacaaaatatcatccacatataaaataagaaaacaaatcttactcccgctaaccttttggtatatacattgatccatggcattctcttcataatcaaatgaagagataacatcatgaaattttaaataccattggtgaaaagcttgtttcattccatatatggatttattaagcttgcagattaagtgttgcattagagaagaatccttcaggttgttccatgtaaacctcttcctctagatcaccattaaggaacttttttttacatcaatttgatgtaactcagagtcgaaatgagctactaatgacataacaactcgaagagaatctttcttaggtacgggagaaaatgtttctctataatcaattaattctctttgagtgaaccctttggcaacaagtcttgtcttatgtctctgaatgtttccttttgagtctttctttgttttaaagacccatctacatccaatggcttttatgcaatcaggcaactcgatgagatcctaaactcgatgctatagatgccacaaatactattccttagaactcatggctagtgaaaatgcatcaggatcattttcagctccaatgttatagtctgattcttgcagatacactacataatcacttggaattgctaatcttttgactctagtagatcttcttaatattgctatattatcttgttgaggaacgtgtttctcatcaacaacttgatctacataatcatctttagcaaattgtcgaacttcaattactagttgtctaacaccctattgaacttgaggggtgtgaatgactaccaatctatcacttaatccagaaggttgatcctcataatgatccttttcaaaagcaatgccttgaaatcaattactcccagtaattaagtcattttcaagaaattttgcatttcttgattccacaatcctagtattgtgagatggaccatatagcctacaacccttagaattttcagcatatccaatgaaatacccactaatagtcttatggtctagtttcttttcttgtgagttataaatcatcacttcagactgtaataccttgaatcttaagcatgtaattaaccctgtgattaaggccataatcatgtgttaattattcgaaagagagcagttagcagaaaaccctgtatgggttgcggcgctgagggcgccaggtctggcgctgatggcgccagagcactggagtgtggtgccaagagcgccaggtccacgctgagggcgccgtggtctctgggaagtggcgccaggagcgccagaggtggcgcctggggcgccaagtttcccaggtggcgcggagagcgccagaagtggcgccggtggcgccagggtttctggaaggtggcgccaggttcgcgctgggagcgcggggtcactggaggttcacgccatgggcaccaggtgtggcgtcaggggcgccatgtttccagctggcgcggatcgcgccagaggttctggaacgtggcgctgagagctccagatgcggcgctgatggcgccggagtttctggagcacggcgctgggagcgccgggccggcgccaggggcgccgcgggtcgagctgagtgactatttaaagcccaaaacacgaaaattgaaggggaaaaggtcttcttcttcttcatttcgccctagactccattgctaaccatctcaagcttccttgagccatatttcttgaccaaaacaccttccttcggctcttgattgtgagagaaacactatggaagcttgaatcactcatcctttctcatcaaaaaccccttttgagtgattttgaaatccccaaagaaaaacttgagaacttgagtgtggctgagacccattatgtgggaaggacaccggagctcgaggaggtggtcctagggtcgtcttggacgccgttgaggtaagaaactcaagtttctccgtttgattttgagattaggggtttgcatgaatattgactcttttgtaatggggttggaattagcccaaagtcttgtagagacttgtgttcagggggttgttgtgatgatgttagagccttcagaaatcattattgatgaagtttgattttggttctgagacatgcatgtatagagaaaggggctgagtgcatggttatgttgaaccctagagtagatgataaagtactcttgatcggacggtcatgatgatgatggattgtaattttaattttgtttaagtattttgtagctatgagatgcttctttttcataatttaaaaatgaatcgtgaaaaggaaatagaggcataaatatttcaatagaaaaatcataattacaattatatataatatttaattaaatttggattgaatgacaaattaagtttggattaaaagaaaattagtggtacaacaccaatgaaagcacgagaacccaaaagacaaaaatttaaaagtgataaataatatttaatttgaattgtaatattaactagcttgcttgggttatgcattttattaaaatttttatgatgatggaacttattatatgattggacaatatttagtggtgtataattattttagttttacttacaccaaataattgtaagtataagactttgaagttatacctacaccaaccaaattaatgtagatacaagttttatgaagtttcatataaatcatgtagtcgtaggtatatgttttttagaatttttcctacactaagtttttgtcgataataatctttttgagttctacctacactaatcaatcgtggccacaaattttatgcaattttacctacacaaaatagttgtaggtagaagttatttttagttttaatgaatttatctacacaaaataatggtaggtacaagttgttgagttttacctacattattcaattgtaggtagaagtattttttagttttacctacaccaactcatgaatgtaggtaaaaggtgtctgtaggcataaatcaatcttcttgtagtgcaagtatcatttgcaagagatcatgctcatgagtttccttctggcgatgttttatgagctttgatatctttgagtttatctctttctccaatctccacatctgtctattgcttttgtttggcatgtatctaaacagattatgatatcatttgtcacattatagcatcgctaataagaacaagaacataatatgcaaatatatggtaaaagatgcataccgaaatccaggaattccagcatgtatcttggacaatagtttttgaagatctctaagctttgagaatatttcttttccttcaatgtaattgctaccaaaacaagttcttgaaattatgtcagcagacaaacttcgcagatctttgtcgattttaatctctgatactgcttcaccactttcaagtctagcctcccaagaccttagtgttatatttgttgcgtccactatcagattaaccattgcctttaacatgatttacagcaaaagcaaattatgagattgcaattctaaggtagcaaaactgaaattatttagctctcttgaagattacttttagactagttttcaaggtaaaaatacttcaaaatactttattgagttaagggtcttgctagcggacactgatttaaggaattaaaaaaggaaaaccttttattgaaataatctaggagcgcatttaaaaatcataaggggtgcatttttacacctctcaataaaaaaattctctttttacttccttaaccaatatccttaagacactgattggcagtgccttaactcaattacaatttgacaccttcaaggaacaatttgtatggacaagccaccttcaaggaccaaaccaacataagttgtcacttttgaggacaaatattatattttttggtcttgaatcaaagatcaagggtgtcttccaacccactaagtcagagactaatcccactcgcatgtgtgactaccactgactctatggtattttgcacacaatgaaaatagaacacggatttgtccactaaatagatcgttttcactcatgtaaacataatgaaccttacaccattgttccaaccctttggattagacaaattttatattaactccacatctaattcttctctatggccaatgtagcattccatttctcttgagcagtgtaggttggggtacaataataaactcaccttcaccttatcagggtatagttcaggggcaattatcttcctctaatgagcccaaatttgcccatttgctgacagtataccttggcccaagagtggtcccagatctttggacaaataagtaggcttccctaaatccaaagaggtatacatgatgatttccttcaccatctctatatctgtcaccattagccactgtatagtcccagtagaaaacaagtatatgggacttgcataaatcaaattgaaatcaaaatttggacttaaaatggacggcaatgaagtcatgtcaacctacttgaattttatgattatcattttcatatcagcacttcttgcaaagtatcattctacacattattataaacaaaattacaactagggaaaatatattaacttttttatattataattgagaacttgattctttgtgcatgaaattaagaatgcaataagtgaacagaccaaatcaaaaccatgtggccgacacaggcctttggaacaagtgaaactattctgactttggcatctgggaagtaaaatacattgttatggaatcagaaaatgatttctatcaactttatcagatcaagaacagaaatgagttcataatgttagagtttttatatacttaatgatctaatcattttcacaaataatattagatcaatgcagaatgaaatagaatataaatacctccagccattgctccttgtattaggttgtaatactacaatgtgaagtgattttttgagtcttccaaactcttctctcaatttgcactggatggtgtatatgcactttatatgtgagtgagttcaaggaccccagaaattgaagatacacacctatatatagagcttttccatcaaaggtgtttttgtgtgtatggttatgatgggaagttaacagcggttgagataagagtagttaactataggaatagttatgactatccatacgaatagttatgactacccataaggaatagttatgactatccatacgaatagttatgactacccataaggaatagttatgactacccataggtatagttaaccaattaaggttggttacaaaataaaaccaacacataatacatcactaattacaaactcaactcattctttcagctttcaacgtgctcaaccatagattaaccaataaactcaaaatataaaagagctctaaaagtgaaacaaaaacaccaagtttatgcttatattttgaatgttttaatttttataaccaaattcttgctggaaaactcaaactgtaaaagataaagactatcctggtttcaaagaaagaagactatactttgattcagctctatatgcttttgttacttcacttctatcagaataggagtttcacttgattatccacacaataaaggtttccattaaatgtcaaagtagattaccgaagtgaaactccaattctgattagagaatagttacaaaagtacctatagaattatttatgttgtgtccttcaaaaaattctgccacaattgcagccgcaagataaaagttttttgacttagcgcgactgtaatttgtggtgcatcagctgcattttcccacactttcccacattgtcaaagattaacagctagcaaccgcgaccacaatagaaaaccatggtgagtattgattcatatttctaaacaaaaatgaaggaaggaaacatgatgtttataagacaagacaagaaaagtaactgaccatattggttgatccacttttgaatgtgagggaagagagtaaaaggccatttgtgagaaagagaaacatgttgatctttatctttgacttgagtggttggagctgactgaacttgaagcaaaagggtcttcatttctggaatgttgccaaagtagaagtgaggtgaaggaccatgaatcccttgcctatgaagctttcctctcagtgatcttggccttaacaccaaaacattgacgacatgcatcaacaacaccaaaaccattcccagcacaactttcatggtgctcatctccatcatcactaccctcttctcctctccatgcaactttattttccacaacaaaatctgtgtgtttcaattgtatgtttactatagtttattcccaccgtgctatgcacggtattcattttattttcaatttcaattctaatgatacataggaaatactaaaaagattaaaatgcaagcgtgaaaagaattttgtataagacaaaaaaaaatacaataaatattatatttaagattacataaaaaggacatgaaaaaaatattaacgtaaaacaaatcattattaaaagaaattcacattgttttgttcaaggttttttattatacatacacattggagaaaaagtttaatacttcaattaaataaaagaatggcatctacgttcacaacctaagtcaggatagtgcaatatcctcggcaataattttcaatttgggcatagataaagagtgttaatagttctatttgaaaagagatgttctatacttgagaaaaagtggttaaaaaaaagagtgcgtatttataaattaatatttatagaaatctcatatgcttaaaaacacttttattctcttttatcaaacatggaaaacttttatttccacaattatgttttgatgttaaaatattttctatatcaatcgataacttaatggcaaaaaagaaattaaattattttaagtttaaattttttagtctactatttcatcatttcttatctcatttttattttttaaagagtaaatatctattttggttattgaaaatatgagacagattgatttttacaagataaaaaatttatatttaatttccaaatgtgaaagagtacaatatgttggtcttgtcttcaaatttatgaaattgatttatcattaaattataatatttaagtatcaaattgagttacaaaattcaggaactaatttattattaaattatcattaagattaatctatcatattttttatatatttaaaaattaatttaaaatttttcatcgatcaatttataatcccactattacataagttacatccaaaagtaaaaagacggaataaatatattctttgtcccaacatatccatgcatcttgggattcattccacggttacatcatatttgtgaaggagatttagggtgggtgttaattattggaaatcttctcatattcttttttattcttacgggaaaaaaattgtatgtaaataattcaaattaagtaaccatgcatgaattatcctctaccataatcctctcatcaacgctttttatttattactccccaaaattttctacaaagctgtataatatttgtcttcctctgcagcaccgccaactaacaccatagggaataattgccattgtttccgtataacacccaagcagagaatacaatgacagatgtagcttctacaaatcaccgcctacccacaccctattcccacaccctcggcccacctcacaccaaatactccttccaatcttaaatatatatatatatatatatatatatatataaaatctcatgctaactaaacaataaacttaaaaagtttaattaattatatttaattatatcgatttcaataatcatttattaacttatttttattaaaatttaatattaaaaataagaaaaaatcattaaaattaacatctcaattaaataaaaggtattttaaaaataataactaaataaaataaaattaattaagagaatatattgtattaaaattttaaaagactattttagtattaaacaaaatttgtggattttaaaaattatataagaatattattatttatcaaatttttttataagatatttatgatactttgaatattaatgaatttatattataagaatttaaatgatttaaaagatctttataaatttataagatttgtaaggattatgtaaattttttaaaacacattcaaaattataagagttgatgaaaataataataagaaatgataaggtttagataaataaaagtaaatccaatataatttttttaaccttttaatagttatattgattataacttcatactcttctatattaaccttttttgtaatagtattttttcattctcacttttcgatttgaataatagatttaaaattatatgttattttttgtaattactataattatttcatgataaatctaatgacatgttaaaatgggatgcactaataagcatattactagaagggattggtaggaggataaatgagtaatgtgggtgacaaattaagagaaacaatcacaaaaatattacatccatcaagtgatggacataatcaatataaaaaaaatatggttagtcttagcataagacaaacattaatttaatttaaaataaaaagggcaatgggatgagtatatttgacattttttatttcaaatgaataggagaaatatattagacacatgcatcttgaagaatattaaagagagaagagagtatgtgtgatgagagaaaaaaaagtatgataataatagaatcaggaagaaaaaaatctagtaaaatctcaagaatttggatgagattgtttgataaatattttatgttaaaaagtacgatgaaattcgttaaaatccttcttgaaaaataatctatcaaaatttatatatttttaaatatcaaaaaactttttataagttaaaaagaatcttaattaaatactactagaatttgttgtattcgttaaaaaatcttaaaagtcttaattaaatgatacaagacttatttatactatttaaaaatcctcgctgaatactataagatttatttatattatttaaaaattcttattaaatattataagacttttttattaaaaaaatcttttaaaatcttttgaaatcccaattcaaatacaccccttaagatttacttgtatttaatataaaaaagtatttattttttcattttatacttaagaagaggaagagagtatcttcataaattgtaggtggtggtaaccctcaaaaatccaatgaccaccaccaacccaccgaatatagttccacctgataagtgccatttatgcttgcacatgacacttgtgctcccacgttcccaccatggtaatttacatggtcgccatgcagtggtgaggctggcaattccactcataatgagagagaaacaaaatacttccagtttgtttgatagccataaccaggattaaaaacaaataactggtcaacatagatccattaccttcttattgaagatgattccattcctcgatcggctcccaaatggaccacatgcactggagcacaccaaaccgcggtatacgctgatcgcccactcttaccatatcgtccacattgatgaatgatgaagtaaatatcaggttgacaatgttggaccattaatttgtaccgctagccacttgtaaatgcttgctcaaacagagtatgcaaaatgacaagtgaaaaggcaatgtacaagagattcctcttccctgccacaaaatacacattcatatcgtggacttttttaccaaaatggttacttttgcaaaactatttactagtatggatgttttaaaaaactatttaattatagggtgatttttcccaactaggatttaagaagtgtcacttttagtggtattttgtgtttttcgttcgtcctacagcatgaggtgttattttgattgactcctttttttcggtattttgtccatataggaggtcccactctggtacagttcatccctagctataaaataagtatttagcatcaatctttttaattactagatcttatgtgaccattttcaagtaactcccaatatagcagcgaaagcaagatgcataggtggatcaactcattaagctcccattgaactaagctccacacaaggaaaagtaattgtcattcattaaaatatcgatgtttagtttaattattcttactttttggtgttggtttcactatttttatatttttactaaattttaaataaaaatagagatattttttatatttatttagagaaagcaagaaaagattatcttaaatgaaataagttctaagtaatttttgtgtttatttgttattttcattttcaaattatatgtgtgtatttatatgtgtgtgtggagcatgatcgatgataaaacttcataaaatcctaaaatcaagaaataagattaaaaaatggtttttttttttatataaaatcctaataacaatgtttaagtttaaaatggaaatataaaataaataaaatatcataaaattttcttttaaaagaatcaaagaaaaatgtacaaaattgttaagaatttgttgtatctcataaaacatgtttagtgacgacttttcatttttaaagtcgactttcgtagatgctaaattcctgacaataataaatcatataagggtggtgcctactatgtctacacaaagaaaactatttacgctaaaatcccatattggtaaatagttttgcaaaattactcattttgattataaaaaaaataaaaaaatcatatcctgttgcatctatcgccatttccctcctcctaagtttgtcctttgtgggcagtctatttttgaaggttctctacataaaaatcaatacagttgaaggtatgcatgtcccgcacaatttcttgtacaagatattgtcaccccaaccaaactaccacgtaatagttgatacgctaaatgtacagaataatcacctgagttatccacaagccataccaacttatcaacctcaccctcctttggaacttgtaaattaatatcaatcatgaagtttttcattattggtaatttccatgcaaatcactgtctcctccattctagcttgccctcccacctcccatccgaccaactcccacctcctttacaagtttttgttgttgcaaagaattaagataaatacgactaaatttattcttaagactttgctcaccaacccaaacatgatcccataacgagactatgttgcctctcccaacacgccacttcacaccactatcaaaccacaaacccgcattcttttcactacatgctcccaccaattccctccaccacattaaatccattttagaattcctattcctccctcacatgcactcacaccatatctagctaccaacactttcctccatagcccctcctagtcatgattgattcgccaccgtcattttcctagtaatgcttcattgaatattttagatcactaatttccaacccaccttccccttttggcctacataccaactcccacttaacccagttaatttttttcctctcctcacaccacccataggaactccctctggatactcgctaacctcctgataacacccttaaggaccctttaaaaaaaaaaaaaggaggtaaagaataaagaatagatttgactagtagaggtggcaaaatgggcctgacccagcgggccatcccatttggtccaccagaaaaagtggactgggttaagattttgaactcacgctgactaaatgggccgggccaactcgacccacaaaaatccaggccaaatctgggccaggaacggaccagcccatcgggtcaacagtccaccagtgagtttgtctgagagtgagtatgatatattaaaatttaaaaatagtaaaatattgaaaagatgttcttgttgaattgagtggctgagagtgagtcagtgagagagactgagaagtgaagtcactgaagtgaggtgagagtctgagagtgagagactcagagataggtagagtcgcagagatgagagagcttccagcttcatcttcgacctgagtcacctgacaacctctacacggcttcgtcttcgtcaatcgtcttcaacctcgtcacaggttcacaacatcacctcgttcgttcgttcttcgacctcggtagtgaccatgaatgactcggcggtgttactacggcgtcaacctcgttcgttcgtccattcttctccgtcgttctccgttcaccagatcaaggtttgtaacaactcctccttgatgctgaatagtactctgtgtgtgtgtgtgtgtgtgtgtgtgtgtgtgtgtgtgtgtgtaagtgtgttgtgacttgtgagtgtctcagttgaaagagatgtattctttgtgtgtgtgttgtgacctcgttcgtaggatagagatgcaaaattgcaaatgccatgaagaaaactagaagctgataggctctttcaagtttcactagtcttcaacaataaaagggaaaactagtttttacacggtccatgcttgccttttttcatgattgtgtaaattgtttccatgattattctgttaacacttgaacatgtacagatatttttcagtctttcctgataattggtttgaaagtttcttgttattaatattcctccttgcttatcgggttttcgaaaatgatttgtcctagttggtttgaaactttcaaaccaattattaggaaagactaaaaaagatctgtacatgttcaggtgttaacagaagaatcatggaaacaatttacataatcatgaaaaaaaggcatgcatgacagtgtaaaacctagttttcccctttattgttgaagactagtgaaacttgaaagagcctattagcttctagttttcttcatggcatttgcaattttgcatctctatcctacgaacgaggtcacaacacacacacacaaagaacacatctctttcaactgagacactcacaagtcacaggtcacaacacacttacacacacaaagtactatttagcatcatggaggagctattgcaaaccttgatttggtgaatggtgaatggagaacgacggacggacggacgaggtcgatgctgcagtcacgatcaccgtcgaacgaacgaggtgacatcgtgagccggtgatgaggtcgaagaaaattgatgaagacgaagccgtgtagaggtcattaggtaactcaagtcgaagaggaagctggaagctctctcatctctgcgactctgcctctctcactctcatactcttacctcacttctcagcctctctcactgcctcactctcagccactcaattcaacaataatatcttttcaatattttactattttaatatatcagactcactcaacagtggactttggcccagtgagctgacccagatttgacccgcatatttgtgggtcagtcagtatgagttcaaaatctcagcccaacttactttattggtgggtcaaatgggctgacccgtcgggtcagactcattttaccacccctaacccaaccaccaaaggatagagtacgatacttctacaaggccatttaactcctggactttgacacaatagtagcccaagtagctagctggaaatgttttcattgttaaaccatccaatcattagccttttgttttacttttatatatattttttacttaatcatgtcaaatatcacattttttaaatttaatcctcattttagagagaataaatacaaaagttgtaatatttaaaaacaattaaattagagatttatgatgtttaattaaagggacgaaatagaaaacaaaatgtatattttaaaaaaaatctaatagaggatcaataaaaagttaatttgataattttttttataaagagacgtgttatatatctctaaaagtcactaattaatttaagctttcttcagcattctctcacgctcagtgggcaacccagaaaaaatgaccacccactcaatccatcatgctagtcttctaaaattgtatgctccatgtccttttttaatggttttttttttcttaaattagtttttaaaaataaaataatcatcaaatccatatattgtcatcatagctttaaagaattagtctcatggtcaggacgagaatgcagaactttgttaaggggaattggaattttttttttctttttgtgatccagaacacacaataattatataaaaaaaaaaaatctgaagcattagcaggatgtgtgcacaaaaatattaaaagaaagtagacacaagaagtggaataaaaagtatattgtttactaatgtgtataatgatgtaattctggttttatatatataaagagagagcagaaactagttaataaaaaatatataagaccaatttacttgatatgattgccacaaaataaaattaccactataaaaaaaagttatttccgacggtcgaaatccattggaaatatcaaaaatctgtcggaaattcgatatttccgatggattttcgacggaaaaaaatccgtcagaaaaacggtcgttggaaatttgaccgacggattttgtgtccatcggaaatttccgacggaaatgaccgtcggaaattactgacggaatatttccgtcgaaaattttcgacggccgtttccgtgggtaatttccaacggccatttccgtcggtaatttccgacggactattccgtcggcaatttccgtgggtaatttcagacggccatttccgtcgataattttcgacggccagtttcgtcggtaatttccgactgcctaatccgtcagtaatttccgacggccaattccgtcggaaattttcgacggccatttccgtcggtaatttccgacggccatttccgtcggtaatttccgacggccatttccgtcggtaatttctgacggcattttcgtccaaaattacgtaccgcttattccgttggtaatttccgtacattttgtgcaattattgatattaaataagataattatgaaattaaagcatattataaaatgaaaaactgaatttatacattaaaagcaaaatgtttaaacaaagtaaaataagttccaaatataaataaaataaaaccacactgtttaacatataataactgataaactgttttaaagtcaataattaacatagtcattgtcatcctgtccttgctggtcatttgctggttcatcattgttttgttgctgcgcatcatgtgattgatcatgttgttggtgttgttcttcggcgagttgttgctgctgctgcataatgctgcgagcttctggaggtagaaattgaagtacaactgattgaaaaactcgcatttgttccgttgattgacgcaacgcctcttttgattgacgcagctcctcctttgattgacgcagctcctcctttatttgattaatttccgctgcttcataggaatggctagatgacccatgcaggttttgcacaaatgtctcatctccacgtttataagaatgagcaagatcgccagtaccgtaaagacgtcccttgcgcataggtccagctgctgcaatccaacactgactccttagtctttgttcttcagcaggagacaatggagtcatttcagaatcaccaacactagattgaacatcagacctagcttgagataatctagcctcaaaattttcctgtcattgaaaaacagttattatttcatgagatgaataaaacataatgttttaatacgaaaaccatgacaaattagcatctcacatgtgtctgcttagatctatcatcgacaaattcaccagtatccttccgtaaatgtgtttgttgaaaaatctcatcaatgtatgctgatcgaccaagttcctgagactaataagaaaaataacaacacaaatataacattaccacattgtatggtggaaaaaaatttaacatgcatatttgtaaaatcatcttaccaatcgaattgcatgatcctgcaagctaatagaaccacctgtgtgcatacagccacccttttcagatgctcgattttttttgccttttcacacttggaacgatactcgggtgcattccaatgtgataatagatcattccagacacgatctccaatccaatatggccttttattttcatttcgggcatcgcaaaacatttcagaaagcctatgagaggcttttgagtgaaatacttttttaatttcactctcttcctctggtctccaaaccaatttcctctaagataacacaaagttataatattaaatataaatacataaagaccaatctcatcacacaaaatattggtgaaagacaaccattttactattacttccaacgataaccacaaatgtatttaacaacaacaacaacagagagaagaaaagaaaaaatattaccacaagtgactattagtaaatgtacaaaatatacacataaaaacaataatcattcaacaaaagaaaatgtgtagaaaatgtgggaaaacttttgcagtcaaaggggattggaggactgatgagaagaagtgtggcaagttgtggtattgcatttgtggctcagacttcaagcacaagagattagttaaggatcatattaggtcttttgtaaagggacataaccctcatcctccctttgaaacctttgaggatgacaaggaatgcattactactggctctgatgaagatgaagttaatggtcatcatacatggtctaacaacattctatagctttcctttattatgaagatatggcatagtagaacaaatgtatttaacaataaccacaaatgtatttgacaacaataaccacaaataaccccaaatgtatttaacaacaacaataaccttctatgtattttctttaactattacttccaacaataaccacaaatgtattttatttgtacaacaagagtattatgaagataatattctttattaaaaagatatggcatagtaaaagaaatgtatttcacaatatccacaaatgtatttaacaacaataaccacaaataaccacaaatgtatttaacaacagccacaaatgtattttctctacaatgacttccaacaataaccacaaatgtatttaacaacaacaacaacaacaatagaacacaatttaaaccataaaaagataggagatcgttacgccattgaaattagtaagaatgcaacattatattaccttaaaacgttggaaaaacagttcttgatggttttttggaattgctccccaagttggccatgggtgatcaaattgttgtctaatggacaatgtgatagcctttgccacaacctttgatggatgaaaacttaagacaacaaataatttgttaatgtgtatgtccataaataataaatggtcatgatatatttagaatttatgtatattgttaatacgtacactccatttttcagttaaattgtcggatgatcattgataggtgggtcgtccatggccaaatttgctagatcttcatcagaaggtgtgtttgcagcacctggggtaggagatgttgtgtctgtaggcattgtggatggtccagcagcattaattggaatagatggtatagcttcattcgaaggtggagatggtgtaggtaaaaaatctaatgatcttattggcatagatacactagacgaggatgatgtagacgacggcaaattatctctaggtggtaatagtctaagcacatatcgttttttctttccacctatctgattgtcaatgttatcattgatcggtggtcggggaggatcaacaccacctgatgacatatctatatgtacaaaaaagtgatatgggcattaaagtatgtgaccattaactatttttacccaactggcatattttccttttacacaaaaaatcaaagacattaacaaagttccattccattacaataaaacaataaatgtttcataagtcgggaagataaatatttaacatgtctttaactacttgctggcattccctctctgctgtttcagatcgtacatatatgctttcaatgttagctttttccccagtacagtctacacactctataccatattcaagtgtttcaacagccatacaattatctaaagtcggaacacaaattcttactatgtctctaaatactttatcacaatccctaattgtcatctctcatcattgattccatctcccaaattcggtagataaatctttaacatttgtctaattactttctggcattccctctctgcagtctctgatcttacaaacataggtttaactttgtctaaatcaaaagagtcttcaactatgttaacatccgttgagtcctctaaatcaaaagagtcttcaactctctctaaatgtaaagagtcttcaactctctgaacactcatactgtcctgcaaatctaacgagtcttcaactctgttaacatccatatagtcatttacatctaaagagtcttgaactatctcaacatccatggagtcctctacatctaaagagtcttcaactatctgaacatccatggagtcctctacatctatgttaacatccatggatgcctccatatctaaagagtcttttactctctcagcatccatatagtttggtcaatgtaatccaaaatcaactttgtaatcattaatacagtcttaaactatgtctacaatgaaaaactattgaagtctgttacgataatggaatataatatttacttggcttagctttcataatcattcattataaattcagctgtaatatatgactcaacttggtatataacatccaaattgtgttaaccaacacatacatacatacatacatacatgattcaacttggtatataatgaccgtatgatgaagatgataacattcaacattagcagtgcaagcatgtaatcatgaacagatataacaaaaaaacctgtgtgtacacaaaaaaggtggttcatcttaaatttctttacaagtaattaggggcggtgttttacactgattgcagaagttaaataaggattcataacatcaatccatttgtaatcctattcagaatcataaacctcaaaatcatcttctaatttgccttcattttcttcttcaatattatttgtctgtccatgcaaagtatttgattggggatcatttatgaagacatcatctgggtccacttcttcaaccccacctctctgatcttgcaagccagaaatgttttcaacttcgatgatttcattaccatgtgacatttcctctacttgataaggcacattagttggtgcattgttatgttctatgtaacccctgggctttgtttttattgcaacacaccaatcacgtttgtccggtcttattgctggataggacacataatacacttgtctgacattctgggcactaatgaatggatcaaatcgattgtatcttctatccattcgaatttccattgttccatcttttggatccactcttgttcccctgctggatggatcaaaccattcacaataaaacaaaacaacttgcttagcataacttgtactgttatattgtacctcatatatatgtttaatgatcccataaatcatctgctcctccctctgtaaccccttgacataaaccccactatttattgtttttttgccctcagtccaacattgagtatgaaatttgtatccattgacaaagtacgtgtgccattctttaacgtaactcataggaccatacgataaatcctttaagtgttggtttgtgacatttataccagaatttaccacctacatatagaataacaatcaacaatttttttcacaatacaatacaataattaactgattaataacatacatgttcatgaaaccatcttggaaaatccgcatggacattacgagtatatccatttggttcagtaatctgttgggtttgtacaaatgaactgtccatatgcaaatatacatatggcgcgttaggcttccattggacaacaaccataagtacaaatttatttgaagaaaagtatgtcaacttactcaaggtatggcctaatttcggcacagtttatcaggacatgaacatgggctgagtttttttcttcatcagtcaaccagtgtatgacctccttcacagaagcccgaccttgttggtcaaacactgataacattcagggacgaggatcacttcccattgtactttgattcctaatgttgcgtgacgacaacataaagttatggaaataatgggaacaaaattgggttgtctcatgatgtaagtaagacgcgcaaatcgatccttcgacccttgccctatttttcacagctcgtttacaatcacccatgaatctacaacatttgcataagatatcagtcaccactgtacattattgatttgacattttaagtcatacacaacaataaatttgttacctttcaaatggatacatccatctatattggactggtccgccaagtctagcttcgtatgccaaatgaactgccaaatgctccatcgaatcgaaaaaaccagggggagatattctctccaacttgcacaatatcaaagacatattttgttccattctacgcagatcatcctccaacaaagttgaagaacacaaatctttgaagaaatgacttacttcactaattggattcaagacatgtggtggcaaagagctaaaagcaacaggcagtaaacactgcatgaatacatgacaatcatgacttttcatcccatgcatggtgcccttggcaacattggcacatctagccaagttagaacaataaccatctggcattcttagttcttttatccaatgacatactaactttgtttggtctgttgttagagtgtaatttgcttttggctttaaaaatttgccgttagcccccagcttcatctccaagtctctccgcctacagtacaaagccagatccaacctagctttctcattgtcttttgtcttgccactgacattcatgatagtgttgaagatgttgtcaaaattttttttttcaatgtgcataacatcaagattgtgtcgcaacaaattatctttccaatagggaagatcccaaaagatgcttcttttagtccaatgatgccactccccatatccagatactgttggtggaggtaaacctgtgtcggtgacttttggtacatccctaaccctccgccaaacttgtctaggtgtcaacagacgtggtgggtcatcagtttccatttcccctttctttaatgcatttttgtttcttctaaatgcaggatcaggtggtaagaacctacgatgacaatcaaaccaagaagttttccccccatttgccaactggaaggcctttgtgtcctccatgcaatacggacatgccaatctatcgtgggtcccccaaccagaaagcatgccatatgcaggaaaatcattaatggtccacatcaaagcggccttcatcatgaaatttgtacttcttgaaacatcataagtcacaacaccatcccacaatgttttcaaatcatcaatcaaaggttgtaaataaacatcaatcccaacggttggattacatggccctggtaccaaacaagtcaaaaacatatacggtttagtcatacatagttcgggtggaagattatacggggttacaatgattggccaacacgaatacggtgtagctaatgcttgaatatatgggttaaatccatctgtgcataaaccaagttgaacattgcgtggatcactagcaaagtctccatgtacccgatcaaagtgcttccaagcttcaccatcagagggatgacgtaatgtccccgaactatttctattgtcatggtgccatgtcatctggctagcagtttgcttcgatgcaaacattctctgcaaccttggtattataggcaagtagaacatcgcctttactggaattgatttgttattatttgatcccagactactaacacgatatctaggcttgttacaaaatttgcattcagttaatgccccatcatctttataatataacatgcaaccatcgacacaacaatcaatcctcttagcctccaatctcaacttagatattaacctctttgcatcataaaagcttttaggcaaacgttcttttataggtgtcacatccaaaagcatttttgaaataaactctaagcattggtctggaacattccaattggatttgcaggctaaaagtcttgcggatattgataattttgagtcgaatgccccttcgtacaaggggtgattcgcatccaacaataaattgtaaaatctttgtgtatcttcattcggaggctcttccatgttatttgagtttggaagctcaaatgtctctgcctgtctgagagcatcgcacaccatgtcttgcataaacacaaaatcttcaagttcacccacatttgatgtggtatttgatgcatcaatgttaccatgctcgtcattgaaacgagcatgtgacatgggttcaccatgatcagtccaaacccaataattaggcctaaacccatatttgtataaatggactttgacaactctatcctcgaaaatcctagtactatcacatttaacacaaggacatctgatccccccatcattgtggtaacattgctgttggctagctttgttcacaaactcatcaacccctctaacaaaagactctttcagaccatttctacgactataacatctatcatacatccaaagtcgattggaaggaatatagttcatgttctgtgcattatgacaaaaaataagaactttcataaatcacaaaaatgtcacaatttgtcaaagtaatggtaatcatgttttacgtaaagtcaaacattacacacataatgtttgctttcatcaatgaacaagttatgataaataaatgacattaagacaaccataaatatcaataacacatgcatgatatgtaaacaattaatattgcaataacgttctcctgtaaaataggaatgttcagactccataatcagtcattatagctgtgaattgtatgacaaagtttgacaagttgttgtcgaaaaagtacctgcatatgatagttagtgataacggttgaggatcccacacacctatgtattgctgtttccgttgctccacgaaactatgtcatcaaacatatcataattatatacaacgtatacagtcaccccaatgtagttgttctcacaacctagggggcgttgttgtcatgaccaaagtaaacaatattttctagttaaataggaaacgattgtcgacagaaacattactgatgcctttcataaatataacaaccatacttatatagtacatgatcaaatatattaattagccatctaacaagtccaaccttcctggtatgcattcagtgggaaaggctcaaccaaatgaataatgcaaaatgcattattcagggtatcattgtatagtaagttaggtaagtatatagtaagttattataaaactatatgcgaaaacccaaaattaattttttaacataacatgaaacacacacttagttttcatgcttctgtgtcgtcaatatccatattgaaaaacctttccaacatttaagtctaaaaattatccttcaaattatacttaaacccagtccataataatatccttccatagaatcgatctatcattgtggcaactttatagctctcatattgtcacgtgcaaatctaatgaatattgtagtgttttctatttcagaagtgaggaaaatctcacatcaaagtttggcagcatctcctcctgttagtattcatgtttggagctttagttagttagatgtctacctcatttctagtctcattatataaggttttagcaagtatcaattcctatttttagtgattgaaggagacaaacattcaatgacagacccataaatcagcatggcattacatgagaaagctagtagtgtagacacttatgacaaatgggtattttcctgggcaaaacctaacctcactcgcactccccaaaaccctctctgttgaactttgaaatgacccctctcttgacccgtcaacctcacaaacccccaaactggccaaaagttgtaccactctcagcagaagtttggctatccactatggttttaatgtttttttgctggtttaaatacaagaaaacaccaacttaaatcatatgttaattatgaactaaatcaaacatacctttgtcaaatgtatatcacagcttcaaaatggatacccatatgaaaagcaacctctgagcctctccaccagtggtcactgaaaaacagatgaatacttaaaacaaccaagaggggtgggggtgaattggttgaaaaactttgcccaattaaaatttatatcaaagtagccacaggatctttatcacttattagaaattcttttgataccagaaatcaattttcagattcaaaacaaatctttaaaaccaaaatcagtcttcaatcaatcttccccttccaagagcactagaaaacagagtatctcaaactgtgctttgaatatgattcacaaacaatgcaataagcatataaaactgagaaaattaaagaacacacagattttatactggttcacctcaaacactatgaggctacatccagttcttcactctaaaccagagagaagttccactattgcaaaatattctttacaggcaattacaaatctctctttgtcaaccctagacaaagttcagcaatctaaaacactattagatccttagagacacccctttcaacctgagaactctacccagttgaaaaacccagagaaacactatctctatgcttgaaagaaacccaatacaatagatttacaagatttcactgttacaattaaattgtaaaacccaatcactaagcaagaaaagatatcacctgataatccattgatgatcgaaaatgaatgaattacagatgaaaatgcagatgatcaaaccacttatatgcagcttttcttgactttgattgaaagaagaaacttcaacacatgatcttcatgagtaattgattctatgaagcttctacaatgtttctttctcagatttttatcactaatgaaagcattgattgtttgtgaatgaatactcaacgaaaatctctaaagcacttgataattctcttctttttaatttctgtcgtagtgacttctatttataacagaatttttaccaaaaataatcgattaatttagctcctgtaatcgattatttcgactatgtaatcgattaattcaagattgtaatcgattaaaatacttatggctcgttcaagacttcaagaacgaatagtttaatcgattaaacatatacgtaatcgattaagccagtaagacatattttttttttatttagctcaattaatctatttcgatttcctgtaatcgattaaaactgaatgacagtttttaccaaaacatatatgtaatcgattacaatatttggtaatcgattaagccagtcattactactttctcattcttgcctaagtaatcgattaaactgatgtgtagtcgattacaatgctcatggcttgtattcagaaggcttctaagaacaaaataatcgatgtcactaatctggtaatcgattatttctttgaaaaatgatttttccaaaaacttaagcctttttaatcttcctaaattgattttcttgattaacctcattaatcttataattctatatgaatgactaatgaatgatatgcatgcttggattatcagatcatatattttctatttatacaatcaatttgactcactaaggattcacatccttgatcattacttagcttcctttgattcttccatcctttgcatgttgaaagcacaaaacactcatccatgatcttcattgatgctttgcttcatctgaatcaacagtcaccaccttcacatggacaagggttcttcacaaaggtttaagcttagggcaaaagtgggtaagggtgatgagtcactatttatcactaattacttatctttttgtactcattttaatccctaacttgtgcttaattgtttatattttgcattgtttctcatttaagatttaattagaccaataattcggattttaattaatttggattattttaagtttaattattctaatttttatttacagggcagtttaataattaattgaacttggagttaatttatggacttgaagattagtgcgccacgtcagcatcagcttaatatttcccatatcaaattatagatttcatttttatttatgctgaatattttccatatcagattatggattttgtttttattttttattttatctttagggatttcgtttttatttaggcttaatattttccatatcagaatatggatttcgtttttattttattttatcttatcttatctttagtgattttgggctaaaactgttaggaaaagtccattcttttaggttagacagttactatatatttaggggttctgtgcccatggaaacacacccctctagactcactacattctacacaattttagttcagtttccctttagttttaatattttttgttttctgcttctttatttttagagtttacgtttcctatttttccagaatacaattacgtttttaattcagttttattttcgtttctgttccttctaatttctaatttcgttttctgcaatttcttgttcttctatttcgctttctgcttcttctatttcgttttcattttctgttcttaagattgtttaatattcagttttgtttcaatttacgtttctgttgttaaattcaatttaatggaaggctaaacctagggttggaccctaggacagattgcagacctttaatggaggttcttgttcttctaatttgttttctgcttgttcttccttgttatagttttgttctgtatttttcgaattggagtcatgcttaatgattctgaggttgattaattcagtaatctcagtttgcttaattctgagaaacttgccctaacgaggttcacgtttgcttaattcgtgtaatgacgttttagattaatcttcgcttagttgattaatctggactgataagaattaagtagaacaatttatctttcgtgaaccaaggaaattagaggcgcaatctgtcctaagggtctgacttgtttttaatcattgcaattaattattatttctgtttaattttatatattctgccaaattccttcaaaaaccccccaacacgttttcaatcccttaaacatcgacaattgatccttgagagacgacctaggagtcactttcctagtactacacttaattcataataatttgacggagtacgaccttcgatcaaattttggcgccgttgccggggatcatcagttctgttaaagggttttgtttttgtgtgcgtgtgtttttatttttgtttttgtgttcgtttaaaaaaaaaaataataagaaaaaaaattttattctgtgtttctcttttgttttgtgttctgttattataaaaaaaaaaaaaaaatttcgaattgtgcgtgtgcctttctcctatatcagttcctatttttgtggtttgttataaactatgcttcaatttttcatatcttgcatattgtaattagggtattgaggaagcaagccgcaggaagccagccgcagccgcgcatactaggaggaagcgtagtcgcaaggagtagcgtgaatagtaacctagtttttgaattaattgcgatttttcgttttgatagttagacttgttatttttccgtgaatttttttttggtaacttcttttagcttatatttgttaggaaaaataccaaaaacatttaaagtactacagattctgagatacgaaaatttgggactcaatttttttatcaaaacttaaaatggtcataactttcaatccgaccgtcagaatttgaagtattatacatgtttttggggtagaaaaaaaagatctacccagcccagcacgctatgcttgctggccaccgtcggatcttcaaaaagaggctgttttctaatttatttttatttttgaagttttattttcctatttttccatatttgcttaatctgttttatttagttatcctttgaattaggtcttgaaatttggtatgctgtcttttcatgattttagggtgttgctcacaaaattttaactcatttggacttcgtttgagtataggtctagttctacctctctttgttcttatctgccaattgcttgatatgctgcatattgtgcatgatgtaacgccccaatttactaatcagggtcattactaaccacacatcataaacaagcagttaatcaatcagagttgaagcagtttggaagcataaactagaagtgacagcatcaaagtcactatcataacactgtacatcataatatggtgaatatacatcatagtttcactgtacaatacaaaactgtacaatcatcccatcagggtgcatcaaagtacataaccaaaacatatgagcaacatgctcaagtcctctatcatagtgtgtccttcagcagctaatcctgcacaggcttcttgccttgggacctctctgctgctctggaagaatcacctgcaaaacatagccccacacaaggggtgagatataaaatctcagtaaactcagggcccttgaaggtatttccttcccctggttcactgacaacagatgcacagacagaatcatcatcaacacataaacaatcaatgtacaaccatctgtcaatatccacatgattccgatggtcatcaccatctatcacctatcatcatcctgcggaggctatcacctagacatatatgccgatccaactcacagaggatccaatatatactaggccatctcatggcaggacgtcactatccatcatcaccatcctgcggaggctatcatctatgtatatatgccgatccaacttacagaggatccaatatacactagaccatctcatggcaggacgtatcagaggcacctccgaaaatatataggtacaaccacgtctggaggactcctatataccgggccaacctctatcatgagctacaactcatatctcaatacaattcgcctgaggaggcttcttccgtgaatataggaccatctcactaaggaggctatctctatatcacagaaaacatctcatgtcaggcctatctcaatcacatgtcatctatcctattatcataggatttcacaatcaatcgtgcatatatttagctaaacaaccatagctatgcaccacaatcgcccatcactgggtccaaatcagattataacatcataaatcaaatcacaaccattaccaactcatatggcaccatcatccatcatcagtcaatcagactacataagcataaccaaaccatcacccctttaggagtgtggtggaacacagcaaaggaaccacaagcaagaaccaagagcttacctgctctggaaaagtcaccggctctcccggtcctgtggtcaacaccacctgagctatcaagctcacgtcctacataagaatacaaacacaacacatcagatacggtcctaaaccgtttgaacgaaaggaactccctttcttcccataatcacaacacaatcactgtctaagtgatcatccgaccctcaacaggatccctcttagcctatacaaggctacagagcctccacaaaagctctgatcaactatggccaagcatatctctgcttacaatggcctaaattcaacctctcataatgatcagtttcaaccgatcaaactcatctatctaacctcatgagcaactttgtcaactgctctaaggtccagactagtcaaatagtcgaccttttccatctgcatatacagactcagagccaaaatcaaacttcatcaataatgatgattcaaggctctaactccctcagaatagtcctctgagcataagactctacagagtccgagcctaataacggctctaacacctccaaaaacacccctcaagataaccccaaaaccccgaaatccaatacacagaaccaccagttagagctcgagtttcttacctctgtggcgttcagaaacaccagggaatagctttccctaagatgattcgcccaatcacggcctctttcgctttcaaactccgagctcccaagggttctctcagggaaatccaatctcactatttctcaccttttctcgagaatcaatcggggtatcttacttatctcgaggttttgatcacttttccagttgggtctaaggtgtttagatgagctatggagaagatacgaagctctcaaactcgtcaatggaggttcccactcttttcctttctttttcccttctctctcagcccaaatggcccttttataggcctctgccgcgactcccacgcctcaagcgtggactcccacgccccaggcgtggcgttccagccaaaatttcacttctgggcaacttcccacgcctcaggcgtggctcccacgcctcaagcgtggacctccagcaagaatttggctttctgggctgtttcccacgccccaggcgtggactcccacgcctcaggcgtggaacttcagaaaactcataaatcagtttatttcatctttttctcaagcctttctcttagggattctcaagtatcactataaacctttatcttaggcttaatctaagcttaattatatgcttaaaattcaagatattacacatgactagaggcaatccaggagacttgcaaccctttgatcctgagatagataggacctaccatagattaattaggcattctaggcaattttccttagattctgtagcattagatactgttagtttgaattctgagtattcttcttctgagcatcctgtgcataatatttctgattctaattctgattttgctaattatttttatactgagaataatatggctcaacctccacctcgtgagaggactcttagggagctggctgcacctgaatttacttatgaaagcttgtgcattcagtatcctgatgaggatgttccatatgttctcaaaactggactaatacatttgctgcccaagtttcatggtcttgcaggagagtgtccacataagcatctgaaggaattccatatagtctgttcaacaatgaaacctccagatgtccatgaagaccatattttcctaaaggcatttccacattcattggagggagtggccaaggattggctgtactaccttgctcctagatccattactggttgggatgatcttaaaagaatgtttttagagaaatttttccctgcatctaggaccacagccataagaaaagatatttctggaatcaggcagcttagtggagaaagtttatacgaatactgggagagatttaaaaagttgtgtgcaagctgtccacaccatcagatttctgaacaactccttctccaatatttttatgaaggacttaacaacatggagaggagtatgattgatgctgccagtggtggagcacttggtgatatgacacctgcagaagctaggcatttgatagaaaagatggcttctaactcccagcagttcagtgcaaggaatgatgctattgctattcgtggagttcatgatgtagctgcgcattctagttcttcttcatctacagctacgaaattagagggcaaattagacgctttggtgaatttagtgactcaacttgctattaaccaaaagtccacctctgttgccagagtttgcgatgtctgcacttccaatgatcattatactgatgcatgtccctctctgcaacagcaacctgttggccctgatgctcctcaagcttattctgcaaacatttataataatagacctcaacaacagcagcataattatgacctgtccagtaacagataatctggggtggagaaatcatccaaatctcagatggtctaatactcagcaacaacaaccacctccagtaccaccatttcaaagttctgctggcccaactagaccatatgtgcctccaccagtccaacagcagtaccagaggcaacaacaagatgttcctgttccaccagcccctcaaccttctacttctgaaccttcattggaggagctagtgagacagatgactttgcaaaatttacaattccagcaagagactagagcttccatccagagtctgaccaatcagatggggcagatggccactcaacttaatcaggcacagtcacagaattcagatagacttccctctcagactgtgcagaatccaaaaaatgtgagtgccatcacattgaggtcgggaaaacagattgacatacctaccacaataaccgcacctccatccataccagttcctatacctgcacctgtaccaacacatgagcaaaaggatgaccaaattcgtgcagatgaaccttcttctagcattagttttgatgtgcagcagcagcagacttctatccctcttccattccctcctagatcaattccaagcaaaaagatggaagaggtggataaggagatactggaaatcttcaagaaagtagaggtcaacatacctctgcttgatgccattaagcatatcctgaaatatgctaaattcctgaaagagctgtgcaccaacaagaggaagaggaagatgactggaattgagagagtcagcatgggcagaaatgtttcttccatgacaggtaattctgttccaaacttgcctgaaaaatgtgaggacccaggtacttttagcataccctgtattattggtagtaataaatttgataaagctatgcttgatttgggtgcctccataaatgttatgcctctgtccatttttaaatctatgtctcttggtcctttgcttcatacagtcaccaccttcacatggacaagggttcttcacaaaggtttaagcttagggcaaaagtgggtaagggtttgagaaaatagagggaaaagggaaagttgctgaggaatgagctctctctcacgtcactttcatttttccacacttaaatgaatgccacctcacttttccgccacttaagggtgtgaaatttcaaaaatcagggttccacgctaaccgcgtgaaaacccacgatgatggcaccatcttgtgcagtggccactctgtctgcacgatttcacgcgatcggcgctgcatgtcacgctagtagcgtcatctgttcaagacaattgcacagcttcgagctacccacgcgaatagcatgacaatagacgccatcagtgtgagtaactcgaatccaaagctccttaagtcaaacatccacacgtatggccccgtctacaacacgactagcgccactcgttcgagctaattagcctgcaatgaactaaccacgctatttgcatcgtcctccacgccatcagcgtcaagacttcgaagcctcagcctttcagtcatagctcatgcggttcgcgcggtaaatgacgctggcagcgttgatcattcgaggcaaatggtctgctttgaggcaaccacgctggtagcgcttgggcccacgccatacgcgccatcatttcgatcctcaaccccttcatctgccattgacacgggtcgcgctatatgtcatgccagcagcgtcacttggtcgccccatttggtctaatatgagtattccacgctattagcgtcaaaaccgacgccatcagcgtcagtatgtcgaatactcagtcccttcagtaacaaggcacgccaatggcgccatatatgatgctattagcgtcaaatgttcgagccatatggcctgctctgaggtatccacgctgtcagcgtcatagatgacgcgatcggcgctgatagggcgagaaagcctgaacggtttgtatattttaaagaaaccctattttaaagaaaactgaaagggtcacatactgtccatgttcccaaaaccgctgtgactgtacccatttccttcaatcaccaccataaccgtccccaatcatctgcaaggctcggttcattatacatatatctcaacatttagtctaattcactgcaaaggttcattccaaggttgaagttgcattcacattcaatggcaggcgacaaggtaagctttattgaacgaccctatattgcataataagcctgaagtttaggttaggaaaataaccgtacactagtaaaatggctatctcacgcgagtagcggcaccgctatgtcgaatttgctctgttttgttaatgggcattttgcatgttttaagattgggaactattcattgcaaggcttggttcagttgaaatcttagtatttggttgcatgataaatacactctgttgtttgacatgattgtcactattagattgatttaaatctgggaatgttgattgtgctgttttattcaatgtctaacaaaaactagtagtgatactaaacacatggagttgaagtggttgacagttagataagttgtgaaaataatgtcatagtggttgagaaaatggaatcaaactccatactccaggtatagagtccaaccagactcacacccataactgcattgtgaagccaatgcattcatcttctttgcttctcaaaggaatgaaatctaaaatgagttggttatacacactacttattctggtttctactttgaaggagtgtccaatttatcatgaagagagagtaagggtaaaaagagagagttaaagttggattaaacactcacatattactaggtattattaactgcgtggcaacatggcaatctagttttggtttcgggtgaacaccagccaagttggataaagtgttggagaaaaccaagagaattgaactcaaatcctagactagttttgtcctgactctcttccttaccatatgtgcaaagtcccagttggggtacatgtaaatgtaaaaagagagaaagaaatccacaacagcacaacacccttcacatgctagacagcgatgcactgtgtaccctcttaacaaaaccgggtacacgtccatttccccttccacactgtatggacacctatcccttgagcagtaatgcctctctctctgtgtctgcacacattatatgtcccaatttgagagaagattactactactgtctactaagatacatgattagcaaagggtgcatggtgtttgtagttaagaacagtattaattaaagtggtccatatagcttaagcttaaaaatgggtttgatttagtaatctggtttagtgttcaaatgtggaaagaaaatatatgctgttctggacataaacaacatacattaattatttagcatccttgtgccccattttcctttaataatgcgaatgttggttctgagtcattttgagtctgatgagttgaagctagatttgttgggttgtccatgattccatgagtagcatgatctaaatacttgtgaacaatgccttggattgactgaagttgatatacttggtgatagtctggtatatatgtatgttggttgctgtgcttgaattagtgaaacatgattgaatctctcatagttcattaccgtgaatatgaagtatgacaaagtataagttagatgtttgataacttaaggattttaactgattttaatctgggaatcttgattgggctcttaatgggttgtaatagtgcaaatgttggttatgagtcattttgagtctgatgagttgaagctagatttgttgggttatccatgattccatgagtagcattatctaaatacttgtgaacaatgcatgtaagtaattagatttggggatttactgtgtttttgacatacatacatgttcatggaacaataaaagctgtcatgatcaggtgttaatgtcatcatcgaagtgaattgcgagaacaagttctgctacatccattgaacacagcacactcattgatccataaaaattttaagttgttgaaagaaataatggaaaacaaatgtgcttgcaatcataattaggactgccatcaatacatatagctgattcttgcacttaactcactagcaaactaaaccatgttgttattttcgttgtttaacactaattggtatccattgatacaaactacacaaaactgggaattgttaggaatgttcaagcccgttgaaaaatttgaattgatgcttgcataaattagtttggttgtgtttggtttgccacatgtatctaaatttaacatccatatagtccaagtcagcactcatcaacttgaatcatgaatgtatattggattttttctgagtttcagggtaaacagattgcgaaagggaagaagaaaagcacagccacatctggcaccaaacgagcccgggtttctggatatgacgaatctcgtttccgcaaccatgagtgtgaagagaaatttgagacatggtacttgccaaagaaaataatccccgaaaaataatcttaagggaaacccttccagaaggcaaccctatcttagaggtcattgtaaggcgtcagtggcacaagctagttagcttcgctgagcctagttcaagcttaattcttaaggagtttctagccaacgttgacccatctaccatcgatatgaggagagtcagctgggtcagaggagtacaggtgtcgtttgatgagaagaccatcgagagatttctggataccagctatgatccgtttgacaggtgtgagtttagccacctattcttgaggatgcagcctaacatcttgaccaagatgtaccgggatgacgtaccccagctagccaccaccatcaggcatgcaattacaggcttatatacagcctggaagaccaaacccagcttagattacattccagacaagatggagaaaaatgacttagtaggagatgcagctttttggcaccaatttgtgaaccgcacagtgattccatccactaatatgactgatgtcaacgtggaacgcgctgtcctgctatatatactccggggtgaaggtaatttgcacattgcaaacattttatctaaccgcattgttcacatgattcaggacgctagcagtaagtcgtggctagcccactcatctttgatctctcacctgtgtcgagaagcgggtgttgagatcctagatgaagagccgatggatgttccaattgcttctctgatgggccacaagacttacttagatgctatgaagaacgccacagaagaacagatactcagagcttcgaagctcaccctagagcaacgtgctgcaaggagtcctcgtgctaaaccccaactggaagacactcagccacaggaacctgcagaaccttcttcttccactgagacggcacccagacatgagcctttgtacgaagactcaccgagctatttagcccttcaggccttcatccatagccagctagattatcagacacgcatgttagagaatctctgcaggcagtgcggcgtcatgacaagttcctaccaggcaccagtaattccaccaccacctcctactccagctggagccccagatactacagaggcagccacagccattcccgatccatctcagactgttgaggctgacgatgagacgagacagggcgaggagtgaggagtgatcgtcacatcatttgactttcttgtttttagtataaggtttatatcgtacgtttacattttgaaactaatatatttcactacttcatgcatatatactactgttttatgattaaattgttgtgatcatgctcagtttcgattaatgttccatttgagttgcgatttcacaaataatcttgattgataaaaaatttcagtaccgctatgaccttgttagtaataattataatagtaaaaatttggtcctatgaatatttattttttactttcctaagtttcagtcaagtttcattgtagttcaatttaaaggttagaaacatatttataaatttacatattttttgttatatttttcattatctttaacttaaacaataaatgaacaattttaaaattattattttgtatgtttcgtatgtcaaaatgttggccgaaaattatttaattggttaagtattataaaaatgagggttgtgagaaaaattatgatatagggaaacatttcaaataattaaacgtttgttataatcccatattaatttatttaaacagttttaagtacacaaaaaaatgtttaaaacacaatatatttactaaccttaaccaaagttgtatgacaaaattgtttatactttaatggcctttatgcaaacccattaaagaagattaaataaaataaactaaaccaagttcaaagttcggaaagtaaggaaaaaaattaaatattacataatttatatgatttttcattgggtttaccttaaacaaagaagtaacattttgtagcttgtatgatttttttaaaaataaatcatttgtaaaaaatatttttttacaggctaaattaataaaatattccacaatctaaaaacaattcatactgtatagtcacaattcataaatgaagattaagtcttaccaatgatgtgttcgaagaaggagttatcccccggcggggcgttatcagtcacattcatgtatagtcattcattagacttaatcaaatttaacttacataattatatttaataaaaaatttaattactcacattaatgatatttattaaacaatgtaaaacatgattaaaatgatcataaataatattcatgaatgctattaaataagatatggaaactctatataaagtaatttaaattaattaactttggttgttctataacaaattgttaaactattatatttaataaatatattaattaaatgctattatgtttgttattgtaacaattgaattaaatcaaaagaatttaaaaatttcaaatcttgattacatttagataataaaattataaatatttgtatttttttaaatgttctcactttatttaactgttctttacccattatttatatgataaaaatttaaaaacaaattatatatttaataaaaataaatattgttgattgtttgatatgtaattatgttaaatacttaaaaaaaattcctcgtaagggtttacccatgatggcatagagaataattatttttcataaatgataattgtagtttttatcataaaagatgaaattaaaactaatttatataatgatagagtgagtaagtaatttaaacctttcttgtaacaaatattataaattaattttaatttttatctatatgataaataacaatatttttattaatcatactattgataaaggaatttaaatgaattaattttggttatcatataacaaacaatcaaactattatttttaaataaatatatctaaatatcattacgatttaagaattgaattaaataaaaagacttttaaaattcaaaagcttgattaaatttaaatgaaaaaactataacaaatttatttttaaaaatgtcaccactgttatttacccattattttatattatgaaaatcgaataacaaataatgtaataaaaaaaataaatattgttgatttttttatttgtaaatgtgttaaatgctttttgtaaaaaatcttgttatgaaataagtttgatttttatctctatgatgactaaaataattttattttttatattattgataatttaatttaaattgattaactttagttatcctataacaattaatcaaactattatttttttaaaaatatattaaataaaggttattgtgtttgttatcataacaattgaatcaaataaaaaaaaaaaattccaaaatcttgatggaaaaaaaataactacgctattatttctttattttttgaaaatgccaccactttagtttatggttatttattcattattttatatgatgaaaattgaaaaaaaaaacttaatatattcaataaaaataaatattgttaattatttggtatataattatgttaaatacttttatgaaataactaaagtaataatcaatatgtagacagttgcatcaatgcggttattaacgaacgcatatttattcattattttatatgataaaaattgaaaaataaataatatattcaataaaaaaaatattgttaattgattgatatataattatgttaaatacttatatgaaataactaacgtaataatcaatatgtacacataacggttaaaaacggacgtatattcataatattccagtctaagtctcaattcaactttagtagaaaaaaagtctcaatttcacttatgaaaacagtaaaaagttacttttaaaaaatgtataatggacatgttttacaattttgaagtgatattgttagtcacactttcaaatagcactgtgaccttcttagtcacaaataatgcacacttaatgaaatttttttatgatcgaattgggtacatgattattccttttacttattagatactaatgttaatgtcaataacaaaatattcaataaatttatttacaataatattatacatctttttacatcttacaagtaataaagcaaatgataaaaataataaatatacaaaatatataacattttcctgcaaagtaccgaatttttaaattaaaaaaaatatcaatacagtgtaaattgtttctacgaacaatttttgcgaaaatataatgtggaaaatattttccacataatactctccgactcaccaccaaatttctctcattgaccaaaatatttcaaacaaaatataatccgtcggaaattttatttccgacggaaatatccgtcggaagcgctaaaattaccgacggaattttgtctgtgggtaatttccgacggatatgtccgtcgaaaatttccgacggattaatccgtctgaaattaccgacggaaatatccatcggaaacgctaaaattaccgacggattttgtccgtgggtaatttccgaaggacatatccgtcggaaattacccacggacatatccattggaaattacccacgaaaatatccgtcggaaacgctaaaattaccgacggaattttgtccgtgggtaatttccgacggatatgtccgtcggtaattaccgacggacatatctgttggaaattaccgacggacatatccatcggaaattacccacggaaatatccgtcggaaacgctaaaattaccgacggaattttgttcgtcggaaatttccgacggaaatatccgtcgaaaattgaattattttccacggaataattactgacagccatttccgtcggtaatgtaaatatttccgacaaaatttttccgacggaaaataatccgtcggaaatgctgaaatttccaacggattttggtccgtcggaaaaattccgtcggaaatagcttttatttttgtagtgtacataaccttatataattacataatttttattattacactatcaaaaataactctcaaaattctatattattcatttttattttttaataagggaaaaactagtttatataaaagtggaaagataagccactaataactatcagcctatcaaaacgaagaataaggaaaaacaatgtaactattttctagctaattaacaaaaccaaaaattgtgtaagcaatctaagttacagttaatttaacaataataaagtcccaagagatgggggctactattcgtccctgctcatggcttcccgcggcagggatatcttgttttcaaaaagaaaaataataattatgatctaatttggaaaaataaaaaagacttatcagcatttcctactacatgttttcaacagtcatcaaatgatgtcttaatgtcttatgattatatcaactatctcgtttcctgcatgttttccacattcatttgctacattgtaattgctacattgttgcttaatgtcttatgtttatatcaatcatcttaagaacaactcccttaccaggttctataaccaaacggaaggaaggtgaatggcagtaacttgatgagagagagaagtgaaacttcaacagaatgagagacaaaatcacctgcagttctgtcatggctaggtgttgtccaacacacacacacaagccccgattccgaatggcatataagcttgtggaaccttgcaggctccaagcaccccatttgcaaatctttctggattgcacttgtgagcatcacggccccagagttgagggtcttgctgcagcactgagattggaatctgaatattggttccttttggaattagcatgccttttaaagtaacatcttggagagctagctgttctaacaacaaatgctgctggtgaataaatcctccaagtctcttgaatcaccatgcttaactgcaactaacatttttatagaaggatctcacttgatcagtaagaatgctcatgaaacttggaaataatttagagtctatttggataaacttcttcagaaacacttgtaagagaagaaaataaggaacaatgaataagtttctctgtaagctagaattagcttatacattagtaaaaagtttttggacaagttaatatgagagagcttttacaaatcaacttatgcataagctaattttagcttttggaaaaatttatttcatttttaattcctatttttactcctataagtgcttctgcattagtttatccaaacaagccttattagaattatattaaaatttgagacacaaaataaatgttgaactaaaaaaaatcctctaattaaagaactgctaagtagcatgattaattcatgtctgttccatcctattttcaacactatgcaacacttttttgcatgtactgcccatttaatgccaacaaaatcataagcaagaaaattttatataaaatcctttggacaactgatagatctactatgttatgatgatctctcaacttgtttacttcctcttgtggagattagaatgcaaatgaaatgggaaaaaagtacaatgaattttctccaacttcaaagtcattatatgttattcatgcattgtgtccaatctaaatctctgaattgaaattctattccataccatgttgaagtccaaatccaagaaaactaatatgtttcatggaaacatttagctttagcacatactgtgtacaacataccgttttcaggcttctaagcatacttgcatctggagcactttttccacaaacttcaattaagcaccttggcacgagcacaatcttgccatttttggtgtgcagctcacagcattaagcaccatgaggctgtaattgcagtagtctcatgaccagcacagaatatatttttgtaattatctatcataaacctctcacatgagatggaatctgataataggccatcattacccttggaattctttgcaccctcaagtatcatttgtaaaagatccttctcatgagtttcctcctatcgttgttttatgagctgtgatatctttgagtttatctctttttccaatctccacatctgtctgttgcttttgtttggcaagtatctaaaacagattatggcaccattttgcacattagtaatagtagcatcactaacaagaacaagaaaataacagaagatatggtaaagatgcaagcaaaaggaaaaggctaaaatggaaaacaagcacattatatttctcatcattgatgagcacgaaagtctttctagttagcatgcataccaaaagcctggaattccaacatgaatcttggacaagagtttttgaaaatctctaagctttgagaatatttctttcccttcaatgtaattgcttccaaaacaagctctagcaattatgtaagccaacaaacttggcagatcttcgtcaattttaatctctgaaaccgctccctcactttcaagtctagactcccaagaccttagtgttacatttgttgagtccactatcagattaaccattgccttcaacatgatttacagcaaaagaaaatcatgagattgacattctaatacagtataactgacattttttagcattcttgtagattagttttcaaagtcaaaatacttcaacatacttaatgagataacatacaatttggtccctaaattgacaatttgtgttgctttggtccatgaaagggtaaacctgtcagcaagttgacaattttaaggcttgatttgtattgactttcacttccaaggactaacaacaacaaccaagccttatcccactaggtgaggttagctacatggattacatgataccattcagccacatggagcactttcaacgaccaaagccacataagttgtcactttaaggaaccaaattttaaattaactctgcatttagttcttctgtatgtccaatgcaacattccctttctcttgagcagggtagggtggggtagaatacacttaccttcaccttatcaaggtatagttcaggggcaattatcttcctctggtgagctcaaattggcccactagatgtcaatataccttgccccaagagtgaccccatatctttggacagataagtaggcttcccccagattcaaagaggtgtacaagatgaattccttcacgatctctatatctgacaccattagccactgtataatcccagaagaaaacaagtatatgggacctgcatctatctaattgaaatcaaaatttggacttaaaatggacggcaataaaatcatatcatccctattaattctagaagactaaacttttcatttagtattatcccaacccttttcagcacttcctgcaaagtactattattttctggtttttctttttcattttttggtgtgtgattcatttttaatatgtctttgattatttcaagtgtaatgtgtaaacatgcccttgatacataacattctacccattataaacaaaattaaaactagggtaaatatcctcaagccctgtagccaatagggccttctgaacaagtgaaactattccaaaatttggtatattagcagtaaaatacattgtgatggaatctgaaaaggtttctcctatagaacatttctatcaactttagattaaccaatacagtgttcgtaatagactattactaaactcaaactcaactcaatgttttagccttcaataggctcagtcatagattcaccaataaactctgccccaaaaacaaaaagtcaaacaaaaacatcaagtatgtgctttcattttgcatttagaacattccaactcttataatcaaaatctcactagaaaacttttgaaacataatatttctttgtttaggttcatttgaaaccaaatatcaacttgcaaatagtactgattgctgattcatttctccaaacaaaatgaaggaaacaacatgatgtttatgagactcgccaaagtaacttaccatattggctgatccacttttgaatgtgagggaagagagtgaaaggccatttgtgagaaagagaaacatgttcatctttgtctttgacttgagtggttggtgctgactgaacctgaagcaaaaaggcttcatttctgggatgttcccaaagtagaagtgaggtgaaggaccatgaatcccttgcctatgaagctttactctcagtgatcttggcctcaacaccgaaacattgaaaacatgtatcaacactaccaaaactgccaccaacacaacttgcactgtgttcatctccatcactaccctcttctcttctctcccttttccttctgtttacactaacaaaactacaaaatctcggtgattcaattgtaagactaagattattggttcttaaagtaaagtacacttttgttaacttttctacaatttttgtaaaagaatattgaatactaagaagagtttaacagacgtgtcctttaactacctcaaccaatcaaaaatccttcctaatataatttttaaaataatttatatatctatctatatttatctatacataattttaagtctactccaaaaaataaaaagtttttacagagtatcaacatcacataaaattagaacttgggttaacaaaaactttctaaaaagtttttgttatatatatatatatatatatatatatatatatatatatatatatatatatatatatatatatatatcctcaacactcacttatcggcaaattttgaaaaataatacaaatttttaaactattttgaaatctggggctgacaaatacgcctaatttaggtatgtttgggtgttgtatatggacaaaaaataactttttaccattctactatatcacattctctctctaaaagttttttacccttctctgtggagttttagtagattatttctgcaacgaagctttgccaacaagtaagtgaatttaataattttgaatattatttaatatgttatattattgaattagaaaattgttagagccatatgaaattgttagcaatgtacatgttaggttcgtagaaaattgttagggtgtagggtgtagggtttagggtttagtgttaatggtgtagggtttagggtttagggttgatggtgtaggatttagggtttgaaaatgaaaggaacacttcaaaacaaccaagagggaggagtgaattgattgaaccttggtaaataaaaattttcaaatcagagtttttccaaaggatctttatcactttaaaatgttttgaaatcaataatcatttattcaatcaaattcctctatcaagaaatcaatgagtaatacaaaaatttctgtgcaaacaatttgaatcaccaccaaaacaattgagagatgaagagataagaagaaagattagccactgatttttatactggttcacttcaaacactatgaagctacatccggttcttccactcaacactagagtaaagttccactattgcaaaaatattcttacaagatttacaagcctctctttatcaaccctagataaagttcagaagtctaaaacactattagacccttagagaccaaacccaaactgagaacactactcagcttcccttagagaaacactatctctaatcatgtaagaaaacccatttacagtagactaatctttacataaatcaattaaaagaattacaccttcaaagaccaaggaaaattttcacttgataatccaaagaacatatgcatgtgaatgattcaatcaggttgaaagagaaattacaaactcaatgcattcctttccttatgctttgactcaatgatgatgcttcacttcccaaatcaaaaacccattcgaatttgtgaagcctatgtgatgttagaaactcagaaaccacactaaagaaagctcatgaacgtttgtgattgctcagtatatgaatttctcaaagtcacaaaaaacagagtaagaggtttctatttataactgatttctaactgaaaataatcgattaaacacgctcctgtaatcaattatttcgcatatgtaatcgattaaaccaagaatgtaatcgattaaaatgctcccgatatgttcaggatttcagctatgaacaatgtaatcgattatttcgtgaagtaatcgattaagacagacagacatgtttttcttaatacactatgtaatcgattacaatatttggtaatcgattaagccagtcagtactctattctcaaatgtactatgtaatcgattaaaacgatatgtattcgattaaaccagtagaacatgtaatccataggcatagatgtaatcgattataaattctgtaatcgattaagacagtcagcatgattttcttatttaagcctatgtaatcgattaaatcgatatgtaattgattacaatgttcttgatttgttttccagaaggcacgaagaacaaaataatcgattctatcaatgttgtaatcgattaatgcagtaatacttcatttttccaaacacttagcattttaaatgccttacttgttcattgctcttacttagacctttaatctaacaatcctagatgaatgattatgcatgatatgcttttggattatcagattgcacagctttctttttacatgaatcaaattggtcttcaatagctttctttgacattttccaattaggcatgtagaaagcacaaaaccaccaaagcttgatcctattcattcatgcatggctcctcttgaatcaacaatctccccctttttggctttaaacatgccaaatcttcaatttgattaagctcagatacttggagattaattgaggtttccatttatgaacttcaagcttaaaacctgaaaaatttcaaatgccttttgctaagtaacaagtgttaaagcatatgtgattcatgagacttcaattaagctttatacttttccattaagttcctttttacaccttaactccccctaaaatccagcacatattcaaatcaaattttgggcaaaaaattgaacaaaaaacaggggcaaacagagtacatttgaaatcactcccccttaatcaattctccccctatttggcttgttaaaagtcaaaaacaatataagcacaacggatattgaactggaaatgcataattcattagaattaggtgtcatagggagcattacataataaaaagaaacataatcaacaaaaacagaaatataatagacatgaataaaaaaactaaacacaatctaagcaatcctagaattcaacagaggcattgtcattcatgttggcctcaattgaatccaatctttctctaatttcttctaaggcttcatgagtttcagccttgaagtcttcttggagctttaacatgatgtccatcttttgaataatcaatgattcaaagtcaaagaaggctggctgtgcaggctgttcctcatcttctgaatcaacaaccatttattctccttgtgcagcagctccaacttgattagccatcacctagccattgggtgtcttcctcatacccatcttggtcaaatgtttctctttaatttggctgttggatgagtctgtgttgtctacaacttcattctcaacatcaatgttgaaatgatcaattagcctagagacaaatataggatatgggaaagggtagtttacaagtcttttagacttaagcataatctcttcaataataagcacccagttcataggaatatgatttttcagcccatataccaactgaagatcctcatcagttgcttgggtatggttggttgctctaggggttattacatatgtgattatgtaatgtaagagcctatcctcagcagtcataggacctgtacccagcttagtcctaagcctcatgtgaggattatgaagcatttctctgtaggtgtccattttgctatacccctcaggatcttcatcaaatctcctaacaccctcacacattaccctagccactctttcccaaatttcaggggttacaatcatctctactcccttaaccttggattttatagcccattgcattgaacccttcaagcaagtatagaaaaccttcactaaatcatggtagaaggtacccttcatttctaaaaccttctcagcccttgggcttcaaggtaggctggaaactgaaagccctcccttatgaaccaatcaagttcaagatatttgggagaggccactggtttagtggcattgaattgtaggtagttgaatttgtcactttcagaggaaaaccataagtctaacatattggcaggttggggaggaggtgggttagatgaggattccccagcttttctcttagaagttctagatctcttaggtgttgggtttgacatggttacacagagacagatttgacaaaaccagggcttaagaaaaaactcagaaagtgcagagagagagatagacaaggtgcatattttctatggcttgtaatcctctatttataggcacaaatcagaccctaaacgtccaaaaaattcaaaaatatagttgttggtgacagtttaatgacattgggtgccttttaaaattgattgggcagttaaataacccataaaaacctgtcaggcaacgttcaacaacatgaataatcgattatttcgttaactaatcgattattccagagcaattaggcttctgcaaaacacatggtaatcgattattttattaagtaatccattatttgatcctcagtcagaggttgaagatgaccagtaatcgattattgcttgcagtaatcgattatatgactcactttatgaattatactagtaacagggcataagtaatcgattatcctgagtggtaatcaattattccagtgaaccttatatcttctagtggtgaaggtaatcgattacaaggcttaagtaatcgattatcacagtgagacatgcactcaatcacagaattttaatcagtgtaatcgattatcccgatgtgtaatcgattattctagagataggttaattcttgttatacgaagaataatcgattaccatctgtgtgtaatcgattacataagcacaaatttcatagaggatgtgatttttaatgagattgatcaattaatttgtgctttaatcgattattacagtcaattcaacagatgcagagcattttagcagctttctagaatgttccaaataatcatatgttttgtgcaacataaggctttaattcatcatacaaaatgcatatagaacaagctagaaaatgttactttcatctagaatgcctagcatgttcctaagagtataaaatctatcccttgataatggttttgtgaaaatatcagcaagttggttattggtgtcaatgaattctacctttatgttacctttttgaacctgatcccagaggaaatgatgtctggtctcaatatgctttgtccttgaatgcataattggattctttgatatgtttatagcacttgtattatcacagcaatggaatctcatttagctctacttcatagtcttgcattttttgtttaagccacaagctttgtgcacaacaacttctagctgagatgtattctgctttaacagtagataatgcaacacatgattgttttttgcaatgccatgagattaatgaacttcctagaagatgacaagtgtcacttgttctttttctatctaatttgcaacttgcaaaatcaaaatcagaatatccaacaatattgatagaagcaccttttggataccaaagaccaactctaggtgtagctttgagatatttgagaatccttttgacagcagtaagatgagactccttgggatttgcttgatatcctgcacataagcaaacactaagcattatatcaggtctactagctgttagatagagcaaggatccaatcattcctctgaacttagactcatcaactttctttccactttcatctgaatcaagataagttaatgtagtcatgggagttgcagcatccttgcttttctccatctcaaattttttgattatttcaagacaatatttggattggttgagaaaggttccgttcttcatttgctttatttgaagtcttaggaagaatgttagttcacccatcattgacatctcaaattctttctacatagctgatgaaaaatccttgcacaacaagtgattagtagaaccaaaaattatatcatccacatacacttgaaccaataagaaatcattgtcatgccttttgataaacagagttttatcaacactgccccttgtaaaagattgatcaagcagaaattttcttaacctttcataccattgtctaggagtttgtttcaaaccataaagtgcctttttcaatttaaaacatagtttggatgtttgaaatcagtaaaatcaggagcttgttcaacatatatgtcctcctcaatgtatccactcaaaaacatagtatattttgttttttaacaattcttggaattcaatcttatagtattctaatgtcagttattttgaaaaaaggtttgatgctttaggccgattttgagcacacgagctgctctggtatagcacgagattggaatccctcagtcgggatgaggtacgttttcttatttttaagtgttcttaactatgcatttgtggtccacgttgatacataattgtgtacgactttcttggttcatctgagcagcagcgactgttgtggatggcaattactcctgttatatgcttccacagttgagtattcgcagccggatagatgcatgcgccaatttggaagggatcatccaatcccacgtactcccaggaagctgaagggtatgcatgacctttccttacgcgataaacgagaagataactgggtccgtaagctgagactgtttattaggcactaggaggttagggaccggcacattgaccttccctctctgcttcagggcttcatgtcaccaaaccatgagtacatggtttggtacagcgaaaatgggaagcggtacatctcgaagatggctgccaagagtggtcgtggtgtaagttttgctgacattaaaatttgtctttttatatttattatgctagagaacatgattcacactaatgtttatatattttaatttatagttagatgggctggagatgttgtacttcgcgcttggtcatgagcagtggtcgggttacacccacgagtgaacacaagaagaggtcatcgcataatgtctatcttcaaagagagttgtcgcctggaggaggcagggtcacatgcacccgaatcccagctttaggaggagccacaagtgtctgttggcgttggccgtcgaagacaggagggacatgggctagagcgtcgacggaaacaaatgcaccatgttgctaagcccattgtaggtcccaagcctcgcacccagggtgggtttaggcctccaattgtagcatcgacatacgatagtcaacccttgtattacgagtctagtcagtagggggacatggggtacgagggatttagtacgcaaagtcatatgcctccactggctgactcccagacccagcctgtatatatggaaactgcaatggcgatggcatcagcgaatgttaggagcagtggtgatgtagctcctacaaagtggactggtgctgacattgatgagatgctctctcagcttgattattctgtagcaggttgtgggggttggtcatcagatgtatcatatgccaccccagctgctgagcatccccgacccttgtttctagagcaggccactccatgttcacctctctatgtaggcccttataaggcaggcccttctcagccacagccttctcaggcaaacccttctagccggatcgttctccgccagaccgttctccacgaccgcgtagacagaggctacctgatcgtcaagcgcgtcattatcagtggccaccagagtctttgttttttagccgtttgtgaaacacttttgtataatcttgttacacatgattgaatgaaattatatattatttttgtactttgtccttatatttaaattagattttaatttctatctatgatttatgtataaagtttattttattttaatggcaataaggattaaagcattttattgaacgaacaagcatggttggagggatttgcaaaacaaaatagcgtagggaccactttaggagcatagtaaccttaaaagatttagtcaaaaggccacaagtggtggttctgtgtgtaacaaagaggtacccgtcttttagcgcgaaatgtggattgaaaatcaaaacaaagaaaaaaatagttatagcttgagggaatacaacacaaatataccatattcagagagagagacagagagaactgaagagagaatggcacaggcacaacctgaagagaggatccatcaaaacccagaaaaagaaacccaagaaacagggaattctagcttcaaatttaatgcccaagcacctgaatttgttccaagatcatagacccagatgccagtaattgatatgagaggcaaacagacaaacgacaatgaacaatacttaataaaagatgataacgaaacagacattttaaataacaataacaattgaaaataaccaaacttcataaagctacttaatacaatgaatcattctagtcagcattatggccatgtctcattccatttgggtaactggtttgttaaaaatagctaaaatctctattggactaaaacatttccagtagttggattctgctaacatcttaaacacgtcttcatcccttgtcaactctattatgtgatattcgattgtgtagtctgaatattttgcatgggctagctgtccaaaaaacaattttcttaccacctatgggttgtgaattccataagggggaaccccaataggcgcaacttgttttatgacatccttaagtgtttcaatgttgcatcctgaaggaatttcaaaccttattggatttgttccagtgaaggaataacccacaaaaccgccttgtcgtcctatgttccacttgtcgttgtaatataacattgcatcatgtgtagggacgatggtggatcgaagtaggttgagtataccatcgggtgttctgttgatggtgaataatatttctataggaccaacacttgacatttgatcattgcacattaacattgtgcaaacatcatcatcatcatttgtgagttacagagaatgaaaaaaatattgctgacctgcatgtaggatggctatcggtaatagatttcatcaacaaaatggtcattggttagcagaagggtgtcatgcatcctactcttgagtgtctgaaaagaacactcattaggaactcgcattggtattggagtaggacattgaaaagaaacaccagtttcgttgtttttgattgatccatttggaaaaatgaatgctaatttggagttaccaatggtctgactgcttgtttctcctaagaatgccataggattcagattgaatttcgattgcggaggtatgttgtgtgggagtgggagtgtatggcttatatagggatcaatgacgcccaaatataggcgtgttcagtcacgccctatttgttaggcatgtccagtcacaccctatttgttaggcgtgtttggtatcgccctatttaggtgtgttcagtcacgccctatttaggcgtgttcagtcacgccctatttgttaggcgtgttcagtcatgtcctatttgggcgtgttcagtcatgccctatttgggcggcgagttcagtcacgccttatttgttaggtgtgttcagtcactccctatatagccctcattgactccccataaagcgtaaatgtttcaaacacagccccaaatttattttacaattttatttgagtctcatgttcgggtttagtgtttaatgtgtttggtttaggggttagggtttaggatttagggtttacagtgtttggtttagagttttctcctaaaggtgtttggtttagtgtttagggtttagggtttatggtgtttgttttagggtttagggttaagggttaggatgtttggtttagggattatggtgtcgtctttagggtatagggtgtctagtgtagggtttaggatttatgatttatgatggttggtttagggtttaggatgtcgtctttagggtttagtgtatttggtttagtgtttagggtgtagggtgtctggtttagtgtttagggtttagggtgtttgttttagggtttatgttgtagggtttagggattatggtctcgtctttaaggtttagggtgtttggtttagggtttagggtgtagggtttagggtccatctaatttgttatttagtatccattttgaaaacttgattgtcgtatgtgtaatcacagcaaattccgcatctggcgcttctttgatgtgtttcgacttcgtccatctcgttacgtattctgggggaccttggacgaccatttgcatgcaacatttgcctgtcaggtatgagaactggatcttcactcaatggaatagcacgttcattaccgattggttgccatgacaatgaataagcctgaaccaagttgtttacgaggaagacatcatccacatactgataaggattttggcgaacatgtaaagcagcaactacggtgtgactacatgggtatttgaaggccttaaacttgcaacactgacaaaactgctctgcaaggttaactgaatatgacctttcccagccctcctccacctcaaataatgtttgatcaacattatatgtacgtacatggtgacttgtagcaacggactgattatgcctcttagcatcaaccacatttttgcaatgtcatagtgaatgttgaagctgtgaagcagccgcctgacctctgcatacaaaataatgaaccaatcgggtatatgtgtgcttcacaagaggagtgataggcatgttccttgctcccttgaacaccctattcactaattctgacaagtttgttgtcatatggtcatatcttctcccctctacatcatatgcacgtgtccacttttccttagggatgccatcaatccattctgcaaccttaggactggtatcacgaaatcgtgcaaacgctatgtcaaaatcaaccatagagggagtataacctgcagaataataataccattaacactattccatttacagaaagtcatgagggtcttcttcaatcttgcattcttgaacctttgattaaaattactggcaatatgatgaaggcaaaacacgtgatgcgcaaaaggtggttgtcaaccgacatgattctccacagtagatattatgctccggtgtcgatctgaaatgagacgtatattttgtatttgggtaatgtgtgttgatttaagggggagctacataaagattacatgaagatcaagcaatgtgaagtcttggatgaagttttggctttcaacatgcatgaagctttgaagatgaaagtttgtgattaaatgtaaaaggattgaaagcattctgatgatccaagttttgcatgcatacctttcatacacattttaagcattgcataatataagctttaagtaattaatttgaaacttaagaaaaagctaagtgttttgaaagaaatagtctaaagccggattaatcgattactaccttaaaagaatcgattattttgttcatctagctttctggaaaatcatcatgaacactttaatcgattacctcatcggattaattgattacttgaaaattagcatacttggaaattggctgagtgactggtttaatcgattacaacataatcgtaatcgattacatacttgttttaaaagtatagtcacactgacttaatcgattaccacttcttgaaatcgattatttagttcacctcatgttttgcattcacgctgttttaatcgattaccaataattgtaatcgattatattacacaaacatgatttttgacatggtctggtttaatcaattattatggactgtaattgtttattttacttcaacatgtttttttgctcagtctgttttaatcgattacacgtcgggttaatcgattatttgacccgttaactgaaatcaagaacttaccaagaacgttttaatcgattacaggagcctgtggagcgcttttaatcgattaatttagttacgaatttcagtataaatagaacccttgccttatgtgaaaaaaatagggagagagaattaagtacagatattatattttcgaattctgagcattgaaaaaaaaaagctttctaaggattcacaaaggcattcttctgggttcataaggtcttgcttccattgagtcatctatgggtcactaaggatatagtgaagcaaggcaatctttcacaaagactaaggaaacctgattctgcataactgtttctgcattcatcctgagattttcattattatgcatttcaatcttggatcatcaggtaaattctttccttaatctttgcgggtgtaaagtttttctgttgtaactttgatttggttgattctattgtaagtgggtttttcttgcaagaagagatagtgtttctccaaggacagctgactagtgttctcagtgtgggtgtagcttctaagggtctaatagggttttagatctctgaaccttatctagggttgataaggagaagcttgtaattggttgtaagaatattatttgcaatagtggaaatctactctagtgttgagtagaagataactggatgtagcctcatagtgtttgaggtgaaccagtataaaccttgtgtgtttattcttattctacatgtttgattagttttttagtgaattctgttttacatcatatttcttgaagcattacatgtcttgtattgatattgaataaaggttcttggttgtatttgtgataaagatcctaaagggcaaaaactctgattttgataaattgattttgattactcaaaaagtttttaaattaccaagactaactaattcatcccccctcttggttaagtgtgaagtgttcccatattttacaatgtggaagcgaatgttagcaaggaagtattcccaagcttccaacatttccccctcaacaatggcaaatgtcagtggtaggcattcattatttccatcctaactcgtggtaatcaacaattttcctttatacttgccatataaatgagtcccatcaatttgaatgatgggtttgcaaaatttaaaagcctcgtaacgctgtcttaaagtccaaaaaatgcaatgaaatacacgtttttcccgtaccagtcgatgtgccacaaaataagcatctgtttgaaaataaaaataaaaaagaacctggtgaaaaacaaagcatgtagttgcaccacctgagcaaaataagattcttcccaatccccgtaaatcatttccattgctttttgcttcgcataccaggcctttccatatgaaactttaaatccatgcttattggtaatcctctcttgaaccaatgcaattgacacagacggttcctccttaaccattcctaacaatgaaattgtaacattgacattaacaagtgaagcaataacatcaacatcaatatttttcatatagagcaaatttaatagaaacatacctactacaagtgaagcaataacatcaacatcaagctgtttgtgaccctgtgtaatatgatcattcaggcaattgtgttttccaccccatcttgaaacaagtcaattatcaccgtacattggtttaattactctaaccctcctagggcaaccatcgttgtttcgaacacacttcatgctaaacttgttaggcttgctctcaaccacaattgcttctttatgctccttcatatggttccgcttaattcagtttgtgcatcctttttggatgcaaattcctgttgaacaaacaaatcctcccctaattgccatggatcttgcactaaactcgaacccgaagcataaccagtaaaagattcttcttcgcttggatgattccaatcaatacatgtaatgtggaattccatcccaaaaaggagtgacctcaacacctaaacataccaagcaaataaaatactataatatacaaatatacatatatgattacattttcattgatttcagtcatctaacatactttcaacagcttgttttggtttagtagatccaacatcggcatgatagacaatcccacatcaatatcttcttggaatttagttgcatgcacaccaacatcctcatcattatccgacgcactagcatccacctcaagaagacgatcttccattgcgatattttcatcatcgtcatccatcaccaaggttgggtcatgttcagcttcctcagacatatttacacctggagcaacatatgatgatgcattatgtgtagaattaaaagcgactgaccttatgggtaaaccaacatcctctgctgcagtaaaatccacgtacaattctaaaaaatcattccttgactggttgaaaattcttccattaccatttctatgtcttcatcctccagtagttgaaaccccatgtattgttcatgtttccataatcttatcgtcaccaaagtgatacgttggttgtcttttagacctaatttttgtcgtatcttctcatgcaattcacccagtgttgattttcgattgatacgcgtaggcctgtaatccccttcaaaaacaacactccatcatcctttaactaaccttccattaaaaaatagcacaacacaagcactctcactacctaaactcatttgatgtcgtcaacaaaaataaaaactttaaatatgctatgaagaaatggatcaagaaaataacctgtgcataaatggattaggagatgctatttaaataaaatctgaggggtcaaacatgcccagatttcaaaatagttttcaaacaaccccaaatttcaaattagtttaaaatttgtattacttttcaaaatttgccctcacttatcttaacaaattcctttctaatcttccatttctctctcttgcagcgatgaaagtcacagctggctgacatatcacattgttggttaatggcttcttctattcatcgtttttaaggttccatcttatctttattatttgtttattttctcattgtattaattattcattttattgctaattaatgcccatataatcccttctctgtctcttgacctttcttttctccatcttgcaagcattgaagcgttaaacgatttaaaattaactctatcaaaataaaccacgaacatgctacaagttgtacagttttacagaatagctagaacctagagggataacaaggcagtttcacaaaaataatcctctggttgcaccattgatgcattataaatcctttttatataataactttctttatggtatttgtttcatttaatttaactaagacacataatccccttgcttattttagagaaaatgtaactttagattccaaaacttcatggtttccctttcattttcttccctgaatatgtcaggtagactttttcattagcgataatagatgaatgaatttgtcacacttttttactttcggggactaaaattaaatttctatcttttggaaacgaatttgttaacgctctacaaatttatggatgaaaatgactatttacccgtatatgaattatgataggggtttgatttctctcaatgtgaatagagcaacatttatgggaagaagagctaccccttaattgatactttactttctcgaggattaacttaatggttgtgcatttttgtttgagtctcatattttgggtaagaaattttaaaacaatagacaaactatgcttattaagcaatattatgcttattattatatttgttctaacttatttttgttttcctatttttttaattgttttattataatgttatgtttgcaacaattaaaagaaggggaagatgaagattaaattatattttggataaatagtcattttcgtccttgaatgtgtaaagcgttgacaaatttatccctaaatgtgtcaagtaagctctttcattaacggtaattaggagggttcgcgggtcagttaggattggttttggcaaaatttaggacctaacccaatcaaatttgaccgattcagctcgattcaatttttagattttttttgaaacccaacccaactcattcataaacagtttgatttgattcggttcggaccaatggattatccatttatattttatctttttttatttcttagaactattattttatattatgattcatacaaatatccaatacaatgaacacaatagggtaaatagccatttttgtccctgaatgtgtagagacctgacaaatttgtccttgaaagatggaaattcaaattttagtatctcttttgtttagtggattttgaaaatccttatgtgttagaatcagtcttgtttgagagagaagatgacacttaacaatgtcagatatgcacttaattgattgttgtcctttgagctggtaaaatcatttttaaaagaaactttcttaattacatgttagaacaaaatcaaacgtgttggtgttaaattataggttagaacaaaatcaagtgtgttggtccaatggaagaattaaattatattttatatgttagaacaaaaaaaaagaaagatgaagattaaattatatttaatccttaaatgaaataaaatttggtgtctaacaaatcagtccaatggaaacttattgacattttggttaatggaaacttactaacattttggtctaatctattcagcagttgtgttggcaaccatttttgtgacatttccgtccctctgtgccacgtaagctctttcattaacagtaatagatgaataattttcacactttttcactttcggtgactaaaatttgaatttttatttttcgggaataaatttgttaatattatacacattcagggatgaaaatgactatttatcataacacaatattatcaaatgtttgaaaatagtaaaattgattcatttaatattatcaacataatattctaaaatagactaatacaaattaaaacaaaatattcttcaacgatatttactataatagtctgaatcagaactatttcttacaaactaatttcttgcaataagttttggtacaacaagatttgttgaaacaaatgaacaaaatatgatccattaatattataaacatttgaagttctaacacttggagtccaaatattagaaatatttaaattcaaaccaaacaactctaaaaattttgattgattttgacccatacatgaacatttttaattggatctatagatctaaacctgtgatccaactcatacatgaacggttttaatcaattcaattcgattttgatccaaatacataaatgacccaacccaaattgtttgatcggtttgggttaacccgtacccgtacccatgaacacccctaactgtcactgatgaaacttaacagaagaatagatttattgtactttttccactttcaaagactaaatttaaattttcatctttcgagaatgaatttgttagtgctctacacattcaagaacaaaaataactatttatccttcatatgcttaaagagtacaaaatactagtcacttgtgctacactttgtgtataagagtatggacaactaacgtctaccaaaagaagataatttatctatggttatgagaggaactcggaagaccttgtagttattattacactttatatgaccaaaaatacgcaaataaacttgtcgcaaaaagagaatagaccatgtaaaccatctgatctgggacgcattgtcaaagaaatgctacaagattgctgaaatattcttaccatggagacatcttaaatgaaagggaaaccatgaagttttggcatctaaaactttcagctactcaataatacacaaacaattaagttctattttgcttgtaaagccaatcctctttctcctacactcctagttatcaagaaccggtaaagtttggcacaaaatgtcagccgcttgttcgagctctctatctgttatgatcaatggtgggacaagcctgacaacatttccttttccagcagttaatactaaaaggccagaatttcggcatgcatcaacaaagggtgaggcaggtacatctaaatctattcctatgattagcccaacgccgtgaatttctttcatgtgtcggttttgtcctaacttctgcttgagtagttctttgaagtagagacccttcttagatacagatgacaggaaatcaggttttgatattttatcaaaaacagcaagagcagcactacaaacaagggggtttcctgcaaaagtgcttccatggtcaccataatttatagaagaagcaactctctcagtcactaggagtgctccaatagctaggcctccagcaagaggcttcgcaaggatcatcatatccgggaagacgccaaatgcctcatgtgcccaaagaaaccctgatctacctaaaccacattgaacctacaacatcacagaaagcatattatagttaagtagaataatattactgaccaaatggaggcaaaagaacctaaataatacattttaaataaaaaattaccaatttagggccgttttcaaactatttaccaatctggggcaggaggtcgcacccaaaattgggcatgaccggtcccgccttaatctgggcatgaccaagggggggtcaagcccaattttgggcgtgactaaatccatcgctaaatcggttagcgaccgatttagcgacggaatttttgttttttttattttttttgtttgcaacaaaaattctgtcgcaaaaactgttagcgactgaattaacgacgaaatatatgatttttattttttatttaatattatttatttttatttttatttaatttgaaagtatttttagattgatcttcatgatagatatgatctgttttacttttaataatatttttttatttagtatatttttataattttatatgattttatttaatatattctggattttggtataaataatttttaatatattattttatttaatataatttctaaatttgtatatgattttgtttaatattttttggattttgtatatataactaatttttaatataatattttttatttaataaaatttttcaatcctctaataaacaaattattttcatccctctcatcatctctttcatcctctaataatttgataattctctttttgttccagtcaaaagcacctagtcgactaactcgtcattgaaactacaccgaaactcaggctttctatcaatcggtgactcaattgtgtaaaattagtgtggtcaaaacatatacattcaaccgagaaagggaattagaaaggatcgtccatcttgcatggtgaatgattaattgtgtgagtaagttggtcaccatctttatctctctgggtaagcacaatgcaattctttgcaattcaatttgattaactttgtctcacgcagttctactcctatttctagagttctgcaatgttacaccgctgtgcacattggaattaatggggtgttacaattccgattattgtgtggtgagtgcactttgggatgagtggaacgagtggtaaaacgtggaatgagtgcgaaaaagttagaaatgaatgtgttttgggataaaaaaatccaaaaaatattaaacaaaaccatataaaaatttagagtatcgaaaaagttacaacttttgatagaaatgtccgatcgaggtgtacaatatgtcgaaatgctcgaaattaatagaagtaactagaaaaataaaaaatattagccaattaactgacaaaataattaaaaaattagaaaacaagaaattttttgggatttcgaagattaaatcgcaactttgaggcacttaaaggcctcttttggggaaaatttgcgaccacaagcaataagaccaatgtcctcactgatcacaaaactaatttaaaaaattgaacaaaattgtactgtaaaattgacgatgcatataactttgaacaatcctaatttttcgtagcaatgtccgatggatacatattttatgtcaaaatgctcaaaattaagagaggcaattagacaaataaaaaatagcatgcaattcactaattgaatgaataaaaaattagaaaacaagaaattttttgaaggttcaaagattaaatcataattttgaggcacttagaggcctcttttgggaattttttttggccaagtccccttggggacttgtctaagccttctcctctcaatttcgagcgcgtggccaccgatttcgtctcaatcggacattccagtcaaaagttatgaccgtccgaagtttatatacgcatctgttcacctgtgcatgacacgtggcagaagtaggtcacgcccagaaccaggcgtgactaccccctagtcacgcctggttctgggcgtgaccagtcatgcccagttctaggcgtgaccagttgccccatattggtaaattgtttcgaaacgacaccaaattcgtaattttttatttaatttatatttaattggtttttttaccaccaaatggaataattaaatatatgttataaataaacttcaaaatataacagctatactttgtcactcaatgaaataagaaacttctgtggatttacgagaaggtcatggtactagacaatctcattcctctcaccatcattcaattaatcatgacaaggcatagataaaccaaccaaccatttccagtgacaatgccatcaagagtttaatatattagacaatattttcccaagcatcttaaagcaactgaaaaattatttaaaagtgaaaaccaattttgtgtcttcgcctattaggctgttacataagcaaatttctttttaaatttttttaggaacactaggcatttgcttattaacatacaaatacagttaaatatcaatattagatactcgatacctcatcaaacacaagaagtgacccggcttcatcacaagcattacgcagagacagtagaaattcttttgtagcactgtaaattccaccttctccttggatgggtgttgtaaatagatatattttagattttatcttagctatcatctttagttatctttaattgttatctttagttgatagttattatctttagctattatctttagttatctttatctttagttgatctctttaaatagagacctcttgtattactgtgatacacaattcatatttataaattcctatttttttcaagttggtatcagagctctcgattttgagggctttgcttccgcgcctatcgccttaagtgcgaaacccttattcttgactcttgctgccattagctgccaccgaaaatttttccggggaaccttttggaccgagaggattattgtgggctattttctcttgtgtttttggtttgtgtttggtatggctagttccgacaatggttcttctcaagggaattccttcaacaaaattgctgatggtgcatcttccaaatttaagaaagatgatcgttggtgttcttattgtagaaggtcgggtcatattaaggatctatgttaccgtctccatggaaagcataaagtctatgagaagatggcaaggatgcgtggtcaagttcatgtagtttctcctgacataactactgcaccaaatgaggtccaatctggatcttcagaatttccttctattagtcgagatgagttagaacggctgcggaccatcattgattcgctgagtaagcaatctagttctagtgctttgaccatgaccggtatgagttccactaattattcttttcttacttcttgtactgattttaaacattcttgggtaattgattctggtgctactgatcatatggcttgttgtgttgaatcttttctttcttataaccctactattgctactcatacaatagccataactgatggttcacatacatcagttgcgggatctggtaacattcatttacaacctttctttcacctcaaagatgttcttcatgttcctaaagtctccaccaatctcttttctatcaaaaaaattacaaaagatttaaactgcactgtaaccttctttcctactcactgtgtctttcaggatctcaccacagggaggatggttgggaaagctaaggagcaaggtgggctgtactatttggttccaaagtattttgacaaaggtactaaggatcgcatattactaactcatggccagtgtactacagactcattggtttggttacatcacaagcgcttggggcatcctccatttagtctacttaagtctttatttccgtcattatttttgtccaagtctgttgagtcttttcgttgtgatatttgcgaatttgcaaaacaccatcgtgcatcttttccttctagtactattaagagtgttgaaccctttaatcttattcattctgatgtttggggtccttctaaagttactcatggttctggtaataaatggtttgtttcttttattgatgattgcactcgagtcacttggatttacttaatgcatgaaaaattcgaggtacctcaattattattcaaattttataaaatgattgaaactcaatttgggaaaagaattaaaaggataaggtctgacaatggcactgaatatgtcaatcagcgtctttcttagtttctccaagatcagggtatgattcatgaactcacgtgtgttgacactcctcagcaaaatggatttgctgagagaaagaatcgtcatcttcttgaagttgctcgtgctctcctttttcaaacaaatgtaccaaatcatttttggggagatgccatccttactgcagctttcttaatcaatcgattacccttccgggtccttgacaatataagtcttgttcactctatgacttccttctttccatcagtgtcctccttacaaagtcttcaaccctgagtgtttggatgtgttgcctttgtccatattcacaaacatcatcgcagtaagttggatcctagagctctcaaatgtattttccttggatatgttcctgataagaaaggctaaaagtgttatcatcctgctagtcggaaaacctttgtatctatggatgtcacatttcatgaatctgagtcttttttccctagtcctcatcttcaggggaagagcagttcggtaagttctgagtcatcttctttctttgagtctgaacctttcatgtctacttctgtattttttcccattgtttcgaatccttctatgtctgccccatcgactaatggttcggaaatacgaagaattgatacacctgagttagtatatcacaggagtgagcaaccctcattgcctcctcagcaacctcaatcatctgaacaaacggtaagtcctgaatctcctatttctgaacctaatattagtgtatctgatgagttgtccaaagacttgcatgttgcttctgatgacttacctagtgtttctgataacttgcccatttccttaagaaaagggaagaggtcctgtaccaaaaattcttgttcttcttgtccagcttgtactaaatatcctatctcgtagtttgtctcttcagctaaactttctatgcagcataaaggctttatttcagcactagattcaatctcaattccaaaatcagtagatgaaacattaaaagatgagaagtggactcaagccatgcaagaagagatgaatgccttggagaaaaataacacatgggtagttgttgatagaccaaatggaaagaaagcaataggatgcagatgggtttatactttgaaatacaattttgatggtactcttgaaagatataaggctcggttagttgccaaaggctacactcaaacctatggtattgactatgatgagacttttgctcctgttgcaaaatgaatactgtgagagccctcttatctcttgctacccattacaactaggatatcaatcagtttgatgtgaagaatgcttttcttaatggtgagttagaagaagaagtctatatggaaattccacctggttttggctcgatggatggaaggaataaagtttgcaggtaaaaaaggctttgtatggattgaaacagtctccccgtgcctggtttggaagatttactaaggttatgatagccttaggatacagacagagtcaaggagatcatacactgtttttcaaacatttccaagatgggaagttaattgtactccttgtgtatgttgatgatattattatttcaggtgatgatattgttgaaaagaaccttctacaagcacgactggcctctgaatttaaaataaaagatcttggaagactgaaatatttcctagggattgaggtagctcattcaaaggaaggaatttttgttagccagagaaaatatgttcttgatcttctcaaagaagcagggaaacttgggtgtaaaccctccagtactcccatcgagcagaatcacaagttaggttatgaggaggatagttctccgttgataaaggacaatatcaaaggttagttgggaggctgatttatttgtctcatactagaccggacttagcctatgctgttagtattgtgagccaattcatgcataatccgaaagaaaaacacatgcaagcagttgggagaattcttcagtatcttaaagccactcctggtaaaggactgttattcagacatggtggtaatctctcccttgaagtctatactgatgcagattatgctggctctgtaactgatcgtcgatctaccactgattattgtatgtttctttgtggtaatctagtgacatggaggagtaagaagcaagatgtagttgttagatcaagtgcagaggctgaatttctagctatggctcagggtgtttgtgaattactttggttgaagattatacttgatgatcttaaaataagatatgaaggatctatgaaattattttgtgataataaatctgtcatttgtataactcataatcctgttcaacatgaccggatcaagcacattgaggtcgatcgacacttcatccaagagaagctagatagcggtttgatcacgactccatatattccttctggacttcaaaaggcagatattctgacccagggactttcctctgaaagatttcaagagtttactggtaagctgggaatgattaatatctattcctcagcttgagggaagtgttgtaaatagatatattttaaatagatatattttagattttatcttaactattatctttagttatctttaattgttatctttagttgatagttattatctttagttattatctttatctttagttgatctctttaaatagagaccttttgtattactgtgatacacgattcatatttataaattcctgcttttttcaaggatgggttccacaaaaactgcagcaatcttgccctgcttaattaattctaccgcagcctgagcatttccatactctaaaaaggtcactccaggcataacaggttcaaaaggtgttctgtattacactttacttgtcaaagcaagtgcacccagggttctcccatggaagcagttactaaaagctatgaactctattcctggctctttcccgttggtagctgtgtgtctctgatattttcttgcaaatttaatagctgcttcatttgcttcagttccagaatttgcaaagaatacacgatcagcaaatgaagaagtcacaagacgcttcgcaagttctacctgcatcaattacaaaataattatagaaacaaataatgaaataaaggtagaatgcaacactgtgcagacacataacatgctgctacaagaaatgaaccaaagtaaaacataatggaaccaccacaaacaattccaaataaaaagatacaaaataaagttataatatagacatgcaagataacattacaaccatatactataggataaagcagaaactaaacaagttgttttctttccttttcataatgtagatacaatataagagtgacattacaaaaccaaatgatcaatgacaatttctttctctgcaatctccaagcacaaggaagtatacaactgaaatcttcaaatctgaaactctatcaaggagggaggattcaaataaagccagattaactatcatttatgcaaacacggaaaaaaatacagggtctaaaattgatattggaaaaaatacaatacactggactatctgaacattagggtcattgagagagatgtaaacaaatcttttaacacctatgaagactaataactaaggattactaataaagtccttcaaattgtaaattaaaaaatactcatagaaagcttaagtgttgacgatgtaatgcacactatgtttcatttgggacttttttttcacttttataaattggtttagttttccttttcctgctagagttctagacaaattctagcttatagagttacaaaattgtgtgagcgctatactctaatgccatgtttggtagagaagagaaaaaaagggtagatggaaattaaatgagtgatggaaataggtgagaaataaagtagaatttaaaggtgtttggttgaaaagaaatagagaagagatgaggagaggagagagacatagagatgagtagaaggggtgggtaagcatgcctatccgaccaagtaagcccacattggcagcggaccggatcaacctgttccgcactcttacacggacttaatacattggtcctctcccgtcccgcggatttcgcgggccaaacgggttggtccgcaggcctaattttataaaaaaaaaagttgcaatttcaaaataaaatatatttttctctaaaaaaatagtcaattatactcaattatatatattttaaaaaaagtcttaataaatctctaaaaaatactcaaatacaaaagttttaacactaccaaatcaattttcaacataaaaaaaaatttctggattcgaacccatgaccaataagtcacctagacacaactttaccgttatattagggctcatcctcaaataaattttcaacataaatgcaaagaaattttggattggacttttaggatcaattgggtttgggttggtcttggttagtgattgtgggtttttgggccaacccacggaccccacaatccaaacccacacaactcgcgaattatgtgagacggatccaaaatcttgcataatcatggattttttaaaatatattggtctgtgacccttgcaaaccgtggactccacataccgatccattaacctgagcccatttatccacccctaagtggaaataggtgagaaatagtacgggtgggtgggtcccacaattttaaaaaagtttccaccctaatcatatatcccaaacaaaccaacttattttcatctctctccctcatccctatttctcctctaccaaacaaaaccaaaggtttaccaaagcttgataacagtaataacactaactgtgtttctcttcatttagtgaatgggtacaatacaaaggaagtactcaatccaggaaagtaactcctgagaagctatggtagatccccattaagaaaatcatgttccaccatcaaatttaagttttctttccgttcactttgttaaaatccaacctcttccatacaattttcaaaaaaaaaattaagtgcacataattttcaattcagtcccatgtcatcataaagtcagtaaattatgacttccgaaatctccaataaagccaaaaataatagtttgataaacaccacattgagcaatcatgaataattaaatcatcattcccacctccaatgccccaaccctgacattgaaaaacaaattctcttaaaagcatttacaaaattatgcacagcttcacagatcaaaaaatgcaaacaacgataaattatgtaagtttgaattatttataataaaccactaatgaaacaaatagcaaatttgttgccctgcttaagttttttaggaaaacaagtatcttaattcaaacaaaccaaaaatatatatataccagtagtttatttcagattttttatatgatacctaagcaaattgaagatgatttagaaataactcagatacaaatagacaactcactgttagtgtatgcccgtaccaaaggtactgattggtaaacataaagttttccatgacttttatgcagatgaagacattgacataacttacagacatataataacatgcacgaacatgaggtattgtgtagaatatagtgctggtatgagtaagagtactggcttgctgaacacagcattcaaccaatctgcatccccgtgccctagtgcattgacagcaatcccagcactcaaatctaaatattctctcccttcaatgtcatacaacttgcaaccttccccctctcaagcaccactggtgttcttgcatatgtccccaccaagaacttcccttccatctctatcacatccttggttttctccaatgccgtcttcgcaatattaggcgcatgcgcaacaacatccacattaagacacgcactcacaaccctccggcatctaatctgaataataggactgcttccaaccaaagtgctctctctctctccaaattgaaaaattgctcgggtttgtaacacgacagagaaattgaatggttcagagacatgtaaactgcactcattgtgttcaattaagggttagattccctcacttcttccttttgctgaaacataaaaagaaatgaaatcagcttcccatatagttcagacttcaatcactccacttgaagcaagaattttcaggttcaggtcacctctgtttattcaaaacaacactgatacattggcaacagaaaatgccaaagagaatagctagcagaaaagaaagaggaaaacaaaaaaccaaaaaaactaaattaagatttagaatcaaattcaaattcaaatgcatgacaaatatgaccagtaaacaaaccagaaaacaccacagaaaacctattctactgttattttggtccccaaaacttgtacggactatcccccaaagtgaaagaaggactcaacaaagcaaaactctgatgcagctttctatgcaaaactacactccctggactcaacaaagtaaaaaagaaaagtttggtaattgagaaagaaaatgcagaaagaaaccattgccataacactaatctattttcattcttcaccttgtgagtactataaaataacacaaaattaattcacaatctatcaaattcaaaaccttcttctcccaacaaaatgatcaaagctagccaaaattcaacttcaaataagataacaagcataacttcaaagttcaaatcataacaattgcttttggagaataaatattgggactcccttatcctctgatttcaatctaacatccattggtcacaatggaaatcaaagtcccatttagtggtccccttcgaccttcatttttcaaatactaacaaacaatttctaattttccatggtaaacaataaataacaacaataataatttcatttctctaagattaacaatggatccaagcgaagcagtgtgctgtgtgaacacaaagcagaaacaataccttggcagtgaaattcaaggtgccagtttccaacttgggagctaaaacaaacaaggtgttcttactttcaagtgtgtgctgagaaaaaattagaggcaaaaggagtagcagagagacagagagagttattaatactaataaattaattctaataaataataaataggttcaaatgcaatatttttacttttattttttaaaattcacaattttagtctttctattttaaaataatttgatttaattttcttatttttaaaatcaacaattttaatccttttattttaaaataaaaatttttaatctcttatttttgtaaaatttaaaattttgattcttccatcaaaattgaaagagttaattaaatagattaatattaactataacataaattaaactaataatattatatcacatcactaaatttaaatcatataagattagtttcttatttatcaatatttctcaactgagctatatatcatcccctaaaaagttattttacatgcgtgtgaagtaaaataaagcaagaaaatcctgatattgtggtgactggtgatatttgtgcttggaggctcacgttttattccgaccttagggatatactaacttttatggaaaccataaagttgttttaatgtgtattatcatcatggttttataactacaagtctacaactttctactataaatattaaaatattaaagtgctaattgtatctccttttttacttaaaaaacctcttctttcttcttcttttataattcttttaatttttccctcttttataaaaacgcacacccctttacccaatacccatagagagttgttactcatttcaagagggatgaaaatgatatcaagataatctaatttagttggataaataaagtgtatgacttgctataactcctctatgatttttgtaggataaaaaaataatgaaataatttagtagagttatgccaggaactttctccccatccccaactctctgtccccactttttaacatatacaaaattatagtagcagtatagcatgggggacttatatagctgttacacatcactttataatgaagcgtataaattcaaattgtataaacttctgtccaggttcagattagtttaaacttttcacaaaaagaacttggtcccataaagttttctccagatattttaactataagcttcttttttttagaaaagataaaatctaatctcttacatgtgaatttgatgcataaataaactgtacaaaaaaaaatgtatctaaacattactgcacctagctgctttctatgtctcataaatttgcagaattatttagcaagcaaatgtatggatttctttcgagacaagcaatggttcagtgcaggtatcaaatccaacaatattactcctaatatagaattgcttatgcataaaatggaatgggcaatgctctacgagacatataaaattgaaattcaacaaatctttcctaattattgagaaatatttgtctaaaaattattaccattcccaaactattaggcctgtttggtagttaggatgtgattatatatgagaggaagataaaagcataacaaactttaataagttacaacactgctaaaattttcactgattaaacagttgtttttacctcaagatgtgaaaaccatacgaaggacacctttgatgtcaacagttaaaaatagcgggatttggttggggacaaagaatggtctttacacgatcaaaagtgcttatcttttgatcatgcagaaactcatcttttgatcatgcagaaactcatccagcatggaagctcaatgttccacctcgtgccaaggtggtagaaaccataaactatgagaggatacatgcaaggtgtacttggatatctctcaattttgcataaagcttatgcatatttaatttcaagattggtctagagctaaagactaccatgtgaacactgagcaggcacattctccacatattggttacattgcaatacgtaatgtgtagtatttttttttttatgatgcaaattgcacaagattcggcttatgtatcagttatgatcatgaagtcgtagtcatatctaagactaattattggaggagcttgtgtcttactgtgtctaggtatcctatccgctttggttgttatatatatctccttagggctacataatgtgcattttgagatggattgtaaggtcattattgatatatatatatatatatatatatatataatccttatacttttaatttctaactataactttgatcaatttaatatatgaactttacaattcatcccttctcaccgtttgtgatgagggacaaaactattatatttctaaagttaaaataccaaattgattaacattaaaataccatcactaataccatattttaacccccaaaaaaacttatacttgtctctaaataataataataataataataataaaattaatctaccagactgtaactaaaaaaattaagactaatctcttttcaagtattaaattgaattatgtttttctaaaaaaaaattatatacagaaaacaaaatccaaatttatatgctaaaaaaatccaaccatctattttattagtgataaaatattttttatactttataataaacttgcaggcccagtgtcgagctttctgtacctaatgttaattcaacgttataacatctgcagtagcaatccaatttattttccttaaaactattctacaaagtattgttgaccaaattattattcacaaataaactatgtttaagctatttttaatatattgtttattcattcccgcaatggatgactacgtcaattcaaatgcagacaaattaaaagggttgaaattaaaccaagacacttccaagggacaaagctattgctttcttttctttctaataatgttatcccgaattcagttttcaggttttttaagaataattttttgacattagctagaagaaaaaagaattaaaaaatttaaatccttcaaatattttattttttgctagttttatacttattaaataaaatattaaatatgttatttccatttaaaaatattaagatacttaataaaaaaatctcgtaaaaaatataaataaataaaaactcatttttgacctttaacctttaattgaatatatagtccaaaaacgataaatttatcttatcaaagcaattttatatgaattcccttacctcacttgttttttttttttttttttttttgtgaataactcttagggcaattttcaaattgagtaataacaattaagtgaaactttttgtgatttaggtttgtataataatcttctaataatcaaagtaagtctatacaagcaatcaaaatatgtcatcatcccttgcttagtaatattggacgtgctcctcattcaaatttctttttttaacatttcttttctatttttaattaaataattagacgagtttaacttttatgtcaggataaagtttatagactatcaataaatcaaaaattatattaagtataacttttaaaataattatttttttatcaaaaattagttataattatttttttttagagatcacactttttctgagtatttaaaataattataataaaaatcaataaatctttttcaaaagaaaaattaaaaatcaacaaacttattataacaatttttattagttagtaatacaaaaatcatttacattgttagtatatatgtattattaactttaaataaataatactacttgtttaataattttttaaaataaatttgtgtacatgtttttttgctataataaatagtgtatacattaatactaaaatgtgattcaaactactcacaaatttttttttttcaacatcagccacaaatttaataacccttataatactaattaccttttaattaattaaagtgtatttatttgttaacacgctcacatttattaaatttagccaacactagatagataaccctcagaaatttccagtgattttactttcaaggaaaattactctcttagcccgcacccccacccccacgcccaccctgttgcaacttgcagcagttctttcttctttcctccaaatgccaatactttctcaccattcctctcaccattcatcgcattaccttaactaataaatagacacacaacgaaactcgaaaaaccacccacagaaaacacagacaacaacctttgacacaacatagtggagcaagaagaatcgaattagtttggtttctgtttattttttttttctttttctcctatgtaatgcatcagaagaaatccgaagtccagatcggaaaagaaagcagcggcgtctcttccgatttcaaccaccacccactcccaaccctaactccgaacccgaaccaagatgctctccaatcactaacctccaccgcaccctacaaaagaccttccctcaccacccaaccccatctctccaaatccacaaccctacacaaattcccaaccctaaaaccacgccacgtcaccaccaccaccaccgccgccgccgccgttctctccctcctccgccgccgcctccgtctcttcctcttcccctcgctccccttcctctacttcctcgtctcccaccccacaaactccttcctcctcgatttcctctccgccttctccttctccgccgcgctcttgttctctctcaacctcgccctccctcgaatcccctccctccgcctcttcctcaacctcaagcccaaggcccgacccagcctcaaactcccaatcttctggaccgtgggagcccgcccagacccggcccaggcccaaccacagcccggggccttcgcttctccgtggtgccctacgcgaacggcgacgtgtacgagggggagctgaagggagggaagtgttgtgggagtggggtttactattacagtatgagtggaaggtatgagggggattgggtggatgggaagtacgatgggttcggggtggagacgtgggcccgggggagccggtaccgagggcagtaccggcaagggttacggcatgggttcggggtgtaccggttctacaccggggatgtttatgccggggagtgggtgagtggacagagtcatgggtgtggggttcacacgtgcgatgatgggagcaggtatgtgggggagttcaagtggggcgttaagcacggccttggacactaccattttaggtatggattgggggaggtttgtgtttaattgaagtgatagagatttgtgtttgaatttttttttattttaaaagtaagttggtagtaaaattctgtataattatttttatctaataatgtaatagttaggtaaggttgttttaattcacaatcaattctggactcagaattgatttgccagtgtgaaactgaacacgtgaatatttgcttaagattgggttagttggtgtttcgacatgattctggattatcttacgtgaatccaaacatgtctgaaatcagttggtttgttgtagttgatggctgtttgttggcttggatttgttggaagttgattttggtgtcatttattggtgtttgattcggatttggatgtgaatggtggtgggtgtgttttttatttggtttgttgtgtgtgtgtgtgtgtgaatgttttgtgaggtgtttttggaagggtgttggtgcttggtttggttttgtggtttcttaggtttgtggattatggcaatatcttacttcttgaatgatgtttagctgcttgtgtgtgcatgtttggggtgggggtgctttgttgtttagctgttggtgcttagggtttaagaattgaggatgatgttatgttatggaggcttttgtaggatgtaattgtaaactgattggatgtttgttttgttttgatttgttgtgtgtttgtgtgtagcttttgtgagttagattggcaggatgttggggcttgatttggttctgtactttgtcatccgtttcgtaggtttgcctcaatttttcgttcaataaccttttactgctctctgtctgtgtgggttgtgttagggcatataatcttgaatgttggaatgtcattcatttctattcagtttttacagttgaaagcatgtgcataggggataaagatacacaaaagcttgctttgcttcagttgtgaattgttagttgtgaattatgcgttgtgtgtgtgtgattatgaacttatgatgttgttgattggtgtttggcaatcaagcatggtgttgttggtgttgatttttattttgtttgttgtgattgcgtgcatgttttggttttgtttgttttgcatgtatgaatgttttataagatgattttggcaggttgttggtgcttgatttgcatttggtttgacaatttcttccttctggaataatgtatgttgctctatctgtccatgtgcgtgtaggtcttgctttgttgttgacatgttgtttggctattggtctttagtgtatgacaattgagaatggtgtgatggcggcttttttatttgatgtaaactgccctgttttgttttgttttgatttgttgtgtgtaaagcttttgtgagttactttggctggacgttggggattgatttggttatgtgctttgcctctcgtgggttgtgttaggttttattttattatcttaaaagttagaataccagtcatttcttacagttgaaaccatgtgcatagaggataaagatatagaacatgtctttgatttaatttgcttcagttgtggcttctgttttgtcaaaagtacctgtaggcctttgaaattttacttggcttgggtcgtgtatcagttgtgtgtacctattggtaacaattgttgggcataatatgtcatgcacttattttgaagtcattgttttgagatttttgagaatgttcatttttaatgtatctttagccttttctggaaaggaagtaagatttaaatagactgaatactaataacatactattctaatggtagtttattttacctacattggcatttgtctgccaactgactagctgtgtgaaagctaataaatgggagtttaatattgaaatcaaagaaaagatgcagtaagcatgaaatctcataatgaagttggtcaaattgctttgaataaatggcctgagactgatgcttttggttcaaaagcacctacaccacccctgatgggacctcatatggggaattaagaagaaaggaagaggcagcaagaaaggaaatgccacttctttgtgcaagtatactgctattatatgaaaagccacattcatttgtggtgtctgattactaatttgatacaaaacatcagtctgaaaacctttccttcttattgttctacattttgagttttgaaacggtaaatgtctagtgagtagcaagtataagtttgtaggggataggggccatacagggaaaacaagcatacttcttaccctgatcatggtttaaagacacccgccatagcaatcatttcaaacatttttggatcagtaaaacccaaaggggaatggaaggggtaaagattgtagaattatcaatggcagtatgaaataggattgatagatttcacatatttgtgataattcctgtatttgtaatctttcaggtgtttgtgtgacatataaagggaccttttccatcggattgaaaggaaaaggaggtgatggaagtattttatgatattattgtatttgcttttgaggtgctctctttatttatactattggttgatgagaatgagttcattttcattatctgggtgaacaattttttatgtccttctatggaagaaagaccaatacaagagcagagtagaaaaccattttgagggaatacattatttccttgtgattttatatttcttttgtgattcttttgaataaaagatcaaatagttatctataaaaaccactaatacattatttatgtttcataaatttcaagttggtgaatcttgacacaaattttaaggggttgtgaatttttgtatattaagaatacttgagacaacaaatataattactgaaatgcagtaaaaactgaaagattaaaagtgtaaacttgcatatgacccctattgtatgtattcatgttcttaggacttatcttcattattgctaatttcagtttacaacggaaagagtatctgctcccaaggatagactcagtttcgaaggtgctttatacctctcaaactttaaaacaataggttattccataataataacacaacacatgttctgaagggacacataatcttgagttccttgcaagaagataattccacaagttggccttttttgttaagcatctacaatctacactgataccttctgttttttcatttcaaaatggaatgtgctgtcttgggcgtgcattttatgaaaatcggtgcttaattctatgatgcatgaacacatttttctaattttttcgtgaatgtgggttcctctcttctcaggatcattggtgcattattgtttaattgaattacagagctttgagtgactgctttttctttgctcaccagtaagtgtttttatttttgttggtactaattatttctgtttttatcagaaatggggatacatatgctggtgaatactttgcagataagatgcatggatttggggtatacagttttgctaatggccatcgttatgaaggatcctggcatgaagggaaaaggcaaggtcttggaatgtatacatttagaaatggagaaacccagtctggtcactggcaaaatggagtccttgacattccaagcacacagagtaccacctatcctgtttctcctgttggggttaatcattccagagtacttaatgcagtgcaggtacactctacattttatgatttagtttaccttaatatattgcttaatattatttctcaatgtatcattaaagaaaaaagaagtcgccatagaatagtctgggtgatatttatgtcaatggcataatgatgtgcccattttttctgagcaaattgttttaccctctcttgaaaaagatgcttaaattacactcccctctcttaatcagggaatacaagttgccccgtaataattttcaatatagacgaacctcttaaacaattgtaaacaattatcaagcaagagagagaaaaaactctagaaagtccatttacattaaaatagactcaaacgtaacttatatccatctttcaaggagaagtgcataatttaagcatttctcaagtgagaaaaattgacattctctcttttgatgtgaaatgtgatatacttaaggtacatgctttattgtaattttttatttctgaatctacaaatttttaatattagtttccttgttctatgtttcttggtttcttatcactgtatcttaacgattgtttcactaattccaggtaaaaatagtattactacacccctagaaataaatagccagaattctcacagattttagctagattcaggagttgttggataagataatactaacagtccctcatttatccaaatactccataagtgtgccattcattttgtcaaaaattctctctgcctacaattttccatattattgaacatttacttttatacgtatcaaattagctcatatgtgtagaagaagagacaaaatcaactgcaaacagttaagtttgcatcattaggagctttcaatattaatgatgtatttccttgtgaaaaaataggaagcaagaagagcagctgagaaagcctatgatgtggccaaggtagatgagagggttaatagagcagtagcagccgctaacagagcagccaatgcagctagagtagctgctgtcaaggccgtgcaaaaccaaatgcatcatcatgttaacagctcgagcatcccaattcccattgtgtgaggctgtcagctgcaaacttttgatagtagagatgccctagatcgtcggaagaggtcggtagtttaaactgctttgtttccaccgtcatcatcaccgcaggctgaatgaaagcaagcagatttattatccatctgccacgagtcttgtatagagggaggaaggttgatggcttccacttggtaaaaaaaactacatatacatactatattttttccctttgcctacattttgtaaacttagatgtaaatgctggtgtgcgggtgaaacctcaaccccgccactgttgtaagatcgcttggtaaaataaggagagaaacaaacatctagccgaaaatgttccattttttcccacttgctatttttgctttatctgactttggaatgagacatgttccatgtcacgtgttaactaagagttttctattggttagataaggcatcgtgtttgttaaaattaaattgtaaagatgagggtttataactatattttatatatcagtaatatcgataattttgtttggtgtaaaaggttgaaagcatgattggcttaaagaattttgggtctgatgttttgctttatctacccaaatgtctgcacctttaatgtaactgaaaacaatgctctttattgattgggttgcatctttagtcggtgggactgggaaagcatgtgagaaaagcagagtagtgagaggaggtttagattctctgttttcatatgcttagtgccgatttggtttagcactttagcgagttagaggaggtttagatattcattttgaaaaggttgagaaagaaattctaataaaacaagttttattattattattattattattattattattgggaagttagaatctattttatattagaactcaattatgagttgcttcttgccaaacttcattttggattctagaatcaccaattgaaacaccctaatagtatgtttggaaagagaaattaaaatggggaaaataattatttagagaatttaaaattcttacctcttaaataatttgattggatattcatttagaaaaaatttaaaattttggtattttaaaatggaatttgtttttaactaaaatctagaattctaaattttcttttaaaacgtaggaattctaaaatttctccatagctttggtgttcttgacgccattgtggaaggacattcccccattttcgaatctataccctctgacatttagtaactgatttagatgcggtaggcagaggagaaagagaaggtagataggcttggcgtcatcatcgtggagacgacggtggtgggcgaagagggggcagcattggaccattttgtcgggaatgcgagtcaggtggcgtcacgggggtggtagtggtggcggctcagacaagccatggcatgagttgaaataggaaagggagaaggagtaatcattgtggaaaacacgagaagggcaaaagcgtagatgacaagtagtggagttgagtagcaagtggtcctcgtgcttcggttgtgttgtttgacaccttctactagagtaactgtttctaaagtagagaaattactataatcatttatcagtttatttaacatgtattaataaattataatactcctatttgtttatttatttagaccgaatgaaaataccattattgttaaggtaagaattaatatttttttctacaaattttacaataatgtatagtaggagtatttatcattttgagatggattaaagaatttgaaattaaagaaatttaaattggtttatccaaataaaaaattaaaaaaatttaagaattttaattaatgcatttcaatttttctgaatttcaaattctctaaacttttaaaatactccattcaaacacactttaagggcgaagctagattacatataaaaatatatatagaacattaattatttaggagagggtgagagttttgctataatgaatgtcaatccaagaattgcttgttaagtgtagttttatacttattacaagtaaaatatctatatcttttaaaatatattgtttattagtgctagttaagagaaatattaacaatataaattttaacacttctaatcataatttttatcatcaattaaaatatattaagattaagaaatgatgtggattttaatttttatttactaaattttacttgattttataattttaataaatttcagttaataacaaaaaatgtgtttaaaaacatgcattagaaagtatagtgttaacactcatctcaatctaattgttaaacatacaaagtatgaatttatcagagccatagtgagtttattgtgttccgtacgaattttctttcgtaagaatacaactttttttaatcagaaagctgcttatttattaaatgaatatttattttaacaaattaatttaaacaaactgatatgagtaattgataactgagtggtgatatgtgaatgttccatcattctaaatacattattaatatttaatatttgtttgttatttttttcttatcatattatgttatttatatttatattaaatcaatctttattgttaatagttgaataatttttaaaaaaaaatcttttaccactttgaaagcccgcaagatgtgggcctgtggctgcactttctgtctgagacatccccatcagctgttattccttgtcacctgacgccacctcatccatgttgttaatcccattatttcttcatccatttggcttcactttaatctgacaataagcatgagtgtttgctgtgtgatttgatgtgattttaatttaaaattagtttgaataaaaaaatatgatgtggtttgattcagttaaagaatatttatgaaatcaaaatcaaacaaaatcagtcttttgtggtttaaatttgattttattgaggtttaaaaattctgctagtgagtattaaaaaatgtttaacaaatttgttttaattggaaaaaatttaaataataactaattcaagttacaatgattaaactttaaaaaacaaggtaaaacaaagacgccaagacccgtgggagagagacactatcggaaacgtagagatgatcacatgaagagcaattttaggcattagttttagggtttcaattttaggcgttagaggagagagtgagcaactgtgtcttaagtgttaattaagtttagtattttaatattagtgtataattgtatggaagtgtcattttcacaaaagattaaaatacatgtggtatatgtacatgagtcctataataattaaactaatgagcgtatttcgatttattttgatttgattttcaatgtcaaaccaaaaatcaaatcaaattattcaatttaagagaaacaaaaatgaaatcaaattaatatcctttaatttttctgtgatatgcgactttttggattagtttccgattcggtttgaacacctataacaacagttttttgtaccttttattttttaattttgaaaacattgttttaaataaatttgtgtttaaatcattgaacgtaattaaggcttgtgtttaaattttaaagtaatattatttttaaaaaaatacctttgatccagaatcaataagagaaaaaacttcaatagagaaactttaagagaaacaaattaaaatgaagcataataaaataaaatagttattttaatttcgtatatttttactgtataacgcaaacgagattaatttcatttcgtacttctaaatttgaaaagaaaaatagcgatgctgaatgaatttcattgtatttcattttgtttatatacctcaatcaataaaacctaatacatctttttatttaatctctttatatatctttctaacaattattttataagaactgcactctttttattaattcagatgttgtatgagcaattagtagtgtacttatataatttactcaataagtgtaattcaaggataacattaaatctagaataaaaaattagttttataattgattcaaatgagtgaaacttgtaggaatatattaaatgctaactgaaagtcaaataacataatgattttaaaaaagtacacttaaagcatgattagtaatagatttcaaattgagatcttagatcactttttgatggattcatattgtcaaatgatattaaagatctctcaaaatttctctcatttttgtctttagtggtagatctcattatgagatcttagggaaagagaaagaaaaaaaaattattttttttttaacaatgtgcatatcttgagggttcttctacaagaactcatcctccatgttgaagattttttcacctcctttattggaaaatctagtaaagatcaaatcttgaattcaaaacttttgctcaaaatctagtaataaagatactctaaatatgatctaattgattgatattcgtcacatttaatatcttacacatttatttaaatagtctttaagctagttacttacttgcccagaatagaagaccaaagatgctttgccttaatcttaattcttaacctcaatcttaattcttaaatcttaatcttaatttcaatatataataaatttaatattttgtatcatcaatctattttaggcaaatgctaataagtaccttgggcacaagttaaaaaactaaaaaaaaattattgaaatgtataaaattaggttatttatgatttttttatactcatgattttcacattaaatatttttttaatttttaatcagtatcttaaggtactgattagttagactctttattttatcatgtttgaaacatatttaaatcggaactgatgtaattgaaagcttagcttgatggtgcacccgcattgtcaaagaaaatcatttatttagcatttaggtcactgtctagctcactcacgcgcaggcaaattcacagattttttaggtttaatattaatttagttcttatatgaactctagtattttgactttatatgtataagttttattctctagataagttagcttgtttttttttttttaaagatgagttagttaatatactgtattttgttctttatcaccggttgtcttatagctctcataattttgaccgttgtagtaactgctagaaaatttttatcatgaaagatatttctaacgtaaattttttttatagtgatcttggcgacaacgttagtaatggtattaatgatagagattaaaacacagtaaatttagtcatccagacaccaaacttaatttgtttacatgtatggtcgaaatattaaaactgtaaaagtacagattactaataattaaactaactattaaaaaaataattaaacctaatttgtaattcaaattcttttaatggaatgggataaaagaaaagccacaggctaatgtgggagacctccacatgttcaccaccgtgccaaaggttttatgaacataggatatatgtttcttttggaatgcgtgtgagactactgtttttatttttaaacgaagtgtgagactactgtaaaactacctaaattggattattttttagaaaaaacaaaccctcttctttccctttgttgcttcaattcctgcctgtccttttttttccattgttgttctgcttcaccaattttgaataacccaaatattattcaccagatcctaaattaaattacaaacatcaccataaaaaaattaaaatatataaaaagtaaactgaaataaataaataaataatctgcaaataaactcaaattcctatggacggcggggaagagcggcatgcatgacattggagaaaaagtgattatatgtaagtatttttgttttcgaattcatgttgacatgggagatatcaaaagagtaagtgatattaaatcaatgttagttatctcatacaagaaaacttttatcgtgggagactttgttctatcttccaagtttaccattggatgaagagcacaataatctgatggtcacagtgagactaagtaagtaattaagtagtttattccttaatgatgttgattaaaaacaaaattaatatttagttatatttcatgtgtaaaaaattcataacattattatattgtcaaaaccttcgtccttaacaaatatcttctgcctgaacctcatcttcttcatcattctcaagttgttcatccatttcattttcaacttctgacccacaaatgaaattgtgtcctacagcccatacaataacagcaacttactagggtaccttattccgaaaaactcatttccgtttgcttcaatttggctcttagaaatacgctcacacctaaaccaattttccaaactcggttaaataagtccaaaaacacattctcaacatatataggttattccaaaaaacataaataaattaataaaactattcgacgtggaaaagaaaaaaaaaacattaattttattgtcaaccatcatcatttaaagattaacccagccaccaacagagtctatatcccactgtcagattacaagggtcttcatcctacggtcttccaatgttttccaacttgggaaaaaaaccatgtttcctgcgttagaagttgtcctaatagaaatgcatatatgtatactatctttaatataaatttggccctgcaagtttttcgtttcatataagttcagcattttttaattttaatctataaagcacaaatttataaaaactaaaaatgaaaaaaaaaatatattaaagggattaaaattatatataaaaaaactaaaattgaagaaaaaacttgtaggatctaaaattgaaaaatcataaatctaccggaaataaattaaaatttaagcatataattttaatacatatattattattttatgtgatactattagtaagaagtattagtttttgttaatggcaggatttaaactcacgaactctctttcctttcattttctttttatcattagatcaatcatatatttcctactgagtcacgagtttaataacgctgtaaaagactctgccatctccatacgcccacattttcctacttttgcattttaatatgttgcattgcaaataaatatgatcatggtgtagtatagttgatgagaagatgaggttgagtccatggagcgcgtcacatgtaatattctaattgtatgaaattatttgtgatggcctcacaaagtttacatgtttatttgatgaattaacgagaactcgcctggaacaacgattgcatgcatttggcaaaagaaaccaaaaaccatcaaaccaattatcatggatttgttttggtttagtggcaatgtgatgccattttttctttttttgtgttttgcttgttgttcctatcataaatggaatgagtactcattcttctgtcgaagggtttcttactgtaccaaaaggtcttctgtttgatattctttgtcaaagtcttgggagtgtgagtatttgacagaacgaagggaggtacatgaaagaggcactccaacattcgagggagagtttgactcagagctattaatgatatatagtgatttggtgagaatgaatcggtcctcttacttagggattcacccatttttatactatcattgttgggcctaggatctgtgggtctatcacatcatgattgccaaatgaataatactcctcttgatcatgcttaagcacttctaatcaagtgatcacccttcaacgagcttagtggtgataatcatggtcgagtggtgttcgttgctcacacatgttgaaggtcgagatgtatggatatgtggtcaaagggtgtgtgcaatttgagtgtgtcaggtgtcccttcgacttgaccgagtactttatcccgcatattagccctacaagcccctttttggccttgccaaaaagaggggctttatgacatgtcaaaacgattacccccccccccctttgacggttatgcgcttttattgccatgaagtgaccgttacatcatggatgtaatagttacttcccacgtctattcaccttcccactttgggcatccaaatgtcgcatgatcttggctgtagttccgttttgatcgaacggtagggaaatgtcgtcggttgggccttgttccaggcctaactcctataagtagggggaggtccccccccccttcactctttgcccccaatatctatttatttactctgagtcgaacaatgcctttttgttttcatccgagtagtcaaaaaatcaattcttttgtggcgtatgtaataatggtgttagttgaaggttcgtcgtcgatggagtcggctggaagcaagtctaaggtgcgaggatttggcgacgaagtttttgaggtgtcgtctgactcccactatcgccaagatccgagctatgcaggcgttctaagcactttgcttgtatagctctatgtcggcaacgctaggactcttactgcattacttttgtagtcgtccgctatataatgaaaaagaataggaatacttcaatacaaccaagagggggggtgaattggttgtaccttggtaattaaaaattttacaatcagagtttccacaggatctttatcactttaaaaattattttgaaaccaagaatcttatattcaatcaaattcctctgtcaagaaaatcaatagacaactgaaatctttctgtgcaaataatttgattcacaaaccaaaacaataaagagatgaagattagaataaagatcagccacaatttttatattggttcacttcaaacactatgaagctacatccagttcttccactcaacactagaatggagttccattattgcaaattaatgttcttacaagatattacaagcctctctttatcaaccctagataaagttcagaaatctaaaacactatcagattcttagagaccaaccccactgagaacactactcagcaacccctagagaaacactatctctatttatcatgcaagaaactcatttacaataagccaatctttacagaaatcaaataacagatttacaacctcaaagaataaggaatgaattcacatgataatccaatgaacaaaatgcatatgaatgattcaccaggttgaaagaaagaataacagactcaatgcatccatttccttaagctttgaggctcaatgatgcttcactcatcaaatcaaaaacccatatgaatttttgtgaagccaagacgtttttgaacttagaaaactcactaatgaaagcttatgaatgtttgtgattgctcagaattcgaatttctcaactcttcaaaacacagagcaatgggttctatttataacagctttctaactgaaaataatcgattaaacacgctcttctaatcgattatttagcatatgtaatcgattaattcaagaatgtaatcgattaaagtgtttctaatattttctgggtttgagctatgaacattataattgattatcccgtcacttaatcgattaaaacaagaactcatgattttccaaatacactgagtaatcgattactgaatttggtaatcgattaaaacagagagaccaatattttcaaatgcactatgtaatcgattaaaatgatatgtaatcaattaaatcagcaaaacatgttagccataggcatgatatgtaatcgattacgaacttctgtaatcgattaagacagaaggtatatgatttcaaatttaacctaggtaattgattaattcgatatgtaatcgattacattgttcttaatttgttttccagaaggcacgaagaataaaataatcaatgccaacatatctgtaatcgattaaaacaggaaaacttcatttttccaaaaacttgattttaatctgccttatttattaaatgcttttgcattagccttcaatctaacaatcctaaatgaatgatatgcacactggattatcagatactacttatttccttttacaagaatcaaattgatcttcaagcttccatggcatttttgaaatgaggcatgttgaaagcacaaaactccaaagcttgattccttgtccatcttctcatgactcctcttgaatcaacatacaaggctcgatggatctcgctgatgcaactaccgaagcgtccactcttccgccgcttcacttcctcttataaaaattttaaaacctgttacttcaaagtcaaaataaggtcacttgacgggaaagatcatttttatgactaggcggagaatccattgtttcatttctactagcaatagtgtcctcgactgtacaactagtacctaaaggagttgttgactgctgacgaatgttgtgacctcgcattcctcgaattgctccctcgacaattaactgggcagcgccttgtggtccttctgcagtcaccagatcccgtccaggaccttgagggttagtttcatttcttttcaattgtttttcatttcttgctctaactttcaaatttatcactcgtgttattttgtaggaatcatgatccaggccaacactgatatgaatggtttccgcaaggttaggtgggctcggattgttgtcgctagtggactgtctctgaatgctaccagcaattgggctccaagagctcatgaggttctagcttatgtggttcccccgccatcaaagatcatagggggaagcaaaagcataaaaatcggagccaccaggagcatcaaagtggcttggacgaactctctggacaccagaaaggcaccttcctagagaaaaggcttaagcagccgatgctcgagttccaacttgccattgccttcactttgggaaacctcatggctttaaccaatgaaatattcttcaataataatttttggttgggtcatcttgtttagccatagattatttcgaagcaccgttgccaagtttggagaagaggcgacgatgcaaccaacttttgggccttgttttctagggatcgtccaacaccgaaggcttgaaacaccaattgttgaaggtcgaggattatttgaacacaacacatcaagccaacatgaacttggctggcgacaacaacaatctggaggaccatatgcttgcattgtcgaatgatgctaaaggactgaagacgcacgcccttaaatgtcgaggccctggttaagtcttgggacactaaaatcaataggctgaggttggccttggccgattccaacaaagagacagaggaagctaatgctgataaagaaaggattcaacataaggcctttgatgatgtttataattctcatgacgacggcttcaaccattgtctctggcaagtgttgcacgtgtgtgacatctttgaccttagcgtcttcgacatcaacaaagatgtgcatgaaggggagctaattcttattgatgacatcttagaggatgaggctgccttttcacccccgagatcgatgacccccatcgaggaaaccctcaccaaagaggtacatgctaaggagaccgaggatggagaaaatgtagagtatagggactaggttctctaggttttggacatgattttttgtaatgttggtttttgacactttttttattttgtaacaccagtctttggcatcttttgtaatcactttttgttgatttttggcttataatgaatatttcttttcaaagtgttggtggccttaccagacttttttcgttgttggtagcagcctctttatttatgtgttcggttaaatgacgtactcggtggagaaataatgaacaaaaattgcacaagaatttattcgaagggttaatgtaagccttatatcctttataaccttagtcgaattgtagttttaagaaatcaacaagtcttcgggcttaataaataatttgattaagttcaatcttagtcgaggagggcacccgataatgaacagtatgttaatttgtttaagttcaaccttagccgaggagggtactcgagagggaactgtaggtagattttgattaagttcagccttggctgaagagggtgctcagaaggggactgttcgtgagtctttaagttcaaccttagccgaggagggtgctcgggaggaaactatggacatattttgattaagttcaaccatagccgagaagggtactctaggggaactattcatgagtcttctagttcaaccttagccgaggagggtactcaagagagaaatgttcgtgagtcttcaagttcaatcatagctgatgagggtactcgggagggaactatttgtaagtttgaacctgttgatttataatcgaaggcaaacaatcaaaaataggttaggaaatatgtttattagaactcagttattagggtgtgcctcattaaaaccacctcagaaaaaaccatttcacatttttataaggataaaaaatcgtggtaagaaaaagagtacatcacccattacagaaatgcacctaactataataaactttcaaatgtgtaaggttctaagtcctcgggatgaccttcccagatagctattctaacttgtacgctccattcttcaaattgttgattcaagtgaagccaagtatcaaggaatgaggatcaagcttcaagattttggactttcaaacatgcacaaaggaaatgctcaaaggaaagcttgaagagtcaatttgataaattgtaaaagggagtatatgatctaataatccaagtatgcacatcatgcatcaatcgttcatttaaaggtcattgaattaattgattaagtaaaaggaaggcacttagaaagtaaaagtttttggaaaaattaagttgctaataaataatcgattacatgaataggagcattgattattttgttcttcgtgtcctttagaaaacaaaacatgatcattgtaatcgattacatatctgtttaatcgattactcaggctttttatgaaaagatggaactctctgtcttaatcgattacaatatatggctaatcgattacatgcctgtacatgcatcttagaaaaagacatgctgactgtcttaatcgattacttcatgaaataatcgattatattgttcttagtcaaaacccagaaagcttcaagatcattttaatcgattacattattttctcaatcgattacatagtttatcatggaaaaccatatatctctgtcttaatcgattacgtatcggaataatcgattaaatggttcgttcttgaaactcaggacattttataaacattttaatcgattactatcttgttttaatcgattacatatgcgaaacaattgattactggagcgtgattaatcgattattttcagttaaaaagctgttataaatagaacctcttaggctgaggtttgtaacttttgaatattttgagatttacgaattgtaagcagtcaaaaatgctctgagcttttattagtgataattctgagattctaaacacttagaagctttacaaattcgcatgagttagtgaatcaagaagaaaaagcttcatcattcattcaaagcataaggaaaggaatacattgagttagtaatctgctattcaacctgaatatcattcatttttcattcattcttggattatcaggtgatatctttccttgttctttgaaggtgtaaaatgttctttaaattgtttgtaaagatttgtctattgtaaatgagtttcttgcaagtgtagagatagtgtttctctagttttttgttgagtagtgttcttggcaaagggttttggtctctaagagtctaatagggttttaggcttctgaactttatctagggttgataaagagagacttgtataattgcttgtaaggatatttttgcaatagtggaactctactctagtgttgagtagaagaactggatgtagcctcatagtgtttgaggtgaaccagtataaaatctgtggcaaatctttctcttaatctcatcatctcttaattactttgtttgtgaatcaatatcattgctcagaattctatactctgttttctattctttgtgaaagggaatttgattgaatattgattcttggtgttgaaacaattttcgaaagtgataaagatcctgtggtaactctgattttaaaattttaattggacaaggttcaaccaattcacccccctcttggttgttttgaagtgttcctttgtttttcacaaattgtgttggatcctaaagggtccttcttagttggcggccagcttcctatttgacgagggctttcgggcttcattgcatgctcttcacgctggcttagatttgaagaattatgtcatacaccgctttcaaacttcggccataaggactgcatcttctagtacttggtcgattaggtccagatccaaccgtagtgcttcgttgttttagacattagcaaagtattgccttcgtagagagacctctcatacttcagctggtagcattgtgcctatcctatatgtcagtgaaaaaggggtttcctgagtgatagattgagggtttcatctaaaagccaaaggacctctactaactcttcaacccatctccccttggttccatctagccgcttcttcaactcactcaaaatgaccttgtctgccaccttagcttgtccattggtctaagggtgctccatcgacgtcaccctatgcttgatgccaagaacgctcaagcatttctagacctcttgggctgtgatgtttgctagtggttcgaccttaacatacttggtgaaataatcattggccactaggagaaatttccttttccctgaagtcatgggaaagggcccgagaatgttcattccccagatagagaacaaccaaggggaaaccacagagtccatctcttcggctggacaattgatgtgttgcaaacacatcttaattttaggctagttttagattataattcagataaataagttaggaattagaataaaattagttagtttattattatatttaatttaatttcatttcatcaccatttgtgcattttagggcttaaagaaggagaattaaagccaaaggagggagaaaagcaaatctgaagtcccgcgcgggtcacgccagacctcgcgcgaacgacaccacaagcaaaatcagagcttgtttcgaaagcccctcgcgatcagcgcgggactccacgcgatcagcgccacaaattcgaatcaacggcgcgagtagcgtcgcaagccgcgccatcagcgccacggaatcgctgtttccttatttaacaagattcagttcgaaattggcacagaataagggcctagttactctaattaaatctatctataaataaaggcatctggactgaagaaaaaacacctacacaccattccacacctctctacacttctatacatcattctacaccattggaaggcaagaataaaggctaggtcgctgcagaataatgagttatttgacagctttggtttctttgaagcctatggcaggctaaaccttgtattgtgggaaggtcatgaactgatgtaaactcctctgtaacttgactggtattgaatgagaattcttattgttttattttactctgctctttattgtttaattcttatttagaattggccattctatttagatgttgagggttaggattcgcaatgaggacgttgggattctaatttctgaccttagtaaaataacagttgttcatcacctagagatagggatgcgtggctgcagaactttataatatagtcttttatatgcttaacttgatagatttcatcaaggaattgggtctttgattcgggttaaagggttaattcactaaggaattagggattaactagagtaggaagatttattctccgagcaaaagaattcggaaacccttatgatatgttctctaaatgcttagtttgacagaatcgctaagggcttagggttctcgatcggattaaagggctgaatcgctagttatctaggatttacgaatataggagagatttgtcatttgtgatcaaatttgataacccagttaagtgaaagaggtagtgaacattagggattgtgcttgaccacaattgtttctttcattggtaatacttcaactattttactgtttattttattttagttttctattcaaatcttcaacacacaactattatccaaaaatattttctttttacctccaatcacatagaattaatattactgtgaatttcaccccaatccctgaggagacgatactcacttacctattttattacttgaaacgataggtgcacttgccgtattgtgcgatttttgcaacaagtttttagcgccgttgccggggactggttaatggatttttgcagtaattttaatcttgtgattggaatttttgttgctaatcgcttctctaagttttatgcgaggttcagttaaccctgaggatttacagttcgaacctgaaattgaaagaacactccgaaggagactagccaaacaaaggagaagagaagctgaatactttgactttgattcaattccaaaattagagtcagaagcagagatggctgaacaagaagcaaataatcagccaagacgaagaccagaggatgaactaatggaggatattctggctcctatgttcacaagaccaaactcaagcattgtaaggccaccaatacaagctaaccactttgatataaatccttcattgattgtattggtggaaagaagtcagtttggtggggaagattttgaagaccctcatgatttcatagatagatttctgagaatctgtgacactatcagacaccaaggggtctcaaatgatgcagtaagactaagtctattcccttttgctgttaagggaaatgcattgagatggctgaactgacaaacatcaaatagcatctcaacttgggaggacttagtctcaagattctttgcccaatacttttccatggataaatataatcggttggtgaatgaaatcaccaattttactcagaatggaagagaatccctatgtgctgcatggaatagattccaagaattgatcaggagatgcccacaatatgacatgcttgtgggtaagcaggtacgtattttctttaacggtatgactcctgaaactcgtatgattgttaatgttgcagcagggggcacaataaggtcaaaaactgcagctcaaacctatgagctgattaaatctttggcttgtactgaaaatgaaagcatcaccattcagtcaacgaaagaaccaatacaattgtgcagcaatgatgccatgcttgcagagcagaaaattttagcccaacagctggctaaattgaatgaaaaaattgatagacttcaagtctctgcagcccaagtttcagccagtaagccacatgtctgctgcgaatactgccaaggtgagcatgaatctaatcaatgccctattcttgttggagctgaccctgtgcaggttaatggcgtttggaatgatcaaagacagcagcagccataccagaggaacaacaattttgctgcaggaaataactaccagagaaatattcaaggaggaggattagactataagtccagtcattatctgcaaccccctcccattccaaccactagtatctctgaacttgagaaggtagtgatgcagctgtcacaaacaacaacaaaatttatagctgagactagagctcatcacagaaatcaagatgcctccatccggaatcttgaaattcaaattggtcaattggcaaaggaaatttctgaaaggccacaaggacagttccccagtgacactgtgacaaatccaagggaacatgtcaatgttatcaccaccaggagtggtaagatgctcactgcacctgacaaagcagaaaaagaaaaggctgcagaatcagaggaagaaaaatctgcagaaaaagtggagaagaagaaaaatactgctcctccaaagaagcaatgggatttctctcgctttgagaaacccccatacccggtgcagaccaagcaacaaatccagcagcagcagtttgccaggtttttagacatgtttaagaagttacatataaatattccatttgttgaggcattagccaatatgcctaattatgcaaaattcatgaaagaacttctgtctaagaaacataagctaaaggactgtgaaaccatagcacttactgaggagtgcagtgccatcattttgagaaagcttccaaagaaattgaaagaccctggaagttttaatatccctatagctataggaaatatcaatatagggagggcactacgtgacttaggggctagtataaacttaatgccattatcaatgtgtaagtccctaggcataactgaattaaaacctactagagtatccttgcaactagcagataggtctttaaggaaaccctcaggggtgattgaggatgttttagtgaaggtagacaaatttatattccctgcagactttaatgtgttagacatggaaagggaaagtgaaatccctctactgttagggagatcctttttagcaactgctagaggcttgattgatgtagaacaaggaaaattagaacttaggatggataatgaatctgttgtttttaatgttttcaatattgtaaaagatccatctgacacacataattgttctagattagatttgctggataacatgaattgtgcaggtataatagatgcagaaaatacatcagcagaaaatttagatggaaatgcagaacatgatgccacagcaaataatgcagaagaaaattcaacagaagctgaaagtgcagcaacaggcattgctgaaaaattgaacattgcagaccaagaatccatagcagaaattattgaacctgtgctggaagtgctgcagaaaaaggaagatgatattccagctgaaacaccaaaggttaagctgaaaaagattgcagcaaaggctgtgaaaacctttgagaagaaatgtgccaaaatgctggatactgcacaaagagagcatcaacctgcaagcaaaatacatgtagctgcagatgaaattgctaggacttgcaagaagaagaagatcaagaagtggcgcaacaaagaaattgagccaggacaaagtgtgatgctatcaaaatatcgcctgaaattttcaggtaagtcaaaattcttttggtctggtcctttcttggtgcaaaagatttgctcttatggaacaatagaaatcaaatcattagacaagggcaaaccctttaaagttaacaaatgctggctgaaaccttattctgaaggccaagtggatggaaccacagctcctattccacttaaatccactaatgattaaactgcaggatgcgtctagtttaagacgttaaacgagcaatctttcgatgtaaatacatgtttttaagttctatttttaatttgatagcagtagatttatacttcatgcatgttaaattttaggcatttaggattattgcatttttagttaagtacaaaaagcatttaaaaagaaagagaaaaggcctgttagaagtgtggcgcgatccgcgccaattgtggcgctaaccgccccaatgactcggccaatccacgctaaccgcgtgaagctcgcgctggtcgcgctatccattcgaccctgagcttccatttgcatgataaggcactaatcgcgccaagactgacgctgaccgcgccatagccacagtcacttcacgctactcacgtgaaccccagcgctaatcgcgccaagtttttgagcagaaaacccttaaagtgtattcccgcgcggatcgcgtcagatgccttgaaaactgttttaaatttaattgattattagaacttgaattgggcctgaacatgcaatgtcccaaagctgggaatcattgaggctagtcttaggacatgaataatattgggtttaagtcctgtgcattattgaactgaaattgtaaaacttgcagacaccctaattgcttgaaatgtgaattgcttgaatcaatggttaatgttagagctatgcttgcatgaaatacttgaattctgaattttggtggaagtaagcaccttaaatctgggaatccaggtaaagctattcaattccatgtaataatgtgcagattgtttattggtcaacttgatgaaatggaaacgatatctgcataaaatattgaattacacctagttgggtacatgcctgaatttaaatctgggaatcataggcatcctgcgaaattctgagcagtttgatttcccaaatgcttttacacatacttgctgtgttaaaaaaatgtgctgtttattttgaatactaatcactaatgcacagtctagctgaatctgaaccaatgaaaagaataaatctgggaattcagccactgcatcaggtacatatatggtttctgttctgagttcagggtgcacagattgagaaagacaagaaggaaagtgcagctgcacctggcaaccaattgacagaacaggaccatttattttgttttaattttactgttttcatttttaattttcagtatgcttttagtttagttgttttgttagttagctgttttaaataagttctgtttggattaatgtttaattctgattgagattctcaaataatgcagatatgattgaatatatagcaacacataatacctttcacttattgctgaggacagcaattttctaaatctgggaatgggtgcatttgcatgatttgaggaatcacattcaagaaaacaaaggatgtccaacagagaatttttgttttagttattattttaaatttttagttgaagattccaataaaagttggcagcacatcaaatttttcagaattaaaagtgaatggacacagtaatagataggatttctttaatgaaagcttgtgtgaaatgaaacataacatgaattgcatgacacatgaatggaattgtgattgttggtatatgatatgcatgttgaagttgaagtgttgcttgaaatgaagtcagcagtgattgacttgagtttagcacatgtgagattttgagccaaacattaattatgtttctcctgagagactccattttcatagtatactagaacttgaattgtttctctggatgcaggtgtgacttgacatgattaaggcatattcttcttctaaaaaccagggccaaaaatgacttaccttcaattactttccatttgtacctatttttgagctttaacctttcatttctgttacccaaatcagagctatatccattgaccaaaccccctgaggctagagaaggtacaatacaagtccatgacagcagaaaaacagggaagtgttcatcaaggcatgaaggaaaacaagttgaattcaattggtatggaataacaagaataaatgagcacaggccagttgaaaaataataagcctgaaattattagctggaagtctaaaagtggctgtattttgaaagaaaagaaaaagaaaaagaaaatccaaaaagaaagttattgctttgttttattttatttatcatttgttgaataaagtaccaggtttgaagagaatgaacaaggaatatggaagactacaggattggacttaagggactggatctagcctcatattagctacttttccaaagattttcctacccttagcccagccaagttacaagcctaaaagaccttttgatcaaattatgcttgcatctgttgagaatattttcaagcttatggtaatgctgtgactatgttgagtgagagattgatcagcctgatacacttgagtgcatgagtgaataaacacatgtctgtgaggaatactcaagttactctccctaattgacagatttgaaagtaccatggaagctttgatatgaaatgattatactcagcatgatgaattctaggattgtggattgtggttttgtttgatcatagatccttgcttattctttgatgttctgtttgttgctgaggacaacaactattaaatctgggaattgtttgatgtgttgcaaacacatcttagtttcaggctagttttagattataatttagataaataagttaggaattagaataaaattagttagtttattattatatttaatttaatctcatttcatcaccatttgtgcattttagggcttaaagaaggagaattaaagccaaaggagggagaaaagcaaatctgaagtcccgcgcgggtcacgccagacctcgcgcgaaccgtgccacaagcaaaattagagcttctgtttcgaaagccccgcgcgatcagcgcgggactccacgcgatcagcgccacaaattcgaatcaacggcgcgagtagcgtcgcaagccgcaccatcagagccacggaatcgctgtttccttatttaacaagattcagttcgaaattggcacagaataagggcctagttactctaattaaatctatctataaataaaggcctctggactgaagaaaaaacacctacacaccattccacacctctctacacttctatacatcattctacaccattggaaggcaagaatcaaggctaggtcactgcagaataatgagttttttgacagctttggtttctttgaagcctatggcaggctaaaccttgtattgtgggaaggtcatgaactgatgtaaactcctctgtaacttgactggtattgaatgagaattcttattgttttattttactctgctctttattgtttaattcttatttagaactggtcattctatttagatgttgagggttaggatttgcaatggggacgttgggattctaatttctgaccttagtaaaataacagttgttcatcacctagggatagggatgcgtggctgcagaactttataatatagtcttttatatgcttaacttgatagatttcatcaaggaattgggtctttgattcaggttaaagggttaattcactaaggaattagggattaactagagtaggaaagatttattctccgagcaaaagaattcggaaacccttatgatatgttctctaaatgcttagtttgacagaatcgctaagggcttagggttctcgatcggattaaagggctgaatcgctagttatctaggatttacgaatataggagagatttgtcatttgtgatcaaatttgataacccagttaagtgaaagaggtagtgaacattagggattgtgcctgaccacaattgtttctttcattggtaatacttcaactattttactgtttattttatttcagttttctattcaaatcttcaacacacaactattatccaaaaatattttctttttacctccaatcacatagaattaatattactgtgaatttcaccccaatccctgaggagacgatactcatttacctattttattacttgaaacgatcggtgcacttgccgtattgtgcgattttcgcaacaacaatgcatcaagtttccatgtctctggcattaaatgtacttctttacaaaattcgaacagtttgtcatgaaagttggccaatagtattcgatcctcataaccctggtggccatggtcctttccccgaaatacaaacctcaaatccccttatgcaggtcgtggagaacattgttagcctggtcttggtcaaggcacttgagcaaaggtgaggagaaacctcttttatatagttcaccggccattagggtgtacttagcggcctgcattcttatctttctagctttgctcttgtcagctgggagtatctcatgcttcaaatagtcgagtatctcttttttccaatcccaaaggggcttcctccacttgtagacattcttttgttgagacgctgggttctagcactgaatgaagaataaaggttttaagttgtacatgcttaggggaggtagtcagtcaagctaactcgtcgaccttatcgttgactgttagctgttcgacaagcgcaccaaattgtccaagtaataaagaaatggtaagactgagtgtcgattccacaaagactttgcttgtactcagagttaatatatttctaattttaagggagcaacgaattgaatttgatatttttctaatcctaattccgaaacataaaattcaacataaataaagatagttaagcagagcacaataaagagataaaatacaaacacttatggatgagttatcggttgatgcagagttttgtgacatgttgggggctcaactcaccgaaactacccttgatgcaatattaaaggtttttcgctattcaacattatttccactctccttgatttactaagatattataacctttattcctcaagcgtaagaccctaaatcacttaatttcactcctaattcctcaagagttacattaactgatttgcattaataataaagatgataacctaggccaaacaaaaccactttatccctagacatgatattgtttagaagtgttttttagttccaaggcaataactattttttgatatattaaaacctaaaacaaagcatcaaaatgggtgatcaaaccactaacgtgaataaagctcagaaaaataacaataatatgaagataacattaaatagatagttagaatcattacatcaagagtgttcggttgtcgagctcccaacaatggatgatttagcctcccatggtcatgagaggcttacaaatacaaaaaggagaaagatgaatggaagaaaatagaagaaaaatggaagaagggtggaggaaggggccccaagtgagtggggttttccctctttttcgtgccctagctctattctgtccaaccccctgagtgggtagtgttctttcctttttatacttcataacgcgcactatcaggtttttcagaattggttacaccctgagtcggcctgcaactgagcctgcatttgtgcactgagtgagcctacatgggcatgctgagcttgcatgtgcgctctaagcgagccactccagatcttcaatccatcttccatgtctctgttgtatcactctctacaaaaaaaaatacaacgaacacactataaatcaactaattttagcatctactagataaaagcttagaagaagctaaatttatacgttttactcacaaaagaagcattaaaagagggaaaagaagataattgctatgtgatttacacgtaacatttatgtattcatagcaattatcaaactcccccaaatttgaagctttgcttgtcctcaagcaaaagtaagcaaatgttaaactaagttagatcaatgacaatgtcaaggatgtaaccaaatcacaaaaactgagataattgcatacttccaaaacaattttaatattcaatccccaagttcacactaactatggttttatgatggaatcatgcaaagaatgcacttaaatagtgaaaaaggttagcaagactgacaaatatcaaagaaagatcaacctgtccttcactcctcagaaggctagtgtttcactcaagcacacaggtggttcggtcatcaatgattcattcaatacaattgaaatcacaattgttagctttgcacatcatctcattcaatgcaatcacacacacaacatggatcactaaggactttattaggcttgaaacatggttgggctacaaagaaatcatggttttctcataattcaaacaatcaagttataggaaagcattcacttattccttacttgcgttagaggaaccattttttcttgttctgtcaaccttatttaacttgccactattaatagcacatagaggttttcttaactttggtttacttttactttatatatatatatatatatatatatatatatatacacacacacacacacacacaccaaaggcacattgtcattcttgtcctctgtgtgcttcttactcacatccctgcaaaagagttttctaaaagacattcccccaaatttggaacaattttgtcttgatccctaaatgatgctctcctataacctaaggtatggtaacatagttccatatgcttttcagttcaaggttcaagaacaatattccttctcagtttaggctcaagaggggtacaagagattcaacattcattatcaacagggttggttttttggccaagtggctaaaattaaattaacaaaaaggccttgatcatatccactcaaacaattcaagactcatgcaaaactagaaagcaaaatcaatagttctctcatagttacgatgcatacaactcacacggtatcgtgaagcataaaacctctctttcacaagattttctgtcatgcaagttaaccgactcactcacgcacatttaattcataaaaccatcaatcaacaacaatgcgtgctcactcaagaattgaaatttgaaatttcacacaaatgcaattctcagtcatgcatatgatttaccccgcatgcccacaaaaattgttacccaaaatgtgtgaaccaaaaagcactatctatcatgcataggtaaatccaaagtaaaaagcagaatataaagtgtctagaacatgataaaataacaaacagagcataaaatgaaaagcataaaatgtcctatgaagaacatggcctcagtcctgtaacggccatgggtcccatgttccctgagctgctgagatatctgccaagtaatcatcatcatcagcagcagcaacatcctcttcagtaggttcggatccatcaacatcactcccccccctccgatagaggaagttctgtcccagaccaagtgacgcgggagaggaagatctatggcgacatcaccggttgctggagagatagctggtggaaacgatgttaagctcgtggcatgactagaaggaggaccctctacgttttctcgaggtcatctgcaaaaaagacaattaaaaagcaagatatgtaacaccccaaattttggaaccacagccaattactggggtaaaatgataagtagaggcagtgcggaaggatttggaaaaaatgacgaaaatacccttgggcatttcaaaaatgaccaaattgccctaggaagtttagcaagacatcttgaggaaagaaatcctataaaaattcttagatgctttagaaaagaccaagaatacctctagggtaacaattacagagatgtcttgaacattttttagaaatgacgattttacccctagggtgaagggtaaaattaccaaaatgcccctaggtcaaaactgactaagatgactttagaaaattatgggaacctgagtattggataaaatgcctttagacaacaaattatcaacatggttggtggtagaaaactctaaattgtgatttctagaaattttgaaagatattctgaaaagagctcaatctagacaactacaagtatcagaaaattataagaaaagtgtaaatataatctatggagttttctcttaattatggaaggaataggttgcctaaataagttagtttagtaattttaataattagagtcaatatgaaccaatgagaaaatagaattttagtattacatgaaataaaaggaaaattagattaatttggaaatttagattaagccttgaccatatgatgcaagatcaatggaggaaaacttgtagaaaagtcaagaatgatcacatggatggataaggagtctagacattccattggtccaagtcaaaagtagcaattaatgcttggaatcttttagaaaataaaacttagcacaaaaggcaagtatcatacgtatgaaaagagcaaatggaatgccactatatttgagaagtgaacgtgcacaacaagcttgggtcaaggaagtgaagaaaattcaagaacaaagacacttggaagcaaaccatttcttagccaattaaaagtaagcacatgtaaaatagctataattaccaaggaaagatatttgcattcataattgaaaggaaaccgtaaacaagctgaaccaaggggagggtatatgtgcaaaagaaggaagaagaatgtggaaaaagccacttggacggtgcaaaagaattagccaataagaaggaagctagctttagatattttcaagcttaattaagactataaaaaggcatatggaccgaaactttgggctgtccttaaggaaattcagccatgccaaaaccatccctagagcctttccatttcattctaccttttacctaaatcaaaagcaaaggcttacatccttggaacctcacgtgaatattaaaaacactaggaggaaggaattattcaactttaaagaaggaaaagttgtcgaaagaataaagaaaacaaggaggagggctgatcaaaaagcttcaggaaggcaaaggtatggggagtttgtgataatcaaagtttgaataagatgtatgtcaaaattcttatatgattttataaagaactaaatttggtattctaggtgtttaataaattgtcttaaaagagcttgaatggttagttgttaagtaacttggttttaaattaaggaataagtcttgaataaataacttgaatctaatttaaggaggaaagctaaaagtgattaagagtagaagtagaatagctatctttagaaaaatagttgtttgaaactatagtggctggctatcactttaatgatgaccgaaattcacccatgcttctttaagtatctatatttaatttgattggttggaaacatgtatagtatattggattctatggaaaattaggaaataaagttggttatcatgtgtttggtaaaaataattcaaaagaagataaagatggtttaagtgttgatattgaaagaaatgtttgtaaacatgtgttgttgagtgtttctattaaaacttatagaatttgtgtattacttggtgattcataaatcttgatgagctttgagtgatgtatggtgaatcttgatgaattttgagtatcaagttgagtggtgtgttgtgttgatgtgatgagatgacctaagtgttgagaagatgaaatacacagagattatgtgttgaatgattttataaagttaatatgttgcttatgaacccacatgtattttaagtggttttatgatgagaaaggagtaaagatattatgttgagtttgagatgtatgtgatgagaaaaagaataattaaaagatgtgataaaataaattattcatgcattgtcatacgcatatgcctggcgggggttaatccgtggagttgatgccttgcgagggttaatccgtggagatgtgtgtcagatagttagaggaactgagtatgagtgttcagacagtgaggagtctgagttggggggtgcttcggcagtggggaactcacgccacccatgatgatcacatgtagtgtgggtgactttcctgtgcaccactatgacaccctgactgatcatgcaagttctggaccagtgattggagctatctgactgtggccactgatgatgatgatttaataataacctgagatctcagtcatgcatcatataaaaagatgagcatgcagtctatacattacatgatgagtatgtggaatatctgttgatgagtaaattgtatgacttaattcgtgtgttgtatagatgaagataatttaattctgtgggcaaatactctgtgttgttattttataaatatttacgtatgtatgctgttatatatgtttttattcaaactatgtctgtcataaacttacccgagttgtgtctgtgattgacacctgtgatgaccccaatatatttggacgagcagatgaacaggaaagcatgaactgtaaatgaaggatgatgaagaagttttgatgaactgtttgttgtagtctgtaattttgtggcatgtaattcgtagtaaaacgtctgtgtattattttggataactgtagctggactgtatcttattattattataattaaaccgtggtgaggaagaactgtgtacgttacaaacgaatcatttgcaagcgaagcaaaaagaattttcgtgaaaaatttataactaaaaacgttatagtacagaaaggacatgaatttccatataaaaataatcaagcacgagtgagtagatgcgcactgagtgcaccccaaaagaaagcattaacccaaaaattctaggctaaatgtgagacggcgtgcttggcccatcacctgctgaatttactcgcacttagctcgatgatattacgttgtcgacacgcaccaaaacaatttaactatgttaattctatagcacaggattaacctaggtcgactcagagacacaatcaatatggttctagcttcaatttactaataacagtgaggggggaattttatcaaacagtttatgtgcttaagtaaaacttgcaaaaatgtaaattaaaattaaagagcaacacagaaactaacagaattcaaaagaagtgatgtaaaagagaattaaagcatgaattcaattcacctcaccaagcaatttgaatcatcattgttctcagaaatttatcctattatgaaagttcattcaatctcattagaagcaactcaatcgacttaacccctaaattgattgaaaccacaaccctaactgaaatatcatccaactaatcagtgattaatattcgaaattaggaaatgaatccataacctaatccgttttcaatcctaaacacattcataatcatgaaaacagaatagcaattgaagaagaagatgaacattcacatagaatttgaaataccaaaccagaactcaaattctccttgtgcttgggttggttccttggattgagtgaggatttagccttccatgatcatcatcagtgaaaggcccttggaattattgcacaaaaatggaagaacagaaaaacgaaaatgaagaacaagcaagaacagttgagagaaaatgagaacaagggttttgatcctaaaaacctaaaagaagaaaatgtaaaactgattttattaaatgaaattgtgtgtgtaatctatccaatgtcactaataagtagtgactaagtctgaagaaaagaatgggccatcaacaaaatccatcgattctaattatttactatttacaaccataaaattcaaatttgcagcccaaaattacaagtgcagaggtgctaacttcgaagctcaaaattaccctcaaaatgatagaattggcctcgagctatttctggcaaacttgtaggtctttttgttatctttccaaagactcctagaacgctccatttggagatcggtagcactctataggccctgcacaagtcagatacattaagtgagcaaaaatccaaaaatacgctacaattagcaattaagcccacttacttgtctaggtcaaaaactgaattagaatgaaaaaataaaagttcaaaagaggtcaaataagctaagaatgatagacaaaatttaactaaaagcactctatcactcgacaatgcacacttagcacaattattttaagttgctaaatagagagttacatgtgcgctaatactctggaacaaaatataagcaaaaataaaaagtgacaatttttttttttgaaaatgggcgttgagcctccactttgcgcgctaagcaagcctgagtctgtgcgctaagcctacacctgtacgctgagcccaattcacgtacccaagacttatttgggttgagcgcacatggcgcgctgagccaacactttgcgcgctaagcccacacttgcacgctagcgagatctacaagttaatttttttctgcagaatccgcttagcgagcccttgcgcattgagtgagccctacgcgttgagcgagccataaaaatctggtaacaaaaatcaaacaacaaacataagacaaaaagcatcaacactcatttacacacatatcaaccaacataaatattaagaaagtcacaacagcagaaaaaaggttagaaatactaggttgcctcccaataaacacttatttaatgtcactagcttgacgggccaaatgcctttaaggtggcatgaaggtcacatcaaacacatcttccttgcattttcgcttcttagctagaaactcgatgaacatcatgtatccatgaagctccttccatatcattgcaagggatgtattggtgatcacagaaaaaatggcactcaaggatttgtcacattttccatgcctttcttccttgccaatcaattgatgaggagaggtattgacttggagagggctttcttgttgaatttcaacatgtgagcacttctcccgttgttgttgtgttccctcctcacttttctcctttttttcttcatctttttcctgcgtatcatgctcttctacaagactctcctcatgtgttgtgacttctacaaaattttcttgcattatgaccgaaggatatgtgtcagccatttcttccgctagcttaccaatttgaatcgccatattttgaactgaattttgattggcgttgaagctagcttgggaagtttccatgagatgcatcaacatattttcaagattagagagtctttcttcttcatactgattgtaagggtgcaatcttactcccacccagaattttccatggagtaaggatgacaatcatcattgacatgatctcctccacaaacatcacaatttataggctgtgggcgactcacccctaattgtctgagcatactacttcaaatatcttccaagggtcaggttcttcaaaggttccaccctacaagcaaagactcacaagaaaaagatacttttctcttttctaattttttttctttttcttcttttacttaacacaattgatataacacaaaaaattagaaacaaaagaatttatgcttaaacttaggatatacaaactaccaagtacaatgaactaattcctcagcaaccgccaaaaacttgttaacggtttggcaagcacaccgaattgtccaagtaataaagaaatggtaagactgagcatcaattccacttagactttgcttgaactcagagttaatatatttctaattttaagcggacaacaaattgaatttgatatttttctaatcctaatgtcgaaacataaaattcaacataaatatagttaagcaaagcacaataaagagatagaatacaaacacctatgggtgagttgtcagttgatgtagagttttgtgacatgttgggggctcatctcaccgaaactacccttgatgcaatattaaaggttttttgctattcaacattatttccactcaccttcatttactaagatattctaaccttgattcctcaagcgtaagaccttaaatcgcttaatttcactcctaattcctcaagagttacattaaccgatttgcattaataataaagatgataacctaggccaaacaaaaccactctatccctagacatgatattgtttagaagtgtttttcagttctaaggcaataaccattttccaatatattaaaacctataacaaattatgcaaatgggtgatcaaaccactaacatgaataaagctcagaaaaacaacaataatatgaagataacattaaatagatagttagaatcattacatcaagagtgtttggttgtcgagctccgaacaatggatgatttagccctccatggtcatgagatgcttacaaatacaaaaaggagcaagatgaatggaagaaaatggaagaaatatggaagaagggtggaggaagggggccccaagtgagtgggttttcccatctttttcgtgccctagctctattatgtccaaccccctgagtgggcagtgtttttcctttttatatttcaaaatacgcactatcaggtttttcagaattggttatgcgttgagccagcccttttcgcgctgagttggcttgcatatacgtgctgatatgtggctcacaaatgaaggattaaaagagggaaaagaagataattgatatgcgatttaaatgtaacatttacgtttgcatagcaattatcattgacctctcggcttatataagttacttgcacttcctcaaattctcccttaagcttctcaaacatgtggtagtattttaggagttgggggtctcagtttgaaacaccttgttgatctgctcggtggcaatcttagagtcacttcggcaccagactcttttagagccaacctttttggcgagccttaaacctgtatggagggcttcatatttcatatgattgtggatttgaagctgaagcatagcgattagaccatagccatattgttgggtccttccaaaataaccctgactcagctcccattttggttggaggagccgtctatgtgcatcatccaccatttctactcaaactatggtagtgggggatagaactcattgatgaaatagtccagtacctgtacccggatagtacctctccactcgtaggcaatattatattctaagagctcaattgaccatgtcatcattcatccagccaactcgggcttacgtagtatcttggctatggggcaatcagtctgaatagtgactttatggctctaaatgcattgttggaggtggcaagcggcattgaccactgcgagggctaccttttccatcaattgatacctcgtctatgaatcttgtagtacccggcttacaaagtatttcggtatcttctcactttcttcctcttgcaccaatgtcacgcttatggcctcgactgggaccaaaaggtaaaatcaatgtttggtcagtgtctgattttgacataatgggcggtgttgttgccagtgttacctttatttatcaaaaaggtttcttcacaatcctcattttagacaaagttattggcctttttgaggaggttcataatgggcctagccttgttgacaattcttggtaaaaaccttgacaaggaggctatcttgttggctagtcactgggcctctttaatacattctgaggactccttatatccaagatggcttggcatttgtccgggttggcaagtattcctcgatgggtaagcatgaaacccaaaacaatttcctccttctaccctgaagacacagttctcagggttcatcctcatgttgtatttcctgagttggtcgaagacttcttctagatttgtaaagtgggttttcaagttgttggatttgaccagcatatcttccttatagactttcaggttttgtttgagctgaccttggaaaactttgtccattaagcattgatatgtggctccgacattctttaacctgaatggcgtgactttttaacaaaattttgcagattcggtgatgaatattattttctcctaacctttagccatccttatctgattgtggccagaatatgcatttaggaaacttaacaccctatgtctgaccgctccatcaaccagttggtcgatctatgggtgtgttatgcgtccttggggcatgcccagttcaaatctttgtagtccatgcgcatcctccacttcccgtttgatttttagaccatgaccacattggagaggccagtagagtagtcaatctctcagatgaacccagcactgctcaacacctctcttcacccatctttctcttcctctaggtgatcggcttggtgtcttcacatatgtacaacctatgacaatagaagcttgggtcgataccaggcatgtctattaaggaccaggcaaacaagtcgatgtgttctcggatgactcattgtatccgactattgtcatcctcgggaaactaactccccaactgagtgatctgtccttccctaggcttcagctggaaagtggaagtctcttcaactgggcttacttggttgtcatcattggttctaggttcaagctcaagtccttctacctcttcgacctcaattccaacttccacatgctggacggcttctagggttccttcccttgtgtgagagtgtagcttaaggttggccatgtaacattcccggggcatccattggtcagcgtgcacaattataatggtctagacgtctgacgagaattccaccgcgatatcaggtgtaacaccccgtaggcctccgacgtgttatcattaataatatcatattagcgcataaaaaccaaattatatacattagaggaagcatagaatcgttttcttgatacattatgtatggaatcacctatataaaatcgtgtcacaaatatacagaacaataagccacgcccctgctgatccaatttatcaaatctaacataaacaagacagataacagagttttaggcagagtaacaacaaaatatacatacatatactcaggggaaagtctcatatacatcacatcaaagttctgtacatttatatacataacagtttcgcaccacacacggtgctacaaaagaatatcaacccacagaaggggtatacagaactaaactcaaaacaaatcaaaatggagccttcaagctctccatgcggctcctcagccaagcagcctagtctctgatgggcctcttgccctgagactgttcttctcttccagaaggttcacctgaaaccacataaccccacacggggtgagataacatatctcagtaagcttaggatccatggaggaatctcctccaccctggcccactatcataatacatatgcacacacatcacaatcaaatggcccactggcctagccctctggctttctcaatcacacagcatatcatacaaggtgactacacatatcagagcaggaggaaaccatctcctgtaatagggaggaaaccatctcccaggaataaagtcaccaaataggaggaaaccatctcctatatcaacatatcaggctaggaggaaaccatctcctagaatgggaggaaaccatctcccagtgtgaggccggaacttacacctgtgtcatcccaccggacgctaccctttacggggatgcacatatatggtacctccgagaatagcaggaatccatctgaactattcccttggtctaggggatcatcatcaccccgggatcatcatcacccatgagccaaccatactaggaggaaaccatctcctagggaggtccatatctatctattggccaatagatctatctcaatcacaatcacagtacaatcacagcatatatccatcatatctcaagcacagaggcatatattcatcaccacaagaatgcagataatcatgcatgcattatgaaatgaccaccactcccccggagtgtggtgtggcacacaagatgggaatcatccccagggacactgaacttacctggaacaatatcactctgtggtctagtccctgctctgtggctcccgccaccgataatctcagaatcaacgcctatacaaggcatatacagtttcatatcaatattcaaaccacaggcatcaatcacagataaaacatagcataattcccctatcctatggttcaaacacgctcagcctatattaggctgctctcagaccatacaaggtccatctgggctgagtaccaacctatgaatcaatgtagattcaatgcctcataagcatggcataatctcatcagccccaacaactcacagtatcattggaatggttcaagcctcgcctaaggctccattccattagccccacaggctcaatacaacctatacaaggctctggtttaacagatggccagtacaagtgaccataacacaggccacacaggcaacacagaaccaaaaatccaaagtcatcagaatcaaaaactgaaagctattccttcatctattcatcgttctaaacaagtttctcaactggacccttggctaattctagtcccatatcagtgtgggtcacaaaactcagaaaaccccaaaatcacagagacccaagagaacttgaatttcttacctcaatggcgtcccaggagacctcagaactgctttcccaagcactggtgcctatctcctgccttggtctcgcctattctcaagttctcagaaggtttctcacttgagaatccaaactctcactcaaatggggtttaaaacgaaaggatgaaggattatagctttctgaaggtttctctcactatccaaggtcacagggaggtgattaggactccaaacagagtcctaggaagcttggtacaagctctaatggaggctgggtcgtggagaagaagagggaatagtgttttcccttccaaaacgcgatttccctttaaagagtcagcctgcccgagctccggcgcgatccgcgccacctcccgtgccatccgcgccacaatgtcggtgctccggcgctaaccgcgccaaccccacaccatcagcgccaacttccccgagacctgtggcgccacctgccccacctctggcgccatcagcgtgaattttcagagaaaactgattttccagggcacttctggcgttatcagcacggccctcggcgctacccgtgccacctctaaagcaaatggcgctatccgcgccaaccttggcgctggccgcgtggaaatccagagaaaatggattttccaggccacttcccgcgctaaccgcgcgacctctggcgcgactcgcgctggatggaaaacctctggcgcccctggcgccacattgacgctctcagcgtcagcttccaaagggtctggagcgatcagcgccaaccctggcgccatccgcgcggcaccctaaacggggttttctcaagtgaatccccgcgcgacagcgcagggtcaagcgccaagaaaataagggtctttacattaggggttgacacaatcgtgctaagggcattgaggaagggatgaccgaggagtatgttgtatgatgtgtgggcctccactatcacgtatcgtatctttaacttatctagattggcccttcataccctaacttggtgtagagctagagcagcccttcgtccctacctattctctagcaaaagcgaacagggggtcatcgtgggaaaggatttcaaactcgggtatgtccatctatttgaaagtttttcaagaaaagatgtcggtcaagctcccttgatctacaagggtcttcttgacgatacagttggctatctccacgctaataaccattggttcgttctgcactaggtcaattgccttgaagtcctcggttgtgaaggttataggcggcatgttcggtactcggtgctaggagatcatgttgatggatcggacctgctgaaggtgtctctttcgtgtggaggcagtggccccaatcccaacgaagccttcaactatagtgtttatgacccaccttggtggatcaaggggtctttcttctctctgcatggagtggctttggctcccccgcctttctaactgccctgcatgttctcaatctcttcctcgactaggttcaggtttgtgtcttccctcgggcttgtatgactacggcttattgacaaaatcttttaggtggtcgagcttgatgagctcctcatcttgtctttcaaggcactacactcctatgtcgagtggccacgattgcggtggtactgacaaagctttgagtacttggcctttggtggggtgttggctctcttgggcatgtccaaaatgttgacagctaaggcctgatctaaaatgtgggatttgttggtggtaagatgagtgtattaggtgatcgcggctctcatggcgatcggtccctcctcccttcattacaaaccttgttggagtcgagcttgtcattatctttcttggccaacacggtatcagcccgcacctagtttcgatactcgtccaactcctccatctacatgtacttagtcgctctcgttcgcaactcggcaagatcagctgtcgacttcttgcataggttatttacaaaaagtcccactcgtaatgtcgttatcaagtggtgcatagccactattgggtccaggtttcaaatattcaattcaacctttcctaagtgttccatgaaggtccataatggctctttctactcatttcctatattgacgagggacacagatattagatggtgtgccgacttatggcaaactgtgtcccaaagcgggtcgtcagggtgtcgaacgagtccacagagttgggggcattcgtgtaaaccagtgaaaggcctgccccttcaataacatcgggaataatcagcaaagtatcacgtcattggtgttatataggctcacctagataatgtacacgtccaggtgttcgtctggtccgtggtgccatcatacttatcaatagtcaagttctttcaattggaaggaagagtcacctccatgatgctagagacgaagggattcttgaactataatagttgtcttcttagggtattgaaggtcgggggagcatcatttgagcacacactcggattaatggctttgggcaggccaattgcggttgattcaacctctcctccttcaggcatattagcctcaggttgccgcaacttgtgcacctcctggaggtgagcattctcacgtcgaagggcgacgatttcctcagcatggtgtttctgcatctcgaagacctaagcatgtagtctcctcaccacttaagacaagtcaatctgatcttctacccgagtgtcttcgttgtggtgattgttagttggttgctccattgttgttgtgtttgttccaactctggttatagccaaaaattcttgtggttaggatatgcgagtaacacagtgggcaccaaaattttcctatcacaaatggaacggatgcttgtccttctatcaaagggactcttactgtgtcaagggtcttctgtttgatgttccttttcgaagtcttaggagtgttagtatttggcagagcgtaggggggtacccacaaaaggcactctgatgctcaagtgagggttcgacttagagctattaatgatacatagtgagtatgtgagaataaatcagtccttttacctgggagttcacccttttttatactaacattgcttggcttgaggtctgtgcgtctatcacatcatgattaccaattgagcaatattcatcctaatcatgtttaggcacttctaatcaagtgatcacccttaagcgggcttagtggtaataatcatggccgaatggtgctagttgtttgcatatattgaaggccgagatgtataggtacgtggccgaagggtgtgttcagtttgagtgtgtcaggtgtcccttccgcctgaccaaatactttatcttgtattttaattcctagaatattttttatttatgcttaattttatttttttattggatattatactatgcatataaatttaattatatagatgacacaaagaatcgaagtatcgagaaatatcaataaaagggagcaagaccaacaactttaggctgtgatcaatttaaaaaaacgttttttagtgtttgtaaataaatagttataaaaatattatattatttttattttctattaatagaatcaataatgtgagcacatgaatcaattcgacagcatcctctgaatgtgattgaacctcgactgcatgaaagcctccgttgctaatctattgtttattgttagaacaaataaacaatgatatgttttccttatatttaagattgattatatatttatattaattgtttgtcaagtgttcaaaaaatcctaaagtagaaatatttcttttaccaatattttatagaagcaatcgtatatgttgttttattaatgataagacttaagtgcgatattatattgagtttgttctccaactaaaataaaaattgtatttcaatgacttgtacaatcaagatttacgcatgctattaaagtaaacaccaattctaatcagaaaaccacagtacatatactcaaaaaaattccatgcaacttgagcaaggacattttgagtagcaacttttaatttctttattgcctcgacaagaggtttataaaatgacactcatgacactttcatatcaaaccaagctcagcaagaacaactctctttctgaattctaactaaaactaattctttctgctcctcataaacctccttttgttttatcctctcgatggtcacactaatccttcatagaatcgttggtatattttgatgtgaaacaataatttttcaagtttgagtttgaacctaaatgagaattcttctgtttctaggaaactagaatagtactcgtgctttgcacgatggacaattcaattttattaaaaatttagccaatacatcggcaacttgattgacttcaagataaatgtgccttcaagaaaaagtcccattcctctgcacaatttctctaatagagtggaccatctgttagtggacaagggaattagtacaaccttcctcagtcactttttttttatagataaatattaattgttaattattaattttttgttagtagaaaaatcgaacccacaaattttctttccttctcttctccttttaccaccaaatcaatctataactcctccctcaatcaacttgatggttgttttagagtcagattcattcaacaatcaaatcattaaagtctctaaaccaacacacacaccccaccctgaaaaattaaacattttgagcatcaagacatctacgggtaatccgataatagcccaaacattatgatttgcataggtaagtgtctttcttcatatctatgctatcttgtttggatggtgccatggtgagttttctttcaatctccttcctataaaagtaccatcttgagccatcctctggcttctcttaggagtatctttgagaaataccttgacaagttccatgatgacagacatcaccaaccaacaatccagcatccaccatgtgaagaaggtcatcagttttgatgtgtacctgtattaacatttcagaacgtaatgtaatgatcacgccactaatatcaagtgttccctgtagtaaaagggcaattcaagtgcccaaggagaaattgatgataacacgccaaatttcatgtgtttctactttcttggtcgttgcttctaccaagtagttaagtatgaattgtagcttcttcttgacttttgatggctctagttatttttgtatatctttcaatcaatgtatttttatttttattttgacaattttcttaaatgatatgcacttgtattgttcattccaaacaagaagccttagtaaagcacttttttatccattctattctatataatttcccttttttctcgaaaagtttatggtttgaaccatgttttctaacaccttctctaaagtatatgatatttctactcatttagaaagtgattcacttattttcaactatatcatgatttaactatggcctcaattacctttaattctactgctgtcttcttttattttttcatgctctgcttatctttttatgcacttattttttgtgttaatactgatggatttagaccggcgaatttcaattattgttggcgaaaaataaatggttttggaaaaacaaatggtgaactattgttttgaaattgtggttggatgattcccagcacatatttcaagtaattttgcaaatttttacaaatttgtaaaaaaaaaaaaaatatgcaatactaacaagtcaaactccggcattaattacaaaacctaatcactgcctaacctatcgccaacccgttgaccctttctactttaaatatcaaattgaaatgcaacccactctaaacatttgtttttatcccctaacagcttgtaagttttcaagtcaacaataattaaattaccatacaaaacctgtgacattagcacaggaagaatattgcgaacgttaacaaaatattgaactactaaagtaacgtcttaaattcaccaaagtaacctcttaacattaaagcatcaaatttatatgataaaaagtactagagagtaaattaagatgttatacttaaaatcaccaatttaaatgctagcacactttctgccatcactaaatatgcttatttcatttccaaaactaatgggacctcatgaatttcagccaataatattctgttttaaaagtgtgttaaagtgtgtgttgtcagcactcctctacgtgttacaatgatcgtgaagaaaaaagatcagacacagcatattttctcttagatgcagacaaaatgcaggtttagcaaatcaaagagtagcataacaagaaggaaaaactactaattctttcaccatcaaaatgactcaagaacacaaaactaaatatcattccagaactttgaagttgcacattactaatattcttaacaaagacctgccaaaattgtatgataattttaaaataaggtttgaaaacaaatgaaaagtgtaaactgctttcaactctcagtctgctctctcagcctccgaatggtgctccggacagtgacagcactggcagtactgtcaagaagaaaatgcacaaacaaatcatatcttcaaccacaataaaaaagaaaacaattaactgtaaaatacagagtgaaggaagattcttacttcaatgtgtaagcacctccagccttcacttttccacaatctttgcagccccaaatacccacagccttcctcttaacagcgtactgagcaaacaaacatatcattaatagttgatcttaggccaaagttaatttcaacaagtttgagccttaaaattaaaccctatatgtttttatgatgagttcataacctcaaataacaatttcaggttatcagaatcaagtctaatgccttatattcttttaaaaactataagtttgttaaacaattatgtattaatagacaaacttattgactgaaagaatactactttgtacaacatgatattacatattgatattgaaataaattgtaacatattcctttatttataattctatacataatattaagaatttaagattgatataactggtgtgtaacacgatcttatctcatagactcgtattattgggtgtgattgagattgagatcagattcaaatgaataactcaatcaacatttttggactgataaacacatactcatcccacaaacaatcccatagccaatagtgaaccccaaaaacattagaaagaaaagaaaaaaaaaaagaatatacctttccacagaactcacagaagaatttactgtgctgactaacttccatcttcttgatttgcttccttaaactagcaccatatcgggtgcctgtaatttgacacagcataaacatcagttatcacctcgtttttctagacacagaataaaaaataaagtaaatttgtctctaaccggtaaaggggcatcaacatcatcaacaacaacaacaagccttgatttaatttgacatagaccatagtctagcattcaaagttcctttagaataaacaccgaaacaaaaataaaatacccaaaagattcaacaaagaatggaaccaactacgtaccgtattttccaacaataccggccttcttggttctcttggtctggtcacatgcacaaaaaataaataaataaataaataatgttaaaatctcgaattagaagaaaccttaaaattccataaatacataagaaatagacagagaaagagacagcaccatttttgagtggtaagagaagctgtatcgctgctacaagttagaggcgcggctgctgaagttgaaccgtgaacgagggtttgttgcctgagtgagaagagtaacaacgcttttgagggtaagtagaatgatgggcctattgcgaacccatgaataagcccataccaatcaattatttaatgtactcattatttgcttggtgcacctccaaaccttccaatatcccatttttacccttcttcttcctctctcccacctccctaaaccaccacatctgcgcgacctccaccactcacctcctctttcctccacgctgccagccttccacctcgtcaccaccaagatccgcacgggcaaaatgaagaaggaaaggttgaatgaggtgattccttatggattgtgtaatatgtagcgtatatgttgttacggattgatcaatccataatatagataagaattttacatttatatgacaaagtctgcagggtgcaatgtgtgaaatagagaaaaggaagaataaggtgtggtagtgttagatcaatgataactaggggcagcacgaccctgggaggatgggagagtaagaaagaagcaaaactagaatagggaagaaggcaacagcgctagaacaaggaaagttagaggtgctgaggttcagggtaaaagggtccattcagtgctttattatttctaatgagatgtaccaagcaaaaatcgggtacattaagtaatatcccacataccagcttctaaacagaccaggacaattatcatattgatgtttaccttaaaaaaacacgtcatggattcagaggaaaaatgaaaaggaatttagttagaagcaaaagtgaatgacagattcgaacgagacatgctttgttttgttataccttcttagtttatagtgtatttagatgagtgttaacaaaattgattttaaaaaaataattttggttggttaaaattaattttaaaataatgtgatttatgtatgaatgttttttattataaaattaagttagaaatacaagtataaaattctggtcttgtgtgtgtgagtcatcttaacttgtatgtccaaataagatgggatatcaattgcctatgttgttacatagaattctagtcatctttgagaaattaattcatattttaacggttgagtacgtcttcagcataattacttggagtcaattaagttgtgcattaagtgagactttatgttcgatctttcttaatttacttcatatatgctttggtgattggttgaattttgaacgagaattcaatattttgggctgttcgtttctttgaaatttttaaatacttaatttacacaaattttctttatagtaaaattttaaatctaacacatcgtaaagacttatgtatagtgtcttaagtcttgagcaatgcaaaatcattttttatcataataaatcttctctttttcaaaaaaaaaattactgataaatttagaatatttaatagcataaaacaacagagctgtcaagttgcagaattttttcataatgattcaggttaggtgtttctttgattgtccaaagcccacaatgtctcattagtcacgttagaattttgtcttgatgatattttgcgttgtgtaactacgttaaaaatagtatgtttaacatcctgtgtgcaaaaagttccagataagtaattttacatcttaagcttagtcttagtcacgagttagtgaaaatagtttcttggttgacagttatattgagtcttgtttaatgaggttaactgtaattaatgtgtatgaagtttcttatctggtaaaatacagggtgtgaagttggataatggttaatgactaatttaaagggattcaatgtcaagtagggtgaggtatatagcacgtaccttaagggtatatattgctttgctctatcaaaaatttatcctctttaatataattttagtataaatataaaaatttaaaattatttatttttagtataaatatatgctttaaaaatatttgttttattataacaatatgtttcagtttttatttttaatttaatttattttttattttattttttttaattttttaattttttttaacggatgcttcttataaatatacttgtaagtatatgcatacacatgtataaacatatagacatatatatttaaaataaaaagacattacaaatatatttaaaaatataataatataagaatttgtaaattgaacttaaacctaaaattcgtgaagagtatggattattatactcaatggcagagccactttataaccagcaatgatcatgacactagctaatttttaattttttttaataattatatatacttatataattaattaagattaaaaataaaatttaacactatctaaatttttggagtagtgcaagtgaaatggtgtggtgtatctctctattagagatggcagtttatttttttttcaatttgaattgaagcaggatgtgacggagaacgtactgaattaaagcagtctctccttagtctcctacttttcagttttttgttttcctccctccactccatgagaccacgaccactccactctcttttctccctccagtcccagtctccctccactccactctcctctctggctccctcacctcacgaagtcacggtcagtcggtcacggcctcccttccagcagccagtatcaagctcctctttcactcagattgttgcgtcggtctccctccattctcctccctcacctcacggtcattggttacaccgtcacggcctctccctcccagcatcaagctctcagatcgccgatctacctcatctcacggtcacgggttagtggtcacggtcatgtggttgagttgtttgttcatattatttttgctccttttctttttgccttttgattttctttgagaaaactgaaaagagagaacgagtagtgagcaataagagaggtgagaatgttgatagacttgttgggttgtatgcagaaatgttaaatcctttgtttgttgtgtgcaataagagaggtgagaatggtcaatgttgaaatgttgaatcctctgtttgtgtgaatgtcgagaactttgacactcacctgcaaagtgcattggcaaaacaattagtaattaatttgttgtaacactaaattattagttaattaaatgaaacaaagagaaaatgtcataattttattgtgggggaatgagattattgatggattggaactatatgaagctagactaaaacagagagaaactcatttgattacttgcttatttaatggttgttattctgtggactatgaagatcctagttttgacatgtaggttgaaaaagtataggcaaggataaatagaaaagtatagatgtgttctttaaaaagaaagtagtctctgaacgtgaatcaagtgatgctctttcaaacataatttctgaaagtgatgcaccttctcatgagcaaactccttcaaagtgtcatagaattaaacatactgatgacattattacagttaaaaataaattttttgaacgtgatccaagcaaacataagccaatttgggagtattcagctaatgaagtcaatgtgatacggagagcttatttaatagttaggccatatcaacctcaatgcacctatcctttttcaaaggaaaagcatccttgacgttttcaagcttcttggtttaaagaattttattattaacttgagtattcaccttctatagatgttgtgttttgtttaccatgctatcttttcactacaaaggtcggtgggcaacatggttgggatgcattcgccatcaaaggttttaatggttggaatagagttcatactggaaagtattgtgcttttctaagtcacatgggagatgattcttgttcacaacatactaatgcactcatctcatgtgtagacttaatgaatcagtcttgtcatattgataaatttatgcatgctcaaaacttccaacaaattgaaagcaataggttgcatgttaagacttcaattgatgttgttcgttggcttgcttttcaaggatgtgcttttagaagacatgatgagactattaatgcaagaaatagtgacaattttattgaaatgatcaaacttttggcatctttcaatgaaaaagttgttaatgttgttctacagaatgctccattgacagccaagtatacctcacctcaaatacaaaaggagattttatatgtcctagcaaacaaagtacgaaaacagattcgcaaagatattggggactttaagttttgtattattgtggataaagcatatgatgaatccaaaagggaaaatatggctcttgtcttgagatttgttgacaaagatggtttcattaaagagagactttttgaactttatcatgttcaagatacgtcatctatgacacttaaaaatgctattagtgaaatactctcacatcattgccttaatatccagaacatccgtggccaacgatatgatggtgctagtaacatgcgtggtgaattgaatggattgcaggcattatttcttaatgaatgtccttgtgcttattatgtgcattgttttgctcaacgattacaattagccttgatttctgcctccaaggaagttgcttctatttatgaattctttcagcatttgaatttcatcattaatattatcattgcttcttttaagtgtcatgatcaattccatgctgcccaaatttctgaatttgaacatttgcaggctattggtgagcttgaaattgtccaggttctaatcaaataggtacactaaagagggctagtgatactagatggagttctcattattattccatgtgcaatcttcaacgagggtataatgaatcgtgttcagtacttgaaaaaatttgtagtgaaggctcaaattacacccaaagaggagaagctactgctacttataagatgatcacttcttttgagtttatctttaatttaatttgatgaaagaactcataggcatcaatgaaattctttgtcaagcattacagcgaaaatctcaagacattttgaatgttgtaccactagtttcaagtacaaaggaacttattcaagaattacgagaagatggttggaaaataatacttgaacatgttgttaatttctctaagcttcataaaataaatgttccagatcttgatgctcaatatattaaaggttgtgatcatcgacaacatgatcaaataactattgagcatcactatcattttgatatctttaattcaaccattgactttcaattacaagagttggatagaaggtttaatgagcaaacaatggaacttttatcactcagctcttcattagatccgaagaatggttacaaagcatttaatgttgatgatatttgtagccttgcagagaaatattatcctcttgatttttctaagcaagagagaattaatttgaattgtcaattgaaacatttccacaaggatatcccaaaacatccaaaacttcaaaatttatcttcaatttctaatttgtgtgggaggaaagtaaaactcatatgtttgaaatgcttaccggaaaggttagtgtccttttatatgtttgctttgatatataatcattgacaattgttcatttaaatttttaatgttatgtaaacttgtgtaattataataaatatttcgataatttgatatgtcaaattttttggcatgggctaaaattatttcctggcttcgccactgattatactagttaaaacaaataacaacattagaaggaaatttagtagactaggcactagcaaagcctgaattgatctaagtaccatcacgctgaccctgacccttgataaagtagctacgagagttaacattcacccactgttttttggtgagtagtttttcttcgcccattttgaaaatgcacatatggcctctactacgactaatatggcaaagaataacaacacagaagcactcacaagtccaaatgtgctttgcactcttcttttgcttttccaggtctatcaccttctgaatctcatccaggacggcacagtccaaagctctttcggttatgataaaagcgtatcccaaaaattgtcaaaccctaagttggaaaccacatgaatgaatttccacaatggtcgtggtcttccatttggactactgggagttgttgtgtgtcatttaattgcctttgcctgccaattcaaaaataatttgttagtaacaaaacaaacttttaaaagaagaaaaggagatgataggtagtaagagcaatcattgcaataacaaaacaaatcctaaaactagaaatgaaaagaaaatgagagagtaggttagaggaacgattgtctaaccatagaaatcttggatatacattattgtgacattaagaataaaatgtgtgtacgtatagagagaggaaaaggtgatactcgtcaccccctcactcaaagaaaatggtaaaatatgttaaaatttgtgtatttcttattcttattttaattattttcctaattgtatacatgaacatggtacatgtgtgattaatatttcctttactttatatctctatgaatttaaatgtagtatttcttacaagaactaactaacactaggttatggtgattagtatatcctttactttatatttctgaatttttcaaaatacatttactatttttttaatatcacaataagatttataatcttttattatttctataataattgaaattgatttactatacatttatcattaagtttaaatataaataatatttcaaaataatagaaaatacctctcctattaaaaaattagaggtgcatcacattagataaattttaacacaaataaatgtaataattagtataaattaatgctaccgaggataaaaactagaatgaaaaaatttatccaattatatttttttggacaaattttagcatgctagattttatcaataaatgattcttaattacttctgccataaaaatggaaaaaaaaaatgagaggtcaaaatatttactagtccaattaaggttatatacaacaataggagttaaaaagttagtgagtaacgaaaagttattaaattaacttattaaattataaatgtttggtaaaattagactaaaatatatttttcattctcataaatttgaaaatatttggatttcgtccttgcaaaagttttaatacttttttgtcctcaaaaaattaaaatacacaacttttgtgcctcgagctaggcttggctgattctcatacctatatatcactccttcgttggcccatcgtcggttgctctcttcttatgatttcaggagtttaatacccccaacaaattccaaaagaaaaaatgccacaaaaccgaaacatacaaaaagagaaccgaacaaaacaacaaaaaggaaaaagaagaatacaaagaaagaaacaaagagaaatagtgctcatttacatggaccgatcaaagggatacaatgacgcaccatttcctcacaagaaaatattgtagacattggcaccccttgaaaatttccaagatgtttcaaattgtatagatgaaaaagccttcgctaacaaactcatatatggattgcatcataggagtgtgcgtttgtgaacgacgatcgtcgtcacattaatagtataaggaatatttgtcgtcattttttgcacttcattgcttgtcaacgacaaactccatttgtgattctaatgaagataaagatattcaagattcaagaacgaagatcttaatgctcaaatacagatgcggatacacatacaagagtttggggacaatttcccccacaagatatatttatttatttgtatgtgtaataaataaataaataaaattgcccccataagatagttttctttatatgaaggtaaaaaaaatataagaaacaaaagatgatataatttcactactttatttttttaacttttgataataaggatgatgaaaaaatcatagaatatttttaaagtatgaaaatgcatagatgacttgtagaaacttcaatttagattttttttgttatgacattatgcattttataaaagtttgtgatatttattttttgctaaaacattataaactattgagttaattatgttgtcgatccatgtactttttataaaattcacttatagtcattaaacaattttttaacattttttgtccctataattttcttctattaatagttttagttcatgctggtgagtgacaacgttaattgattacacagacaaccatgctaattgtcaagtaaccaatcatattcggggtccaataacttgtcacgtcaacaagcagtatgatgttggcaaccatgtgtaatttttagcaaattgtatttttaatatttcatctatttagattaaaaatataatttaccaaaaaaagttacacgtgattgtcccaccaaactccgtgatgatgtgacaagtcattgagatactaatgtgaacttgatagtaaggactaaaataattaacaaaaagaaaaaaaaatatatggaccaaaaatactaaaattttgtgtttaggagctaacagtgaaatttgcaaaaattttaagggccaaaaacataattaagtccattttttcttgtcctcactaagaaaaatttatggatccgccactactcaagtaccctcgctttaagatcccttatctacatctcaaacaatctccattcactatgttgtaggttgttcgttacaaagccgccatccatggcacaatacgaggttcaacaacattctccacgaagtcagcaatgtagttgttcttgttggccatggtgaaaccatgacaacgacggtgctactatgctcaagtaattgtagtcattaatttggatttaataatttgagatctagctgccagcaagattccaattttagattaagattccaattttagattaaaaagtttggggtttatcgttgacaagcaatgagtgggctaaaatgattgtggtttaatggttgtggttttgatttgtagttttaggattgtggcttgaagaaggtaaaagaagagggttcaaaaatttgtagtggattcttaatattttgtgatagtttttaatccccaaaaattatatttaaaaacttaaatgataaattgtaggtttgaatttacgaacctacattcagatcaaaatatcacaaatttcaatgaaatttgtgtgcctacaaaaaagtactaaaaactttgtaatgacaaaattttaatattttcaattatatgatgacgaaatgtaaacgacattaatgccacattcataaaatatttttatataaatttcaattttattttatggataaaaatatattttgagatgttgtaattttagatttttaattaattttaaacctcttgtaatttcatttatagatactttatttttattatatttttagtttcaattattttagtttttttcatattatgtattctattatttatatatactatatctttaaatatttttaattaagtttaaaataaagtaataaacttacatttaggtagacattataattttattatgttaattagcataatagttaaaataaatagtctaacataaaataaagatatggactcaaagttaggcttgtggctcttggattcactcaaaccttaggtatcgactacttagacactttttctccaattgctaaggtcaacacgattcgactacttttcaccattactgcagcaaatcaatggtccttgcaacaacttgacatttataatgcattccttcatggaaatgtaaaggaagatgtgtatatggaacttccctcgggcatcacttttattcaaccaaactaagtttgcaagcttaagaaaacaccatatgccgtatggtttgaaacaatcaagcaggtaattgtttcctcaacttttttcttcttcaataaacaaatgattcactcaatcttcctttgatcactcattattttttaaaattcataaccactctcttagtgcattacttgtttacgtggatgatttgatccttgtaggaaacaaccaacaggaaattaatgacactgagcaatttcttaacaaacaattcagaaatttgtgacctcgacaatcttaaatactttcttggatttgagattactcgatttcatcaaggaatccacatttatcaaatcaaatatgcattggaaatactttctaacataggtcttcagactcccaaatctaccaacactcttatgaagaaaaacaccaagcttcacaaagataatgacaagctcctggatgagcctacaaatgtcttataggtagactcttatatcttaccaacactagacctgatctttgttattaaatataacagttgggccaattcaaaagtttttcaagcatctctcatcatcaagttgtaatcaaggtactattagagattttttgtgtggtcaagtgaaaccaagttatgaggtagtgtttagaacttgcgtccaagtcgtctcccaaaggattagtggtaatttaaaaaattccaatcaaaagattaaagttttgaaaagtattttctcaatgatttgtgtttgaataataaaagaacaacgtgagaataaaaacaagtaataaaaaatagaataaaggaagaaacaattgcaatgttgttgtgagaaggatggtttgaacacccaagattgaacttggtttccccctttttcaatgtaacatcatcaattaatctagttattcatctaatttatctccaattcacagatgtattctaaacttaatgtcttatgcggaaaattctaagtcctttagattaatttcgaatatgttggaaaattaatctaaatgaccaacattaatgtttaaaaattttaaagagccaaattcttattgacttatgtctagaatcaatccccattatgtactcttcttatttcaagaatcaaacaagtgtttgtcgactaaactattgattcctatgctcaagcaataggtgattagtctaaaacaaacgttaagggaaaaagaagaagaagaagaatgcaactatataattgtattaacagaggagtataacatgaaattatgttcagtcattttcaacccgacagatgaggagattagctggtcatagcttgattacaaatcccataatcaaacatacaaaagagtaatgaaatcaagataaaatccctaggaatggtgctttctttcacacaaaattgatgtctcaaacgtgagaggatgtcatcttccttcacacaccaagtttttataatttgatataggcttggatctgacgtgttttcctcgcttaagcatgagtaatgcctcgcttaagtgaggcctgctgatcttaaaaggtttgactactgactctcctagctaaagtgcatagaatattgtgcttaagtgatggattcaagtttctcctttggcttgactgcctcgactaagcgccttgaggcttatgcttaggtaaggccctccaatggccctagagtttcttactgacttagctcacttaagcgcatagcatgccattcttaagtgagcttgacttcatcatcttcttctaagttcttcttgctcatgcgtcgtccaagaaggttcgcttgaatcagtcatattagtagcttctccgattacttttgtcttggctcagttaagaacaacaacaagccacacttaagtgagaataacttcatttgtaattttgacccaatttcctccaaaaactcacaaaaacataaagaaaattctaacaaattataactctagatatcctaagtgtgaattcctaatttatcctaatttgagtaaatacaagttcaatgtataaaaaatgctagataattgtgtcgattcatgtgtgaaattaagataaaattgacaattatcaggtacctcgctacatcaaaaccacccatgtccctggtctcttctaatttgttgattcttaacttcaacttaaagccttctcggattcaaacttgcaagtagacactagaaaatccataatcggatattgtatttttttggtgaatctttctcttatcgttccaaaaagcaatctaccgtctcacggtcctccactaaagttgaatactgcacaccagcttccaccacttgtgaaattcaatggctcacttacattctcagagaactacaacttcctttcatttcactagctctcctttattatgacaacaagtcacctacctacactgtaaccaacctaaccttccatgagcgcactaaacacattgacattgattgtcacattgtttgcgagaagctttaaacgaaactcttccaccttatccacaatatctaccatagatcgtcttgcaaatatctccaccaagccccttgatttcaaacctttttcacaatctgttgtctaagctaaaagtgtcaactatccactcttcaacttttgggggtaaaggaataatcacagaaagttagtgtagtgggacaatttgcgagaaaataattatttttatttttctgttttttgttaggataattttgttaggaatcttatcccttagtttcacctttccttttcctttgggctctatacctatatattgagacccttacttgtatcatttcatatttcaatctcaatttaataacaattcaattttatctctctcgagctctgataataacaagctacaaatgttagatccttatatgatatatgtttattcattgttaataacaatgccgagtctattaataatgacaataccactttaaatttgaatacccgattaagtcagagtcaaatccaaacaaatagaagagtggttaatatcacaagtaacatgcgtgttaatctcatgactaaatttgtgaacacaagaatgtggatactggagttgctgacaatattcataatgagcaaagacatccaactgccaatgaaaatatttccaactgtggaatgatacatcatttgaaagaaatcacacatctaattagacaaagtcaacttgtaacaccatgagtgtctacaattcatgataacaattacgaagatgaccttaaaggcaaaatttattatggtgatgcaaatactaatttaatttcttatcaagaaatttaaataatgcaaatcttatagtactaatcattaaaatgttatgtttcacaacaaatgatgattcaaattcttattaagataatttatactcattttggtatcaaatataagaaaaaaaaacatgtcatactaactaagaaagttagttaaccacttttaattgcattaatttcaattaatatcattttttcaacttatccttcattggaacttagtatgaaagataagaaagagtcattgaaactaacacctcaattaaatgaagtgtattatagagatagtaacattaaataaggttaagttagttgagttttttttatatatatttgagaccagtgaaactaaccattctaatcatataaaaaatgatgatacatgtgctttatttaaacttatcaatgatataacccccaattaatcatgtatgcttatagaatgcttcaaatttcataggatacattgatattgaagatcttacctatctttgtcaatattgtggagcttatatgtgatatgaagaaagaatgagaaaaaatacaaacacttcaaatttaaaaaaatttctttgttgtggtgttgaaaagattcaactacaacttctacaagcaaccaccaaatcctcttcaacatcttctaattgataaagattcaagtgataacaagaatttccaaaagcatatcagttcttataatatgatgtttgtgttaaatcatcgagagaaaaatcgaacaaatcattcaataatggcagatgaccaccttctcttagaatctaaggccaatcatatcacctgattggtaatttgttgcctatgctagggcaaactccaaagtttgatcaactttatctttatgatacaaaaaatgaaatccaaaacagaatggggggagggggcaaacctaattgatttttatgcctatttgtttacttatattttattacaattctttacttacattcaattcatgttcttaatactccaaatattatcttctaggttttaacttctctaattttatctacagttctaaaagttatattgatccagaaattttcaccaaattgaagatgatgcttgatgaacacaatgtatttgctcaatcttatagagtggctaatgagagatttgaaacactacaacacaaaatatgaaattaaaacttatttataatagaatcattgatgataggatttataatttgcccactgtttttggagttgttgctcttataattggtgatacaagcattggttagcccaaatctgatttactcaaattacacaaagatccctccattaaaacctattttttggcaaccctccaataaagatgttaagtcacatttagttataaaagttaaaactcaaaattacccctcatctccacaatcacatacacattccctgtgttttatacatattacacatgcaccccttgtgttttttaaacattaagcacaatacccctgtgtcgtttcagatttggattatcaatttagagatccacaagtccacgatctaagttttatactggtttgcaccgattggagtttggtcgcgcctcaaatatctttaatgatgttttcatgtttggggtttaagagcctagacgattaggatcatcttgcgtcagaggtccctaatttgagttgtaggggatcgacacacatcgatttgagtttatgctttggtctttaaacacattttataaacctcaattggttggagctttggcttttaggaacttcaattggatagatagtgaggaaatgaagaaaatagagatggaaggggagtgttggcgattggcggcgtggttggggaaggttacagaaaggaagaaaaattagaagaagagaatgattagggaagaagatgggtctctttgactcgaaataaaagtttgaaaaagtttcaaggtttgagcttatatctgttggtgatatatgaaaactcatggtgccaagtctgtattgttagaaacaatggcagtgtaaattgacaagttatatcttaaatgaccatggagtatcatgcataatgtttgaaaaatatgagagggaatgcatatgtaattgtggagatgatgatgatgatttgaggaaaaaattacttacaaatcatgtgctaatcacgtgatcaaacgaacttaatattgtttaaagcataaaaagtgacaatgtggaaatgcaaaagttatatgatttttgtgttgaaaaaaagagaattcttgtgaaatccataccttataaattggagaacctttggaaggacatatgtcacattttgagcaaagagaagttacttttctctttcttcctatgtaattctctcttatattttctcctcctttttgttctcttgtgtttctgtttacattctttctttcttctttctttttatgtttttacttctttgtatttatccttaaatttatccgtgattgttttttattatatattattttgaatatattatgtatatacatgacaaaaagcattacacaaagcttcatttcttaataaataagataaaaaactcctctcattttattggttaaaaaacattacaaattctattctaattcattaattttgcagtaaattttcatatttattattttttattatatttttagtaatatgagatatatagtgataattatgaaagaaataaatattaaattcaaaaaatttagtcatttaagaacaaaaatatttttatcttcattaaatgagaagtaaaatttgttaaaattaataatttttaacaaatttcaaccaatcatagtattagaaaaaagtgtcatagaactatttttttatatttgtaaaattatggtttagtattggatattatttatatattatattataataacgatatattaaaaatgccattttaaactaattaatactatttagcttttggattataatacataaactaattatttaatcttaaaaaatatgtcttttccaaatatggataatagtgtaataatagattattttaattacatagatactctctcacctacaagcatatgatttaagtagtattagatttgattcttttaagcaaaatcatcaaatcgaaaatcatcaaatctttcgagaaagattcatcactaataaaattgttgaataatctatatcaatatcacagtaattcaaaaataatatatgcattctctattataagtaaaattatttacattgaaatccaattgtatttttttttgtaacatgtattttatcttaaaatttacttatcttttgttttttttaatcctaacactatctatttttttatattaacattattcaattttttttatatataggataattatattaagctaaagcaatatatcaaaacatttataataataccccttttaaattatatacacagataatttcaaaatatgtataaattttaaagtgatcccatgcaatataacacgggtatcacagtagttctagtaaaatactaaaagtactggtgtaatttattactcttaaaataaaaaagtgtcagacttctgatatgagtataacggtgaaatcccttgtgttgtgaattctttttgtgttgtgggcttatcccagtatcgtagcccttaccataccctaatttttctttcttcaaatcgcgcgcgctcctcacttcgagtcttcgactttcctcctccgaccatctcgccggaatttcccgcggcggcgctccttgtcgccgcagcttctctctctactgaaaccctagagagagaaaattcaaaaaccatttctctactctgaaatttataatccctgaaattcaaaaaccctaattcccctgtcaagctcgtagcacagtcacagccatgtatggcggtggtgagtaccaaaaccatttccccttctcattctctttcttttgcttctgaaatgtgaactcaattttctccctttggttgaatccacagatgaagtatcagctatagtaattgacttgggttcacacacttgtaaagctggttatgctggtgaagatgctcccaaggctgtgtttccctctgtaagagtttcctctactctttttacttttctaaagttttggatttgttgttgtgtttactgttttgctgatatcattttttggcctatagagtaagaaatgttgttatgctctcagttaatagtgaagaggacactgacatttttctgtggtgataggctagttagtactgcttgatagtgaacttatgtatttttataatttatagttgactagaataatttctggaaattgtatgggtagtttgattgttgattgtcttggcttgtgcaaacctaggttgtgggagccattgatcaaatggatgttgatgaagcagataatggcgaaaacaactctgcctctgctccggaatcaaataataataatgttagacatgctgattctgacaagaccaagggaaagaggaaattgtatgtaggatcccagtccttggggtaccgtagagaccatatggaggtaacccttatgtaatggtttttgtgattggacttggattagtaatttacagatttttttgttccttaaaataatgagtagtgtagttattttcttcttctgtactgttaggtgctgtctccttttaaagacggaattgttgctgactgggatattgttgacagcatatgggatcacgccttcaggtcaatactgactttccaatctgtctatgatatgtattgtaggattattgttttcctttttgcacttgtttattgttagactattgatatgatagagcaattagttgcaagttgttacaatttaaattcaagttatagataatttagtagataattttgagattgttattcctctatactctatatatatttcttgtacactcacaattagatatggataagatcctaattattccattctttcaatatggtatcatagagccaggagcttaacagccaaattgatcctttttcttttctcttctttatttttttgtttcttcttggtcatctatcattgcttccaatctatccattaaatgtagcctctgccaattacctaatggctcatctccttgaagccaaaacttcttggtggctatatgacaaggatcacatcatgtccttcatccgaaatcattcatgatggttaagccgtcttgcttcttcctttttaggtgattaaaccatttttcttctgcctttcaggtggttaagatttttttttgtttctgccttataggtgattaagcagttttttgcttctacctttttaggtggttaaaccattttgcttctgcctttcaggtggttaagttatttttttgcttctatcttataggtgattaagcagttttttgctttttcctttttaggtggttaagcctttttcttgtttctgtatttttaggtagttaagcctttttcttgtttctgtctttttaggtggttaagcctttttgcttctgtcttatggtggtttagcgtgtttgcttctttaataggttaagccttgtgttatgacttctgcttaatggttaagtttgcatttattggctttgatcaacgtgtggactttctccccaaatatcttacatttttgcgtcacaaatttatgatgaacaagattggcgttgtctttgccaccaccatcttgcaggagcatgtcagactattaatatgatagagcaattagttgcaagttattacaatttaaattcaagttatagataatttagtagataattttgagtttgttattcctctgtactctctatatatctcttctatactcacaattagatatgaataaaatcctaattattccattctttcaatatttattttatggcatatatggctagcatttgataaagctcacgcgattccttttttttttttaattaaaatcccttgatgactgatgattcttcttaaaagcaatggtccaaagaatagttgacctgttacctgtatctaaagcacagaaatacatgagaaattctggtagtaatggtgtctaattaatgatttatagtaatcagtaatgaagatttttttccaaacatcaatgcctcaatggtccataccataaatatttatcaatttttttatagtaatgaactttcttttcttttacattggctgttcagggccttgctcaaccctttacaagtttcaagtaagaattaggaacattgcacgaacacagggatagttagcaagtgttgagtagcaatattttggaggtgaaaattggggatcaaatcatagttgctccaaccacaattgcacattttagggttttttttttttctttttatcttacaaaataatgggggagattgagggggatgaaagcatatgaatcaaactaagtgaactaacatatagataattaaggtcacaatcgagcctaaaagaaaattctaccagatagctataagatcagtgatgctttgtatggtagtgattgctggacatcaaagtgcagaagagatttgataagtacagcagagatgataagttgaggtggatgagtggatatgcaaagaaaggaaagataagatcaagaacaaagatatacaggaaagagttggagtagcaccactgaggagaagataacagaaactcacttagaaatgtttggtcatgtgagaagatcaacaaaggctccagcaagaaaattataatgcaacgaaaagggtagaggaaccattaaaaagacctcacacaaaatggatttgcagaaaactgttattgataatttgatatagctctctatattttttgatccatgttactaaccctacctagtggaataagtgcatttttggaaggaattaattttgaagatcataatctgattgatagaacaaaagctgtttgtgttgctaaggctttatgttgttgttggtcgttcttttcctattctggttttaaccatttttccattgtatttttttatgttttttgtttcatataccttaggaattgttttatttgtcacggggctcacattctttttttggtagggaatggctattgattgggtgtgctttctttttttttttttggtagggaatgcctattgattgatcctaaagagcatcctatgcttcttgcagagccttcttctaactctcaacaacagagagaaaggtattttggttatgatttattgtctagaattaatagagctcagtttaaagcatcatatgtatgattcggttttttaaattttgcaggacagcggagcttatgtttgagaagtacaaagcacctgcgttgtttttggcaaagaatgctgttagtccttcactgacctacacctttaaaaataatatgtcatggagtgaggatgaaaaactactgatgggttctgacttgtcttgacatacaggttctgacttcttttgcatcagggcgtgctacgtcattagttgttgatgggtaagagatcatgatgttactgagtggtagttttgttcttattctgcggtagtatcaatatgaacaaataacactgatctttctcttcatttctgtataggtgtatatcaattgcttaccttttaagatattatatatggaagacctatgtcgtagttgtcttgtttaattataccttacatgtcttactttttccaattatagtaggagaatgataggaatttggaattagagaacaaataatggaaatcaagctcctaacaagcagaggtagctctctgttgagacttgagactaaaatcaaagaaagaaaatactggggaattatgcagactcagagaatatccactcctcctaaaacctctcgacctttaaattcttgcctatttctttaaaattcttccctctcactttatccttacatccaaccctctttttacacactcaatgccatgcaatgcaatcagtctcagtcagggttgttacattccaaatttctctttagcccctgctcccttatactgtcctcaatgtagtagtcatatactcgtataaagcctcatagagggcattagactttgctttagtagcaggataagggaagttttatttatttaactgcaaccaatggatcaaaagagttgcaaatggcacataataaaattatacttttttatttcagttctggaatagaaagtcttaccattatatcagttaacacttaacagcgagaaataaaatatcaggaggctttttacttattatgaaacattgttaaataaatgagtaaactgtgtaccttaagttgggggataacaatatgaaagtttctttattatatatatgttaacatgtctaaagattgttgttttcctgcttgaccattttaaactgggtttggtaatacacaattagacattggcaatgttccattccaaaaagtggaatgggtaaagcagcattttgaatacatcggaggaggctgatatggatgaaatttgaattcctactatttgagtcaaacacagtggattgggtatttgggtggacctttaagcatatgagattaagaattcaattgaaaaactgaaaaggggagagagaaatagataacttttaaagttcaatatttgttatttcttctaatatgtcccgataacatgccagaagcattgctgataagatgttttcttcattattccattgttttcagtggtgggggatcaattacagttgcaccagtacatgatggctatgttcttcaaaaggtacatgatccatattttgattgattgtttgccaatttattatatttgactttaatgctgttttaggaacctgcattgatccaatttcttgtatgcaccactctgattatggataaatttgaaacgatgagattgtttgattaacaatgggaaatatatacattagatgtatgaacgaaaatcttgacaaataacctggtagtagagttgtcttctgattatgtaattgctattttgtctattagtaatttttggttgtgtagccaactgcaaaaagcaattatattggccatcatctctctattattactcaattgttagattgtgttttacaaaaatacaactaataattcaaaattgtacgagagtggctatgtgtatgtgaggcactattgcttgccttggtatttactaactaatatttcttcatctatgctctgcatattcgtaatatcttccattctgttttctatgtagtatgtatgtgcatgccgcatacacacatacacatatcattaatttaagacctcattgtactcagcatttatatttgagttttggctgatactatgggtctttctgtctgctcatattttcttctatgtttacaacataaggctgtggctacctctccaattggaggagaatttcttacagactgcttgatgaaaagcttagaaagcaagggtattacggtgggtgacaaacattagtcattatttttatcagtgatcttctaaaataaaggtactgtgattttatctgcctgagatttccccccttttaattgccacagataaaaccacggtattcctttaggagaaaggaaatacgtcctggagagtttcaggtataatttgttttcattttaatgacctgtgagtagcattttttaattccattatcttgcaatcattgaagtgtgaggcaccagacttgttttttttactgttgttttcattaaactttgaacatgggcaggacgaggttccatcccatgtgtattatatgtactgtatgtgcctccaggatttctggatggtttcagtacttcatttttctcatctcttttaattgagtgttcttcttgaatcgttttcagtcatggataaaattcgataaaaattgcatgtgacagtatactgttgctagtgacatgaactgaataatttacctcttgtttgatctactagaataggaatggcagcgggacccaaacccgtgggtacccgcccgaatccattctgattttaacgaggaaaaatcgagtttattgggttcgggttttccccgatagcaaaaagtgggggcggtggcgggtatggaattactgatacccgtcccgcccccgcccgtaataaataatattaaaaaaattaaaaaaatatattattttctaatttttttaattgaattgattgattttgttttgtaatttttaaattatgatcccatattttaaatgtgggtttgttattattttttttgttatgtaattagtttttttgtctcatttttcaataaaaaaactatattatttttttttattttaatcaaatagcaggggcggggcgggaaaaacccaactcccagcgggggcggggatggggatgggttttaaaacccgactgggatcgggggcggggactgggagcggtttttgagtcgggggtggggaatgcgatacccgcccccgccccgccccattgccatgcctatactagaattaggttagctactaaatgtttgtgcaagttagcaaattaattttaaactcaagatatcaaacagagaatggtgttatcctgttaggtatataattaaggatcagaacaaagaagatggagtgaggtgtagttatcttactttgtttatttcaattacatatataaccttgcatctgttgttacttgtagaattttggtgggaaatgatagtgagcaaaattgcccagtgtttctctttattagtagctctaaaatttagtttcgtgcatgtatcattttatataattttggttgtaagttgttactgcaattctatgcttaaataattattatttctcattatcattttttttctgaatcttacagacagtagatcttgagtttccaaatacaactgaaagctacaaactctattcccaggtttgtgaatgaccatgtaatatctcattacttgttgcttttcatttatctgatgaccgttcttcatgacagagggtgattgctagtgatatcaaggaatgtgtgtgtcgtgctccagatactccatatgatggtttgtttacctcctattgtcatctcgcgtaatgttttgaatcttactggtcctgtacttttgttcaaatcttattggtcctgtgtttcattttgttctttcgaaggcatgtgaaaaatctcctagtttttatggtgacaacttttatttcttttgagctcctttctctctgtatacatcttagataactatatatttgatgcctcttgtgatgttattttctaaaccaatctctgctttcactcaggtcatatatgatttttttttcaatcatctggtttagtgataaacttgtacaagtcttcagttagctctttatagctctatagaagatggctttacctttttggttcctatagcattgcagtttctgtacattaaatctatttttttcccctttttctgacagagagtgcatattctaacatcccaatgacctcatatgagcttcctgatggccagtaagttgatgttattcttgttctttgaaattgggtggaggatggaatgaataatgtttcatcttcaaaatatattttttcatttcatatgctactatatgtacctcatagactaattgttgcttctggtttttctgtaatttattgtctgttgttgtcttgttatgtgtttgtttttattatgcaggacaattgaaattggagctgacagatttaagattccagatgttcttttcaatccgtccctggttcaggtgtgcagcttgcattcaaagatgtgattagtttttcttgttccttcaatgtaaaagattataatttataatattgcatgatattaaaaatatgcgaaagcttcttgcaaggtattaaaagtaaaaatgtacccttaatgcactaaggactcctagtgccttgaggtgaggtgccaaaagacatgcctcactgaagattggttttaataattggaagacagtaaaacaaaattcttgctataccacaatgacatccgtgttccacccgtttatactataaacgaagaaaaaacaatacaaattttatcacgggaagatattttttgttaaaaaatgataaattttagttatgttaattgttaattataaaactgttaaaaagcacagcttgtgacatgaacaaaaacgaatataggctataaatatatagaataaaaactaaattattgaagtgtttccagttaaattttctgggtggtggttgtttttgtgtgcaatatgactggtccactttttgttgtgcttctattttgttctgcagttctttaaattacttgagagtcaatattcctgttcttttgttctatgtgctaattttcttatttgtgtcaaatgataattacagtcaattcctggcatggagagctttgcagaaattgctccttcagttcgtggcctgcctcaaatggtaatttaacttgatgtgaatctgttttaagtatctaacttgctattgctgattgttttatcattttgcaggtgattgaaagcataaataagtgtgatgtagacattcgaagagagttgtttagtagtatactggtaaagttgatttatctttcccttctttctacacaatcattcaagtagttcttatgtagagcttaatttagtttaccgcagacatttttggtgtaaaaagggaaaagattcaggggcatcctttatatggagaatttttacagttatttttgagattgggttgcatgcgtgggggcgttagtgttgctgaagttgtaatttcatgatgttaacttaatattttcatcttggttggaattctatttgagttgtatttaaggcaaatgatcttttccctagaactttgaccaacatatatttgctgaaaccatatgctgtacatttattacatatagtttataatcaattgataggttttgaagtatttcatatcaatatatcatttcctggtaaattaaaattgatttcatttatcgcatgcagcttgctggtggcacagcttcaatgcaacagcttaaggaacgccttgagaaagacttgctagaggtacattttaacaaatgagtccttgtctatttcatccactgaatggcaatatggttgttggtgctgagttcaaatacctttgaagcttatgttgttttaacatgtgatttcaaggggtagctttcatttttctttcaagtgaatttagtcgatgtctcatcccaaatatcagtagtttggacaatttttactttgttgactgcgccataatacagccttgtggggaacttgtttcttatctcacgtgcagcagtgctacagagttttcttaaatcctgtgactccgaattttcactatctaattttggagggatgggggtttgggagattgagtgtaagaatttacagcaaggacttgtgcatataacaacagcaagaatttttgaaattgtgcatgtgcatataaattttttaatttgtagccaaaggttttagtcttgtcatttttgtagattagaattaaatatatttggcttctctagaaggcttgtgtagtatttgttgttttttttcttccagcttcttacttccaaatacaattttgaagaaaaatctcttatcgtttcctttgggtgtttcttcggtggaacttgcaatatgcattgaagaaatcttttgtgctaaaatattatatatatatatatatatattattattttttctttagttgcctttgggaagaaattgtgtgtgatattgtaagttattttttttactgaattacattaacaattaaaaaagttatatagttgtaaagtacaatggtccgtctgtaagattgtgctcaaactggactataagcatttagccaatgcttctgcaggctggcacctctgattagagaagataattaattaagttgaaaacatttatcaaaatttctcttaggaatcagatttgagtttataatattataaagacaacacattggttctttttgaattaaatcatcaggtggcatgtgattgcccttgttcttcaagaagctggaagggttaattgtagctgtaaatattgactacaatttcatttccgttgcaggagtcccctcaagctgccagagtaaaagtattagccagcggaaatgctactgaaagaaggtttaggtgtgttatctatcttatgccaatgcatctaatcagaggtttagacgtgtttccttttactgctagatttggaaaacctttctaaagcttccccctcttttgcaaacctctgattatgattccatttctctccaaaacaagagagaccgagattaacattttatgtggtagtaattgttgatgcattgtacatattgtgtcttatagttctaactcaatgaatgactttatatgcagtgtttggattgggggtagtatattggcatcacttggctccttccagcaaatgtggttctccaaatccgagtaattataaactgttcaccaaacttgcgattatactagttcattaatgttgatatatatttcactttgcctatcttgtttctcccttttctcataaaagctacgctgccaaatccctttcattaaggataattttacactgaatcattttaatgcatttctgataggtatgaagagcatggagcttcatatatccaaaggaagtgtccatgagctgctgttggtacttgtacaagtttattttactgccatttatctggaagtactatgaacgctgatgtagtgattgtctactaatggatttttatttcctatttaatggccattcccattagatcccaattctaactaaattattggcctcgaggtgaatcacagccaacctttaactaatcttgtgatgatgtaaaacttgtaaagtgtgcctagagtctgtaacaattgtcccatttatcaaattagatctctcctgtgtacgtctttttcttttcttgggtaaatgtgcatactttgtcatgactttaacttacaaaataagcctctaaacctatctttaaaatttgtagaaatattggaagtgttcctccccaatttgattcattctaaattaataaaggtgttcaaaattgaatcaaatgatttgtagctagataatttcataatttgtgcaagactcgagcaacaaaagaccctctacactacggagatggtattttttagctggaatttgtaatcatttctggcgcatatggccaaagtctgcaggcttgagttgcaatgggcatgtagaccacttttttgggggaaaaattttatacaccagtcaaacaactaatacgtccaaaattttatttaaatgtcaataataccctccgttgtttataacagaagctgaacatctttttttggtttccatgaatgacttgaagctttggttgagtgtattgtgagtggaaggtgttggttttggtcgttttggctggtgctgtttgcctttgtcgctgttgggttggttggagtcgtagacggtggtggtgcagctgttagtgaaggtaagcagattttttagcatatacggattcgataatccatatacaatttacggattaggtaattcgtacgttaatgtagaatgggttgatccgtatgagccatacggattagtcaattcgtacgatataaataaatgaatttaattattaaaaattgatttttattattaataaaataagtaggtaacaatatattgtattttgtaattttgcatgttgaaaataaatgtataacatgtggttgataatgtggttataatgttgttaattattattatgtgtttgtgttgtgacttatgtaagtgtgttgtcatttgtgaagatgaacaatgatgagtggatgtatgatagtataatgtctcaagaaattgatatgaatgaagatatcggagatgaacctagtgcatttgaaaatactgattgtttagtcgattgttctgcaccgttcaatacttgtgaggtatgtatattatttttaaattggttaatgtttataaataagtgatttatggaacttaaacttgattatcgatttgtgtaggtgttcccttctcgtgaggatgtattaaaatgagttagaactgttgcatatgacaatggttttgtagccataataatgaggtcagacatgcatacaggaaagaagggaagaacatcatttgttttaattggttgtgagagaagtgtaaagtatagagcattcaacaaaagcatggtacctacagtgactagcactagaaaatgcaattgtccgtttaaattgcgaaccaaaccagtaccaggaggtgaagggtggatggtgaaattattatgtggcactcataatcatgctttgggaaagtcattatgtgaacacctgtatgctggtcaactaatagaggaagagaaggttgtagtgcatgatatgacacggtcgatggtcaagcctaagaatattctcctaactttgaaagagcataatctcaataattgtacatctttaaagcaactaatgaatgcaagatatacatatcgtacgcgtatcaaagaaggtaatactgaattgcaacacttgatgaagcttcttgaacgtgacatgtatatttattggtatagagtaaaggatgacaatgtcatacgtgacctattttggacacatccagatgcagtgaagttgagcaatgcatataatgttgttttcctgatagacaacacatacaaaacaaacaggtacagacttccgttagtggacatcgttggtgtcactcctactgggaagacgttctcagctgcatttgctttattagaagctgaacgtgtagacaatgttgtttggacactagaacgttttagaggcatatatttattaaaagtgaatttttctcaaaggtcattgtcactgatagagatttagcattgatgagtgcagttacaactgtgttccctatgtgtactaatttactttgtcggttccacattgaaaagaatgtgaaggcaaaatgtacttttatccgacagagtaacgcatgggactatgtgatggaagcttagggaagtcttgtagattgtgctaatgagaatgaatttggtgattgtattgcaaagtttgacattgcgtgttctccattgccaacttttgttgattaggtcaaaaacacatggctcaatccacacaaagaaaaatttgttacagcgtggaccaaacaagtgatgcatttgggtaacacaacaactaacaggttagcaaatctttaagttttgttaagttattgcttttatattctcaatgtaggggatagtttttgactgtttccattggattgcagggtcgagtttgcacattggacattgaagagactattgcagaatagccttgacgacctctgtagtgtatgggatgcaatgcacaacatgctgaccttgcaacatactgacattagggcatcattggagagaagcacatatgtggtgggtcatgtgtttaaagtaacattgtataaaagactgattggaatggtgtccaggtatgcattaaaccaaatagctgctaagtatgagcgagtccattatgcaggcaagaacaaaagtcgttgtggatgtgttatgagaactacgcatggactgccttgtgcatgtgagctagctaaatatgttgttggatccatacctattgatactgttgatttttttttgcggaggttaagttttgaagatcaaggtatagatgagggtcaggtccacataactgaagagatggaagccatatctaggcgttttaataaccttgatttttgtgggaaggtcactctaaagacaaaacttagagaaattgcatatcctgacaaaaactcaatgtgtcctccgcctaaaaaagtaaaaacaaaaggtgctcaaaagagacaagtttcgcaccacgcgagatcaaccaagcgggatccatcttactgggagtatgtggatgaattacattctgtgcggaatagttgttccacacaaaaacatcctgctacatcttcggatgatgacagacatacaaagaccaagctgccaatgttggatcaatttcatacatccatgcatgatttcattgtagacatcattgatgttaaagctgatggtaattgtggatttcgtgttattgcggccttactaggttatggtgaagaatcttggtctttggtccgcaatcatttgcttaaagaacttgcacaatggtctgatgaatatataacattgtttggtggctttgagagatttgatcaattgaaacggtccctacttgttgatggcttgtcaaaggtaactaaagtgttactatgtttgtacttatacattaacgagctattttttgttaatgtcaggtaacaattgataagtggatggatattaccgatctgggatacgtcactaccaaaggctaccaaagtggtatactagcataagagcaataaggcacaactaataaatccatgcaagcatcttgaccactaccaaaacatattgcctttttatatgatatatatacaataagaatgtggtttttgtgcagtccaggtttttctatttaatataatgtataggacacaaatcaaatttccatcgatcccaaaatcactattaacatcattactacaacatctaattatttaatctaatttaaataagtttcctagcgactcaaaaatgtacaataaccaataaaagacaattcatttaatcataaattttaaaaaaaaaacaattttaacctcctacggattactcaatccgtatgaggcatacggattgaaaaatccataacaccaatccgtatgccttctacgaattacccaatccgtatagggtatacggattacccaatccgtggactacatacagaatgcgaaagcacgtttatacctcagatggcggccataactcactcacacctccagcaatcaaccaacaaccaccaatgtagactcaaacgactgcaaactgacccaaggctatgacgactggcggcacgcgaaagaaaaaggggaaaaacagtgtatgtggcgacaagcgtaaccaaggcaaatgaatagtgattcacttaattatatgagcaggggcatttacggaaatctactatgcgtttctgggtgtataagccttttgttggtgtataaaatttttcccctttttttgtttttttgtttttgcaaattcttcattttgcatttcaccagcccaacatcatcaagcttttgactcagatgaagttgagacccattttatataagtgtatgctttgactattttgcttgtgacactgtttcccatcttcatcgtaccaaagtcactattttggttggcagtgaaaaatccccacgtggccgaacacctaaagcaacgaacaatccatgaacaatgatctcaaccaaagttgtattctccatgaaaaatacatcatcatcttgattttctactatgaccataatgttatattttttcattgaacaatttggtatgacttaatagtgttagcattttgaattttgcttgagatactgacattgagacttcttatgacctaccttactatgatagtaacaagtgatcttggagggttgagatttagataatttgatcgctttttgagattcatcactacaatttctacttgcgtttccttcacaagtctcacgtgtcccaaaattgtctacaattttatattggataaccatgcattgttccttcctcctgactttttcattcaacagctaccagtgtggtagggaactatatggttgaaggacttgtgattcatcaagccctttgaaaaattttatgttattgatcatgctttgaccatcattatatatacttcagttttaccttttgtctcaccttaaggtgagcttagttttaaggaaacttttgttgaatcatggttttgatttttgtccacaaattgtatgcactggtgtaggtaaatatgtgcttaaacaagttttgatcaatgtattttcaaatcttagttatcgtcttttgatttagaagttgtagtctttattggtctttccctttatcttgttctcttaggtaattgccttatacaagtcataacagtacaaatgatctttccataatcaactttcaataggagtaatttttgacaatattagtttgagtatgtcttcatcctaagtgataatacttttcacatatggaatcacatggatgataactctatcaataagatgaactctgatactacaattaagaaatatcatcacacatttacccttgtgttaaaaaacagcaattagagaaataagaataaaaatagaagaaacatgacaccaaacatttttaacataaaaactctttataatgaccctcaggcctggcgcggctagcgcgagatgccgcgcggatagcgccgggatttctctgtaaaaaaccaagtttgaggtgcggcgcgatcagcgccagacacactggatgttggcgcgagtagcgccatagtggctcgggtagcgccacaggttctggaggttgacgcctgtagcgccagaacggcgctggtggcgccagaaaactctggagacctgtccttccctggaggttggcacgagtagcgccactggtattggaggttggcgcagttggcgccggagtggcgtggttggcgccatgggttctggagcttggggcgatcagcgccagagtggcgcgatcagcgcggcagctcgggcagacccactataaaaaggtcattttacgaaattttggcccaaatcccttgcttcttcttcctccagcgaccgacctccattgcttaggcttccaagcttcatgcaccttcatcctttgacctaaacacctccctttaaacaccaaacttgttggaaaccacattgtaagcttgaatccttcatccttttcccctaaaacccactcaacggagaaacccctttctctagggaccttcgaaaagctcgagttcggcgaggaacggaggcaattcacggacacccaagctaggggaagtggtccttgggtcttccttgtcgtctttgaggtgagagactcgagtttcatcgtttaattttgtgagttggggtttgggataaatagtgacccactggtgctagagctagaattagccttgggtgctttagaaaagtatgtttagatcgttgttgtgatggaggattagctctcaaatgttagtttcatgaaccttggtttttggctctatgatatgcatgtgtggctagtatattgagtcacttgataatgctatgacatgcaagagtcatgattattgctttgatgtgcttgggaggctttagaaacggtgtcttgtgtgagaggaaccgttcaagccatatgtgaattcttgagtttggccagtatagagctgaagctctttgttttggcttgtactgagtcttgtggagactctagtgccgtggctaggtcgagatggacatctgagggtccaggtattgtctagtgattggattaactttgataaccttaagatagaggacttaaggctatatatggaaaggaatgacacttcctttcattgtaaaggttgagaatcgttgttatgtgccttgtgtggttaaattgatgattgattgagcttatatgccttgtatagggcatgacaccgagggtgtcagtggcgtagaccaccgtttagggattgaaccgcagagcacggctttgccaggcaagttcttggttccttggagatgtttcccaccgctgtgtcccaccatactccgagggagtgatggttgcattcatgatgcatgcattaaatggttgttacttgctcataatgatatgtatgcgtgaatctataccttgtatgtatggatacctgtgattagatcttctggccagttaaatagatatggacctccctaggagaagagcgcacctcctagcttggtttgctcttgggtgatgatgatcccagggtgatgatgatcccttaagaccaagagataggtggtccagtcgcggttgaagcctattcttggaggtgccatatacgtgcgtccatgcgtaaggggtagctcctaatgggatggcacgggtgtgagttccggtctcacactgaggtttgatgctgatgatgatgcatcgtgacagcgtagttccgcagtatacattagagctagatgacttggctatgtattgttatgagggccgggaggctagattatttgtgatgccttgatgacgtgtgtcatggaaagtgagccagggtgaaggagatgcctccaagggccctgagcttactaagatgtgtatctcaccccgtgtggggattatttgtttcaggtgactcttctggcagagatgatcggtctcagggcgggaggccccagtagagacagtatctgcacgactgtgtgtcagcttgaggagagcttggtagctcagttttgctgatgatgctttgtactcctgtagagggaagatgtgtgtgtgtgtgcacatgctatgttttgtgttgtatatatatatatatatatatatatatatatatatcttgtatgccctcgtgtgaggaaggatctttgagatcaaagcactcagatgcttattcttttgtatagacactgtgagtgtcagatgatgcttatgaacataacttgtttaagttatgtaattgtaattcctcatgtttcagttgattgtgatacttgtggttatctacctatgtttatgttattctggatcagcaggggcttgtgttgtgatgtgattttacatactatacataatgtatcaagaaatatggtttcgaaaatgcttccgcggggttttaattaaagttaattactgcgcttatctgattaaataatatgttaatacaccggatgcatacggggtgttacactctttgaatgtgaaaggaaaaaaatgtaacatcttgatcaaatcacactagaatgaaagagagaggctatgcaggtatgatactatatagctaaggatgacttaaaggaattaattgatattatctaaaccaacaagatgcatctactttttggtagtccatcacttaagaactttatagttaagcatgtttgacttggagtagttataggatggatggccttctgggaagtttttcggaaagcgtgtgagtgaggacaaaacatgctgcaaagtcttgtattggtttgtggtgtcattcattgatcctggaagtagacaaagttgattttcaagatctcgaaaagggctatttatagagggttctaatggtggagggttttggtcaacaaggatcttgagtgaaatgccacgtgagaagtgctgtagtgtgagccgtcgagagtcgacaaccaaggatattacaaatggtatcagagccgacctttctccttgtatgatgtggtttgagcatgaaataggtggaaggtagtaggcatgtaacatcccaatcgaatcacaccagaatgagaaggatccagaggttgtacaggtatgagactgcgcagttgaggatgacttaaagaaattaattgatactacctataccaataagatacatctacctttttgtagcgcatcacttaagaatttcatagttaagtgtgtttggcttggaatagttatggaatgagcgatcttctgagaagtttcctggaaagttgtgaatgaggacaaaacatgctgaaaagtctcatgttggtttgtggagttagtcattgatcctgaaagatttttgaggtctaaaaaagggataccaacagagggatctaattgctggagggttttgtcaacaaagatgttgagtgaagtgtcatcaagcaaagtgccatagtgtgagagtcaattgagaagttgaaaatcagggatgttacaaaaaaaacacgagacctagttcaacaaaactaactctttttcaaataaggtaaaaatacaagtctctcttgaagtggataactaaaattcattcattttatcgctctaagagataaacttgtttgtagatattatatatatatatatatatatatatatatatatatatatatatatatatatataaagagagagagagagagagagagaaaagtcaggatcaaattataccggtgtaactttgaccaattattacaacgtccaataactttcaattgaataatattttcttaaaatctaccattggattgaaagttcctttcacgtacatgatatatacaaaatttcatattaatataaaattatttgttatctcattcatacaaattaaaattaacataatattaacttttcaaaatatattaaaatatggattgtttgattatcttcttattattgttcaattttaacaaaattccacacaaacaattttggtaatatgtaggtataattaaatggttggatctataaatcgcattttatatcaagttataaaatggtgtaatagttgtttatgttataaaatgtgtatgaaagagagagtaaggatgataatgagaatgattagggcgagtttcactattctcctaatttctgtcccacccttactaaaggtgaggcaagtttaagaaggtgaatattaaaaattaaaactcaatctcattcatgttaatgagattaagaaatctacttactctttttttaataaaaaaataattattcacttataattttaaataaatcatataccaagttattaattataaagtggattttttttaattcaacctaattaaaatgagttttttctatcaaagttggatgagaatcggatagatacgtgtgctcaaatttatttttcatgtctattgagaggactatgatctctatgacttcttggttgatggatgttaattaatttttgtattcttaaaatttcaaattaatttattttgataagttgtatggaattgtcagagattaaagaatgaattccaggtcttcgaaaagttcttcttccttttttccatggattgaaattattaaatcgtagctctccatcaaaatttggagggattttctataaaaagtccatttaatttcatattaaatttttaaaaagtccatttgtttcgctcaaaattatactcactaaattaaggataaattttatccacacgcaaatttatgaaatagttaaatttaggataagaaagaaattctataataaaataactatggtacatgggttattgacgagggatttaattctaaaaaataaataaataaaaaatagaggatggacttaaccattgaatgaaatcatcctcacgacccaaagccttataattataaaaaaaaagtattggaatttaaaaaggaagaattattacaatatttcaaaattttagtagataattatcctttagggtagttaatattttgattacttctatttatttcaacgtacttgaatagtatgaaataacaaaagatgtatattttaattaaaactaataagatgaaaataaataaaataaataaggtacttattagttaagaaagaaaaaaatatagtagaagaccatacatcgatttaatgaaaacatatattttttaaattcttttgggggtttataatagttgcagaagtctcattgaaagggttttaatatacactaatatgatcgtgttagagattttttttttttttctgaattgcaatggtgttatagtaatcactctcttcggatctattttctgttgagtaaattgtttctttcctatcacgatttttttctgtcaaaatgtttccacgttaaatatcttcttcctttttttttttttttttttttccggagatgagaattctaaaagttatcagtgtttttcgagaggcttataaaaaagtgactttggtgatcatatcgctgtcttggacataaaattatataggttagatatattattttctgtaatttaaatatcaatacatttaataataatttttataaatatggaataacgtaataaagttaagttgtctctctttcttaaactacttttaaatacaacttaagtatataaatatataattaaaaagatgattaatatttaccttagttgttattgatacaagtaataatgacttatgtctcttaaccaaatgatttagagttcgaatcttaattgatcattgattataaaataaattgtgttgaaaaaatatttatcctatatggttcgggtgcattagcagtcaacaccaattttttttaaccaaaaaactcattagttcttttgcttatcgaaatttaattcaaagagagcggtatttattttaagtaaaattggtgcattagcacggtttttttatttttattttttacatttcctctcttatttattttttaagatatatacaaaacgttttaaagagagtagtattttttttaaaaaaactaaaatttaaggtaaatcttctaaataatctagtctagcacattaaaagaaattaatgttttcatataattatcaaccacttaaaattattgtggcatgaatcctgagacctggatgcttgaacatggttttcgataacttctccacaatttctattacttacaaattaaaggactatgaatttatgtttaagagtttatgaatcattttttagtaattaaaccaattttattttcaaaaaagtataattctcacaacacatcaacataaatatttttctattcatttactaatctcttcacagcagtgcacacacacacaaaaaaaaaaagaagctcaaatgttcacttttcaatattaaatcaaatgtccatttagactacgtacataaaatgtgtgccatgttggataatatatcattcaacttgatatgattcttagatgtttgttttgataggtcttcccgaagattgccaacaccaattgtgcttagcccattggggatttattgtggagttggcctccaacctcttgaatttcttccaatcacgtagggccaccttcatatctgccacctttgcagtgatgctcttacaacaattggcatggattgtggcgactgccctaaaatccttactatcttggcaaaatccactaaaataaagggtgtccaaaaacctcaccctaagtcctaggtgttcaactatgccacttctaatgaggtcaagaagcacatcttgttcttttttttcctgtcgcattgtccttttggccataccatgtttcaaataaaaagatggtcttgttgtttgacctaacaaagtaaaatctagtgttgatcagatgcttttctgaccaaggatcaccaagatacgagtctgtgctgatttggaagtcttctatctcattcttactcaatttataaatggatttcttagccacattacatgagtgtcctgtgaaaaaaagatgttgcatatgaattagagaaatgaaaaagttgaaaaagtgaaattgatataatttgatagttttatcataaagtatgtataatgaataaataaatgtttagtgatctttatgatttaattaattaaggtttggccatagcacccttagttagttaaattataaattcagagcctctagatcacataagaaaaataacactaattgtaattagtcgtatgtaatatgataaatatcatctcacaagattttttttatcatgtttttgtatgattaattaggataaaaatattaagttatgttcttgatttgcccacagggattaggaaatataactgatatgttttatcattaagttcatatgaattttattgaattaaaattttggcctacatgcaaattttatgtcactaaattcataattctttgagcatgttttacattggtaaagcatgataatgatttatttttgccacaaattttaataataagattatatttgcagttgtacaacctgttagttctattgaagttccggaattgagaggggacaattacccaatttggaaggagagaactctcttgaatttgggatatatggacattgatgaagctatcaggaaacctgaaccaccagctattactgagaacagtgagccagatgcagtggatcgttttgaaaaatgggaaagatccaaccgtttgtgtgtcatgttcattaagactaagatctcttttggtattaggggttcagtggaaaagcataacaatgccaaagtgctcatgaagtctattgatgagcaatttaagacttcaggaaaagcactggccagtactctaatcatgagattttcatcaatgaagttcactgctttaagggtgtgcgtgagcacattatgcagatgagggacattgcggcccaattgaaaactttggaggtggatatgtctgacacttttcttgttcactttatattgaacactctcccagcaccatatggtcccttcaacatattctataacacgcataaggacaaatgatctattaatgaactcatgaccatgtgtgttcaggaggagggaaggttgcaattagaacaaggagagagttctgtgctgacaattgagaaaaatgacaagaagaaaaaatataagaacaagggaactggtaaaataccaccccagactggaattaagaaggaatcatccacgtgttttttctgtaaaaagaaaggaacatgaagaaggaatattctaagttcaaacaatggtttgaaaagaaaactatgtctacctctttagtctgttatgaatctaatattattaacataaatcataacacatggtggattgactctggttctacaatccatgtttcaaataccttgcagggtatgagacatctttcagtttattttataattctgatctcatagggaatggtattttatgtgatggtcttttctatattaatttgcaaaatgataccacttatgacgctatgcatgttaacattggcattaaacgatgtgttatgaatgaggattcctctatactgtggcaccggagattaggacacatctccattcagagaattaaaagattagtgaatgatggagtacttagtactttagatttcactaattttgagacttgtataaattgcattaagggaaagcacacaaataagtctaaaaaagggtgccaagaggagtactaaattattagagattatacatacaaatatctgttgtcctgatattgacatatatggtcataaatacttcatctcttatatagatgattattcacgatacatgtatctctacatgcttaataataagtacgaaaccttagatgcctttaaggtatttaagtctgaggtagagaatcaattgtagtgagcaaattacgatcctgagattggatagaggtggagaataatatggtagatacactgaagatggacaagcacctggtccatttgccaggtttcttgaagagcatggaattgttgcccaatacactatgcctggttctccgaatcagaatggtgtaacaaaaagaagaaatcgaatattattggatatggtgcgaagtaagctcagtagttccaagcttcctaagttcttgtggaaataggcactagagatggcaatgtacatattaaaccgagttccaactaagactgttccaaaaactccatttgagttatttaaaggttggaaaccaagcttacgacatgtacgcgtttggggatgcccgtctgaagttagaatttataacccacaagaaaagaagcttgacccgaggactattagtgggcatttcattggatatgctgaaaagtctaagtgatatagattttactgtccatctcacaacactaggattgtgaaatcaagaaatgctaaatttctagagaatgacttgattagtaggagcgatcaatacaaagactttgtttctgagaaggatcattcagttgctcaaccatccacttcaaacgtgaaactggttgttgtccaaaatacccctctagttcaatcgggtgttatacaaccaatcatacatgatctacaacctgctgatgatctagtagatcaagttgttcatgaggaacatgaagaaattgttgaccaactagtcgaacaacaagttcctcaagaagctgatgtctcaatattacgaaaatctactagagtaaggaaattagcgatacctagtgactatgttgtgtatttgcaagagtctgattataacataggagatgcaaatgatcctgaaagattttcacaagccatgaattgtaaagaatcaaatttatggtatgatgctatgcatgataagatgaattctatggcatcaaatagagtctgggattttgttcagatgcctgatgatgcaaaagccattagatgtaaatgggtttttaagacaaagaaagactcattaggtaacattgagagatataaagcaagactcgtagccaaaagatttaatcaaaaggaaggaatcgattataaggagacattttctcctgtgtcgaagaaagattccctccgtatcatcctagcattggttgcacattttgacttagagttgcaaaaaaaggatgtgaaaacaacctctctcaatggaaatctagaggaagaggtttttatgaaacaatcataaggatttttctcttgtgacaatgagaaattggtgtgtaagcttaagaagtctatatatggattgaagcaagctgctaacacagccaacaagggtaattgatgtgtaaagcttaagaaattggattttgcttatcaaaatttaatttaaagagagcagtatttctttttttttaagtaaaatttgtgcattagcacattttttattttattttttattttcctctcttatttattttttaagatatatacaaaagttgttaaagagagcaattttttttaaaaaaaactaaaattttctaaataatctagtctagcatattaaaaaaaattaatgttttgatataattatcaaccacttaaaactatcgtggcatgaattttaaaataattattaaaaattcaaaaagttgtgacaaataacaatttatgataggagattagtataaatttcacactattattataatttaaaattaaatccaatttaataattaatattacgtttcatattaataatgtcttaattgtatgttttatttattattattgttatttaactaaatacttttttatttattcaaattaaaaatatatttaataagtattatttttattcattttaaatatattatttataaaatataatttttttccattataataattttaaaatatatagtatatttataaaaaaaaaggattttataatacgatatttgaaatcaacggtaagtttaagatgataagaaaattaattcatcgcacttaaagaaagaatcattttctttaaccatggaattcatccaaagcacaacgatgctgcaggagaggatccgcatcctaccaatgccaagccagccaaaaccagcttaaaccaaagccctatttgaaaagaaattggccaatttcatgcagcccacaatccacaattgcccaaatcctggtgtttttctttgatttgctggacctggttgcttgaacatggttttcgataacttctccacaattgccttacttacaaattaaaggattatcaatttatgtttacaagtttatgaataactttttagtaattaaaatcaattttatttgcaaaaaagtataattctcgcaacacatcaacataaatatttttctattcatttattaatttcttcatggtagttgcacacacacacacaaaaaaaaaagaagctcaaatgttcacttttcaatattaaagcaaatgcccatttagactacgtacataaaatgtgtgtcatgttggataatatatcattcaactggatatgatgcttagtagtttgtttcgataggtcttccccaagattgccaacaccaattgtgcttagtccattggggattcactgtggagttggcctccaacctcttaaatttcttccaatcacgtagggccaccttcatatctgccacctttgcagtgatgctcttacaacaattggcatggattatggcgactgccctaaaatccttgctatcttggcaaaatccactaaaataaagggtttccaaaaacctcaccctaagtcctaggtgttcaactatgccacttctaatgaggtcaagaagcacatcttgttctttttttcctgtcgcattgtccttttggccataccatgtttcaaataaagagatggtcttgttgtttgacctgacaaagtaaaatccagtgttgatcagatgtttttttgaccaaggatcaccaagatacaagtctgtgctgatttggaagtcttctgtctcattcttgctcaatcttataaatggatttcttagccacattacatcagtgtcctgtgacaaaaaagatgttgcatatgaattagagaaatgaaaatgtgaaattgatataatttttcattcaactatttaattattttatatgagaagttgaagtcaaattcgagcaacaatattttttgtttcattattaacatatatttggtgcatttactattaaaaggaaatttaaagatttaggacccttcttgtttataaatcttatgaaatataatgagtgcttaatgagacttacaatcaatcataatgtgttacaataaaaaaaaaataatcacaatgtgttatgtgataaaaattgtgtctttctctctctccaacataaccatatcatgttaatccagaatagtagaaaatacaaattcacaatgaatattatgcgcaggatgaaaataaagattttaaatttgaattttatataaagtaaaattgggaaagcaagtatatgtaagtgcaaaatggtttgttactaaattaattttgttataatttttagggttatagttcatgcatttttattctttttttaggttttgtctttatgtctaattcattttactgattttagtatgagtgtcaccaaacaaagtttaggtctaccacaaaattaatacaatatgtcaatggagaaggaacaatgacatccaaaagggaacgtctctttatatgatgaagtgaaggaaattaaaagaaagaaattaaggtctccttaccatacaagaattactcataaaagaaagtggagaacttgtatattcatctccttaattattattataatttcataaagtggagaaaaaagaccaaggcgaaatattagaattgcacacaaaatatttaagttgaaattttattttgaatctaactagcatttttttagcttaaaatgtatttttcatttttattttttaaatatgtgattttagtcttttttaattgagacatttcatccttcacttttaaaaactttataattttaatcttcttttgattaatgtcaaacttgttggtcatgtattttttaattatttttaataattaaacttgttagtaattaaataattaaaaaattcatgtaaataataaacaaatacatgtcaaccagtaaatagatcaacttttaatattagttacaatgattaaaattatgaaattttaaaaaatgagaacaaaatgtctcgattaataaatgagagattaaaatcatgaatttttaaaaataaagaatgaaatatttaaattaaaaaataaaataactaaaatagtatatatttgaaaaaataggaagacaaaaattatagcttaaactttttaatacttagcagtaaaatctttaatttaatagaataatatcataaacatgattttatataattttaaatttctcaaacttcacgaatctttatgtataaatttttaaatctttgttattttcgagtcattatccctccatcaccataattatgattccctattgcaattttttttaatgaagtgcaattatcttttctgaatacgaaaagagaggcgtttttacgcctagacattttgcacatatttgaataatgggatgattacaaatttcaaggtcaactttgaataaaaacaaaactaatggttagtaccccaaaactaagcaatgctaacactctgcatgttgtctaccatatacgttaccccgagacacatgctacgaattaattgaaataagaaacgtagctaacatgacctagagcttcaacctcaaggcacacaactttctaagtgaattttggcaagttcataatgcaattaaaaacttttttttttttataagtttggcatgttcacggtggaaaaagtttcaaagcttgtaattttaaaaaatagttcatgattaaattagttaattatacgagtaaaattgagtctagaatctggataggttattttaaaattaagtaatttaatatttcctatgggtcatattatatatcatttcaataaattaacaaaatattaattacttttcaacaatatcttcaattttataataaaaatgatacgtgcattgagaattgagatatgtaaagggattcaaaacgatttatggagactttagaacgagtgcattgagatatcacaatggtgcgtcaattcaagtaagaaggttgtaatttgatgagaggaaaggaaaagggagtgatgagccgaaggaattcaagcagggatcgaagacgtaaaggttatgcaaggtaaagatggagttcatgatgataataatcataatttgtagaggaaacggagaaggtaaaggttaatgaggaggtagatagttgagtatttcagaatcaaaactggtcatcaaagaagggagttagagatttgagaaaaataaaagtgaatacaggtactaatacgagaagataaaaggagatgtacgtttgagaatgtaaagaagaaaaataatttggatatggaatgggaaggaaaaaaattctagtgatagcgagagaaacatgactcttattcatggagggtgtcatgattatgataccatgttaaaaataagatactattacgtaccgtaaaaacaaaactgtagccacgtttaagaacttccaagaggaattgagttcttctccacatcatcttgatgaaatcttgagacatgtatattttctcaccttcaaaaccaacaccatccgtttctagtatgaagcaattcaacctcaaaaattggcatcgatcataggccgttcgatcaacagcaactacgaggaggtgatcaatgagagaccttgttccttctccaagccaaaaactaccaagaaatatatcaagcatggtggtgtcactatctacatcttgctctacataggccttgtttcccattgaggctttggccaaagcatagtcaaggctatctccatatgcttcaacattagtggtggtctacaatgtatgcacaaattaaaggaaaattaaaatgatgaaaaattattgcaaaaaataaaaaaacaaacccgatttacatgcttgatactaaaaaaaatcatccatgggattaatgcaacattactcttttgattatatataaaactgaaattaaatttcagccggattataagaacaatataatactcatgagttatgagacactcagtttctgattaaaaaaaatatataatacacatgatatgttttgatggaaaattacatagaatatgggtgattgaattaacttacagaatttgattgctcgcatagtggttccttcttggataacactactaattcattggagaaagaggaggaccagttgtacagtaaaataaccccagcaaagagtagtattaccgctgcaaaactcccaagtgtttgtttagggttatccatgattctctatctctagctatgccttttttgtgagaacacaaaaccaaaattgagagtcagtcctattatttatatatattggtgctttcttggagggaggttaaaggtatggctattgtagatcgaatgatcatattgtattaatgaggcggagagaagtattcttatttttgttccatggtttgagaagtattattggtgctttcttggagggaggttaaaggtatcgtgtgcattgtggttcagttaaacagtttgaaaatgcaatttccgtggtaataattaaggatattctttgctgttgacctaaattggatgcaatgcttatcttttttttgttaaaagaattaatttttcaatttttaagtatttaattattatttttttgacgaattttaggtatttaaattgttgtcaattatatcctactaattttatatgctaaattttaattttatcatttattcaaaacataggttatgtttgataaaattaactgaaaagttggctagaatgtgaaaactaatttatgactaaaaattagctaaaagaataaacgttagtttattatatcataaatgtttagtaaaattatttattaaagtatatgaaaaatataaaatgatataaatgaacatattcatgtgatgttttatacaaatttcaattttattttcttgataaaaatatattttaaagtatttacaagtttagttttaaattaattttaaacacttataactttttatttataaaatatccagaaaaataaaaatactacataaacttattttatttcattattaatatcatatataataaaaaggtaagaaaaccctatcatatataaaaataataaaaaattatcttaaataaaaaaatctaataaatattcaagaacaaaaaaaatataaaaaaagccacaaactaacattttaaaaatatttaaaaaaatactaaaagttatcagaaaacttgtttatcaaatagttaaacaaattttttaattattaaaaaataaaaattagttaaaatatcttatcaaacatattttatatatgaaaagagttataaataatgatatagatattattttttatttacttttcaaataaaataaaagatgtaaaaaagtataattaagttctgatacctttcatcaataattcaaattcaaatatatcttaaacacccccctaagttggtgcatgaatatcgatcatgcccaacttgtcaattgcttcttcaaacactcttctaggaatgactttgattagcgataggttcaggaggtgcttcaggatagtccatgtaacaccccgtatgcatccggtgtattaatatatattatatcaaataagcgcataattactttaattaaaaggccgtggaagcgatttcaaaactatatttcttgattcattatgtatggttcgcgttaagtactcatcataaacataatcacaatatgtgcacacatatcttccctctataggggtacaaggtatatcaaaatatacaaaacaaggagcatccatgctctcaaagtgctgcaacagctgtccctactggggccttctatcctgggaaccgtcatctctgccagatgagtctcctgcaaatcataatccccacacgggataagataaacatctcagtaagctcagggtccttggaggcatctcctccaccctggctcgcttccatgacacacatcatcaaggcatcacaatcaatggcctccaggccctcataacaatatacagccaatcatctagctctaatgtatatatgcggaactacgccgccatgatgcatcattagcagcatcaggactctcagtcctcagtgtgagaccggaatcacacccatgtcatcccatcgggagctaccccttatgcatggacgcacgtatatggcacctctgagaataggcttcaaccgcgatgagaccacctatctcttggtcttaagggatcatcatcaccctttacgtgagcaaaccaaactaggaggtgcactcttctcccagggaggtccatatctatctaactggccagaagatctgatcacaggtatccacacatacaaggcatagaatcatgcatacatatcattatgagaaagtaacaaccaattcaatgcatgcatcatgaatgcaaccatcactcccttggagtatggtggaacacagcagtggaaaacactcctaagaaaccaagaacttacctggcaaagtcgtgctctgcagttcagtccctgaacggtagtctacgccactgacaccctcggtgtcacgccctatacaaggcatataagctcaatcaatcatcaattcgaccatacaaggaacataacaacagttctcaaccattacaatgaaaggaagcatcattcctttccataaaaacatctaagtcctctatcttaaggttatcaaagctaatcaaatcactagacaatacatggaccctcagtggtctatctcggcctagcccaggcactagagtctccacaagactcggtacaagacaaaacaaagagctcaaagctctatacaggccaaatactcaaaaatccataacgtggtttgaacagtttctttcacacaatgtagccgttcatatagcctctcaggcacatatagagtaagtatcaaggctcatgcatgttctatgatcatcaattaaccaacaaaataccaacacatgcatttctcagagccaagaagcaaagtccatgaaactaacatatgaaagctaatccttcatcacatcaactccctaaacatacttttctaaaggactcaaggttaatttcaactctagcccaaaagggtcactattcatcccaaaatcaaactcacaaattaaacgctaaaactcgagtttcttatctctaagatgacaaggaaggctaaagaactactcccccaagcttgggtgtttgtgaatcgcctcctttcctcgccgaactcgaatttttccaagttccctagagaaagggatttctccgtttggtggtttttagggaaaagagatgaaggattctagctcacaagagggttccctacaagttttatgtttgaagggaagtgttttgatgaactatggtgaagataggaagcttccctaggcttcaatggctgccagggtcagaggaagaagaagaagaaagggtttttcccttcaaaaaagcgtaaatgacccttatatacctgacctgcctgagcttccgcgctgttggcaccactctggcgctaccggcgctagttcccagtgtatttggcactaccggcaccacattctagagaaaatggctttctaaagcaattctggcgctaccagcgccactctggcactactggcgccagttcccagtgcatctggcgctgatggcgccactctggcgctactggcgccaaattccagttagaaatggccttttgctacaatttcacgctactagcgccactcccacgctactggcttgagagttttttttttttaacccaagggttattatagtccacaacaggtgtttcagttatgtgaggtagaaagagaattgaaatacgggaaaagattcaaaacaatcaaatgttcaagtcaatagactctagggctggtctgtgaaggatttgaaacagtacaacgagcttcacatcaatgaccttatggaataatgcattgagctagaattcaaaactgagatatgagaatgattcaaaattggtttgtggagactttagaacgagtgtattgagccatcacaatggtgcatcaattcacgtaggaaggctacttcgagggaaggaaggttgtaatttactaatttagtgagaggaaaagggagtgattaacgatgaaataaggtatgaagggattcatgtcaggactgaaaaaacgaaggttatatgaggcaaagatgaagttcatgataataatcatcataatttataaaggaatcggagaaggttaaggaagaggtagatagttgggtatttcagaatcagaatcaaccatcaaagaagggagttagagattttagagaaataaaaatggaatacagttactaatacgagaagataaaaggagatgtacgtttgggaatgtgaaaaagaaaaataatttggatatggaatgtggaagaaaaagattttagtggcaatggaagaaacatgattcttattcacggagggtgttatggcttcgataatgttaaatataatatactgataaattggaataataattccttattcactcattcacttatatttcacatattagatgaggtatatttatatacaagtaatgttaacaacctgaacagtaaacaatagttcaacttaagaaataataattcaaacttcttatctaaattattttaacaatatattcctatttaagataaacaataattcaaattcaaattacatcttcaacatttacttgtttttattgatcgatctttctcatgtttaagtgaatagaactgaaatagtggcataaaactagcttgcattcttaatttgttttcttctctagtttaattcaattttttttttgtggtgaagcctagtttaagtcaaatactacaccttaattatgtgccaaaaaaaatactaccttaatataaatttaaagggagacgtaccatcgaagatcattagagcatctttagtggtgttccggaaatactaagatatcggggtaaaagataagagaatctatttaatcaattcaaatatttgaaagtcgatcatatcctatcaatcaagtacgtgataattctaatcccagctaagataattgttcattatcttctgttattatcttcttaaatagattatctacaagccatggcccaaggcccataattcacaatataaatacagccctccaggtattcacaagacacacttttctgactctctctttcaatacacacttagcacacaccccacgtccagattgtggtgtttctccctgcaagtgtgatcttcttccctgaggtgttctttcaccatagacattctcaggagagagagagtttgatcctatagcaagtatccaacgaacctctgttggaaccatattcgttcttccaggacggaacattggcgccgtctgtggggacgataaatttcgaatcccaccaactctcaatggctaacactagaaggcatcagatcgttcgacgtgaagaaccacccaagaatccgaatccggagaatgtaatggtagaagatgcattatcccacacggactcatcccgtacgggaccagctgcgcatgtgtcggccaacacaccgccggtcgcgcaagaagatccagaaacctctcagcgtttcatcaagaacgctcttcagcccttgttggctcgaatggagaatctggataagcattacgaacttcaacgtcaggaagatatctagcggctaattgcccagttggaggaacgcagtaacagaaggcgagaagaagaacgttggcaaaatgccgatcacctagaaggccatgcaggaacagacccgcctcaggcagcaacaaggaggcggagactaaagacgtcggcccgcactgctggagccggccacagggacccgaccaaccattccgagcaggggagagtatctcgttctcatcacgagacacttcaactctcctcagccatgataccgaaatctgctgcaaaaagatcaacgggagagatcatccgtcgacctggtcaaggcgatggcacatatcgaagaaagtaccgtcggggtcattaaaataacagcccattcgtcaaccgaatagtggatgctcagttcttggaagacttcgacggctcgtttttgtccaaatacgacgggagccaggacccacaggtccacattgatgaatttgacatgcagatgtgtgtgagaggtatcgacgagccaatcatctcacacatttttgccaccactctaaccggggcggcccagacttggtttcattccctgccaccctggtccatccgcaactttgagaattttggccagaagttcttgctgaactttgcaaccagcaaaaaacagccgaagttcgagtttgccttgggcaagatacgccagcagccaggggagacgctccagagttatctggaccgattcaaagaagcggccttgcaagtccaaggtttggaagaaaaggtatatgtttatcttatttctgccgggctcaatggatcttcccgcctcgccaagtctatttataaagaccctgtgaggtcattaaacgagttcagagtccgagctaaaaaatatttggagttagaacaaatggagatcgcaaactcggcaccaggggaaaacaaagaaccttcctcgccttggaaccgacgacaggagaatccccaggtcggaccgtccagccgacatccagtaaataccccggcaggccgaccaccacggagcagtcccgaccctcactccaggcccgggaagtacgagttgaaatatcacaattacgctccgttgaccgtcccacgtggccaaatatggaaggaggttgccttcaccgacatgaggaaagtcaaccgacctcctccgatagtaaggagagaaggactggactattcccggtattgtgattttcacaatggaccgggccatacgaccgaccagtgctgggagctccgagacgcaatagaaaaatttgtacgagaaggcaaactgcgacaatacgtgatccgaactcaagggcaccacggcaagagaaaagcccagcacgagagtgagcaacgagaggacaagaggagcaagaaagacgaagaattctcagagcccgagttcgaatgcaacgtcatcatagggggagcaggaatgggagaaggaggcgatacagccaaccaacggaagaaatacctcaagtaacgtcggtaagagaccgaccgaggttcaaggaaagttagccgcgagtcggaaaggaccttggacaaggagcatacttactagagacatcggacgacaagcaagtcaaacggacttggaacgaggacaagctaagaaatactatagctgacaaagtgcagccaagaaagtccatgtgttttcctttagttggctttgagcccgtcatcggaatcatggaccccacgtgtttccctttaattggctattgagcccgtcatagggatcgtggattattatcttaaccatgtgttttcctttagttggctttgagccattcatcggaatcatggacccatgtgttccccttcagttggctattcagcccgtcgtcggggtcatgggagacccaatcacaattgatgtatcatgtgtttctcattagctgataaatatagttcgggatgtacaacccgcacaaatcagtcattgagatcatgaaaatcttatcttcgaagaatattaataaaatccttattataaggaacttctcattgtgcacaaattttgaatgcttagtcgttgttttgtattatctcggccctgatcaagccgacgtaactatcatgggtgaatcatcgggtcggccgaaagaattacacttacaatgatgttacaaataccctgacagttgctaagtcgggaaaaagatcccagaacgatatctaaaagcccgaccaatggtcccggccagataaacagtaaaattgggaacaccccaaaactatgtctaaagcccgaccaatggtcccggccaaatagacactcggccattggagccgaaatacggaagaataatgaagagactaaagacatcgtacaatctcggggaggtcgactacctcggctcagattccccatacgtggtcggccctatacgaggttggccttatacgaagttggctcgacacgaggtcgatcttgcccatacaaggtcggatcgaaagtctcaaatcataggaggtcggttaaaggactgatcaaaccattgtacatcccggtcatcaggaatactggaggaccgggacgaggtcggtttcgcacgaggtcgggtccaacaagatcagctccacacgtggtcggccctatacgaggtcggccttatacgaagtcgaaactcagtgcttcacaaggtccgaggtcccgacaccaaacggtcatctcggccgataaaaccagaaacccgaatataaagaaaatataaaatcgaggtcattcattcacctcggccactacaatcaaccagagtgattcattcaccttgaccgcgacaactaacagaaatgactcatcagcatcagaaagatatgggcgcttagtgcagctcggcagatcagagtgctaatcaactgagctggggggcatctgttccgcaaatactaagataccgggataaaagataagagaatctatttaatcaattcaaatatttgaaagtcgatcatatcctatcaatcaagtacgtgataattctaatcccagctaagataattgttcattatcttctgttattatcttcttaaatagattatctacaagccatggcccaaggcccataattcacaatataaatacagccctccaggtattcacaagacacacttttctgactctctctttcaatacacacttagcacacaccccacgtccaaattgtggtgtttctccctacaagtgtgatcttcttccctaaggtgttctttcaccatagacattctcaggagagagagagagagtttgatcctatagcaagtattcaacgaacctctgttggaaacatatttgttcttccaggacggaacaagtggtaaatctcaaattaggatcttagactactctttggtagacctcatattgtcaaatatgattaaagatctctcaagatatcttccatttttttaagagtagatctcattcttagatattaaggagagagaaaaaggaagaaaatttattttggacaatgtgcagatcttaagagatcttctacaagaactcatcctccatgttggagatctctttaactcctttattgatagatcgagtaaagatcagatcttgagttcaagatctttactcaaaatcttacactaaagatattcttataaatagaataacatttatttgctaaatcccatgtcaatatttggttgtttttgcattaattatttacctaattcatccattaagcaaggtttgatttgttaccaaataagtcgatacacgtcacaccttttcgtataaagttttggtgcaagtaacattctcataaatgttgtgaaaagagaatttattgtactcatattgagaaactgacttagttacgcattttcagctttgagcaatatgttcgtagtttcttattttcttatttttgaaagaactgcacgagaaattgaaactacaaaatattgaaaataaaataataaagtaaaaatagtttgaatttcattaattttcgtaattattgaaaaataatattccaaactaaaaagtttttcaatttttttcttccttccattctcttttttgatttgtatggtaagatgtaatcatgggaattgtatgattatttatataagatttaatctttcatccatctcatattatttttttgacatcaatccatctcatcatgacttcatatgttaaaatcctgaatgcgaatattgtaaaaaaaattattaattaaaataattaccataataaaatcatttttataataaaattgaagatattgttgaaaagtaattaatattttgttaatttattgaaatgatatataatatgacccataggaaatattaaattacttaattttaaaataacctatctacattctagactcaattttactcgtataattaactaatttaatcatgaactattttttaaaattacaagctttgaaactttttccaccgtgaacatgccaaacttattaaaaaaaaaaattaaattgcattatgaacatgccaaaattcaatagaacgttgtgtgccttgaggttgaagctctaggtcatgctagctacgtttcttatttcaattaattcgtagcatgtgtcttggggtaacgtatatagtagacaacatgcagagtgttagcattgcttagttttagggtactaaccattagttttgttttaattcaaagttgacctagaaatttgtaatcatcccattattcaaatatgtgcaaaatgtctaggcgtaaaaacgcctctctcttttcgtattcagaaaagataattgcacttcattaaaaaaaaaaaattgcaatagggaatcataattatggtgatggagggataatgactcgaaaataacaaatattgaaaaaaattatacataaagattcgtgaagtttgagaaatttaacatatataaaattatgtttatgatattattgtattaaattaaagattttattgcaagtattaaaaaggttaaactataatttttgtctccctatttttctaaatatacaattttagtcattttatttttaattaaaatatttcattccttattttaaaaaatttatgattttagtctctcatttatcaatcgagacattttgttctcatttttaaaatttcgtaattttaatcattgtgactaatatcaaaagttgatctatttacttattgacatgtatttgtttattatctacatgattttttttaactatttaattactaacaagtttaattattaaaaagaattaaaaaatacatgaccaacaagtttgacattaatcaagaagattaaaattataaatcttttaaaagtgaaggacgaaatgtctcgattaaaaagactaaaatcacatattaaaaaaaatgaaaaatacggctgatcatcctcttagactgatcatcaccttggtaagcaattgtctaaaaaagtgctagttagattcaaaataaaatttcagcttaaatattttgtatgcaattctaatatttcgccttggtcttttttccccactttatgatattataataataattaaggagatgaatatacaagttctccactttcttttatgagtaatccttgtatggtaaggggaccttaatttctttcttttaatttccttcacttcatcatataaagagatgttcccttttggatatatgtcattgctccttctccattgacatattgtattaattttgtggtagacctaaactttgtttggtgacactcgtactaaaatcactaaaatgaattagacataaagacaaaacctaaaaaaagaataaaaacgcatgaactatacaaccctaaagattataacaaaattaatttagtaacaaaccattttgcacttacatatacttgctttcccaattttactttacataagattcaaatttaaaatctttattttcatcctgctcataatattcattgtgaatttgtattttctactattttggattaacatgatatggttatgttggagagagagaaagacacaatttttatcacataacacattatgattgattgtaagtctcattaagcactcattatatttcataagatttataaataagaagggtcctaaatccttaaatttccttttaatcgtaaatgcaccaaatatatgttaataatgaaacaaaaaatattgctgcacgaatttgacttcaacttctcatataaaataaccgaatagttgaatgaaaaattatatcaatttcactttttcatttctctaattcatatgcagcatcttttttcataggattctgatgtaatgtggctaagaaaatccatttataagattaagcaagaatgagacagaagacttccaaatcagcacagactcgtatcttggtgatccttggtcagaaaaccatctgatcgacactggattttactttgttaggtcaaacaacaagaccatctctttatttgaaacatggtatggccaaaaggacaatgcgacaggaaaaaaagaacaagatgtgcttcttgacctcaatagagtggcatagttgaacaagtaggacttagggtgaggtttttggacaccctttattttagtggattttgccaaggtagcaaggattttagggcaatcgccacaatccatgccaattgttgtaagagcatcactgcaaaggtggcagatatgaaggtggccctacgtgattggaagaaatttaagaggtggaggccaactccagagtaaatccttaatggactaagcacaattggtgttggcaatcttggggaaagacctattgaaacaaacaactaagcatcatattgagttgaatgatatattatccaacatgacacacattttatgtacgtagtctaaatgggcatttgttttaatattgaaaagtgaacatttgagcttcttctttttgtgtgtgtgtgtgtgtgtgtgcactactgtgaaaagattaataaatgaatagcaaaatatttatgttgatgtgttgtgagaattatactttttagcaaataaaattgattttgattactaaaaaatgattcataaactcgtaaacataaattgatagtcctttaatttgtaagtaatggcaattgtggaaaagttattgaaaaccatgttcaagcaaccaggtcaagcaaatcaaagaaaaacacttcgttgtgctttggatgaattccatggttaaaaaaaatggttctatctttaagtgcgatgaattaattttcttatcatcttaaacttaccgttgatttcaaatgtcgtattataaaatcctttttttataaatatactatatattttaaaattattataatggaaaaaaatatattttataaataatatattaaaaatcaataaaaataatacttactaaatatatttttaatttgaataaatagaaagtatttagttaaataaaataataaaaataaataaaacatacaattaagacattattaatatgaaacgtaatattatttatttaattggatttaattttaaatacaataatagtgtgagatttatactaatctcccatcataaattgttatttgtcacaactttttgaatttttaataattatttaaaattcatgccacgataattttaagtgattgataattatatcaaaacattaatttcttttaatatgctagactagattatttagaaaatttaccttaaattttagtttaaaaaaaaaatactaatctctttaacaacttttgtatatatcttaaaaaataaataagagaggaaaattaaaaattaaaaaaaaaatcgtgctaatgcacgaattttactttaaaaataaaatactgctctctttaaattaaatttggataagcaaaatccaatttcttaagctttacagaccagttacccttcttggctatgttaggagcttgtttcaatccatatatagactttttaagcttacacaccaatttctcattgtcataagagaaaaatccttcttgttgtttcatataaacctcttcctctagatttccattgagaaaggctgttttcacatccatttgttgcaactctaagtcaaaatgtgcaaccaatgctaggatgatacggagcggatctttcttcgacacaggagaaaatgtctccttataatcgatttattctttttgattaaatcttttggctacgagtcttgctttatatctctcaatgttgcctaatgagtatttctttgtattaaaaacccatttacatccaatggcttttgcatcatcaggcaactgaacaagatcccagactttatttgatgtcatagaattcatctcatcatgcatagcatcaaaccataaatttgattctttacaattcatggctagtgaaaatgtttcaagatcatttgcaactcctatgttataatcagactcttgcaaatacacaacataatcactaggtatcgctgatttccttactctagtagattttcgtaatattgagacatcggcttcttgaggaacttgttgttcaactggttggtcaacaatttcttcgtgttcctcataaacaacttgatctactggatcatcagcaggttgtgaatcctgtatgactagttgtataacacccggttgaactggaggggtattttggacaataaccagtctcacgtttgaagtggatggttaagcaactaaatgatccttctcaaaaataaagtctttgtattgatcgctcccactaatcaagtcattctcaagaaatttagcatttcttgattccacaatcctagtgttgtgagatggacagtaaaatctatatcccttagaattttcagcatatccaatgaaatttccactaatagtcctcgggttaagcttcttttcttgtgggttataaattctaattttagacgggcatccccaaacgcgtacatgtcgtaaactcggtttccaacctttaaataactaaaatggagtttttggaacaaccttagttggaactcgatttaatatgtacattgccgtctctagtgcctatttccacaagaacttaggaagcttggaactactgagcatacttcgtaccatatccaataatgttcgatttcttctttctgctacaccattctgattcggagaaccaagcataatgtattgggcaataatcccatgctcttcaagaaaccttgcaaatggaccaggtgcttgtccatcttcagtgtatctaccataatatctccacctctatccgatctcatgatcttaatttgcttaccgcattgattctctaccccagacttaaataccttaaaggcatctaaggcttcatacttactattaagcatgcagagatacatgtggctttccctatgcatacatctaaacctgaattacttccctaggaaaagactctaagaaagtaaaatattcaattaatgaaccccgaatcttgactattactcccgctttcagttagtgttcattgctaagtgatcgctcgctatctggctggaaaaggtggtccggaagctttctctctcccagcaagcaagacgagatcaccacttctctcagtaatggatcgtgaataatcatctataaaagagatgaagtatttctgaccatatacgtccatatcaggacaacagatatttgtatgtataatatctaataatttagtactctccttggcaccctttttagacttatttgtgtgatttcccttaatgcgatttatacaagtctcaaaatcagtgaaatctaaagaactaagtactccatcattcactaatcttttaattctttgaatggagatgtgtcctaatctccggtaccacagcatagaggaatcctcattcataacacatcgtttaatgccaatgttaacatgcatagcgtcataagtggtatcattttgcaaattaatatagaaaagaccatcacataaaataccattccctatgagatcagaattataaaataaactgaaagatgtctcataaaatgaaaaggaataaccaaatggtacaagtcttgaaactgaaattaaattcttagaaaaactagaaacataaaaagtattttccaaattcaaaataaaaccacttcttaaaactaaactacatgtgccaatggcctctacgggtgaactcatcttgctgcctgaatagatgcatagttcactgcccactcgtttccttaggttttgcataccctgcaaggtatttgaaacatggattgtagaaccaaagtcaatccaccatgtgttatgatttatgttaatcatattaaattcataatagacttaagagtaagcatacctttcttttcaaaccattgtttgaacttagaacattccttcttcatgtgccctttctttttacagaaaaacacctggatgattccttcttcattccagtctggggtggtgttttaccagttcccttgttcttatattttttcttctggtcatttttctcaattgtcatcagagaactctctccttattctaattgcaaccttccttcctcctgaacacacatggtcatgagctcattaatagaccatttgtccttatgcatgttatagaatattttgaagggaccatatggtgctggaagagtgttcaatataaagtgaacaagaaaagtgtcagacatatccacctccaaagttttcaattgggctgcaatgtccctaatctgcataatgtgctcactcacaccccttaaagcagtgaacttcatcgatgaaaatctcatgattagagtactggccagggcttttcctgaagtctcaaattgctcatcaatagacttcatgagcactttggcattgttatgctttgtcactgaacccctaataccaacagagatcttagtcttaatgaacatgacacacaaacagttggatctttcccatttttcaaaacgatccactgcatttggctcaccgttctcagtaatagctggtggttcaggtttctgatagcttcatcaatgtccatatatcccaaattcaggagaattctctccttccaaattgggtaattgtcccctctcaattccggaacttcaatagaactaacaggttgtacaactgcaaatatatgcttattattaaaattttaggcaaaaataaatcattatcatgctttaccaatgtaaaacatgcacaaagaattatgaatttagtgacataaaatttgccaataggccaaagttttaattcaataaaattcatatgaacttaatgataaaacatatcagttatatttcctaatccctgtgggcaaatcaagaacataacttaatatttttatcctaattaatcatataaaaacatgataaaaaatcttgtgagatgatatttatcatattacatacaactaattacaattaatgttatttttgttgattcaagtaaagcaagcatcaatgaacaagaatcaaaggctcaaaagttttgtgctttcaacatgcacaaaggcaaagttccatggaaagcattgaagaccaatttgattaattgtaaaaggaagtatatgatctgataatccaattgtgcacatcatgaattaatcattcatttaggatcattagattaaaaggtttaatcaaaggcagtatataactaaggcatttaaaaggttaagtttttggaaaaacaaagttttactgaagtaatcgattacacatatactggaatcgattattttgttcttcgtgcctttagaaaacaaatcatgatcattgtaatcgattacatatcggtttaatcgattactaaggctttttatgaaaaatggaactctctgtcttaatcgattacatagagttggtaatcgattacatgcctatgcatatagacttagaaaaatcacagctcgctgtcttaatcgattacatatcgtattaatcgattattaagctcatttagaaaaatatgactgactggtttaatcgattacttcacggaataatcgattatattgttcatagcccaaacccagaaattattaggagcattttaatcgattacagtcttgatttaatcgattacaaatggtaaataatcgattactggagcgtgtttaatcgattattttcagttaaaaaatctgttataaatagaactcacttctctgaagtttgtaacttttgatttttcgaattctgggctttcaaaaacattctgagttttcattagtgagtttctctgagttctaaacatacttagcttcacaaaatctcatatgggtttttgattcaagaaggtgaagcttcattcattcaaagcataaggaaatgactgcatatgtgattgtaatttgtctttcaacctgagaatcattcattgtgcattcattcttggattatcaggtgatggctttccttattctttgatggtgtaaactgttccttgaatatttgtaaggattagtctattataattgagtttcttgcaagtgtgagatagtgtttctttaaaagacagctgagtagtgttctcagtgtaggttttggtctctaaggatctaatagggttttggatctctgaacttcatctagggttgatgaagagaggcttgtaaatttgcttgtaaggataatttttacaatagtggaactctactctagtgttgagtagaagaactggatgtagcctcatagggtttgaggtgaaccagtataaaaatctgagattaatctttcttctcacctattcatttcttaattgttttgtttgtgaaccaatttcattgcacagaaaattatactttgttttctattcttcttgtaaaaggaatttgattgaatattgattcttggttttgaaataatattgaaagtgataaagatcctgtggtaatactctgattttaaattttaattggacaaggttcaaccaattcacccccctcttggttgtgttgaagtattcttatcattttcaatttttcttatgtgatctagaggctctgaatttataatttaactaactaagggtgctatggccaaaccttaagtaattaaatcataaagatcactaaacatttatttattcattatacatactttatgataaaactatcaaattatattttccatttttattggtaacttaataatataatttaatattttatcttaattaaccatataaaatataacaaaattcttgtaggataacatttattatatcatatatgatcaattatgattaatatcaattatgtgttttctttacaaattattcaacacgtgttttgccaaaaattttggtaaccttgcaaacatatatgaaggaaacctagttttttacttttgatgctattttgtcattttgtgccaattttataatgctttgttgtatcacatacataagtgataaatttgcatatcacaagcatcttcctcggtcaaaacaagtgtcaagcaaaattttaatatgaatttataaagcataagacgacaaaataacatttcttgtagcataaaagcattgaaaacaagaatttgcttttacttttcagagtaaaggtacaagaacatgcacgttatatatcttgataatgtcaaaatcaaaaggaattgtcattttgaaacttaataaaacgacacacacttaagttgtcttcaaccttaagcaaaagggtatagaagcacgcaaagttttaaatcacggtttctaattttaaaaacttcttttcataaaattttacatcgtttttcatgatttaaagtctagaatcattagaaatctattttctttatgattcttaaaatcaaaatttattttaagactttgaatcaaaatatccagtaaaacccaaaaaactcaaaacgtaaaaataaggcagaggttgaacaatgctctgataccaaatgttagatttttatatacttaatgatctaatcattttcacaaataatattagatcaatgcggaataaaattgaatataaatacctctcgtcattgctccttgaattgggttgtaatactgcaatgtgaagtgatttcttgagtcttccaaacttttctctcaatttgcattagatggtgtatatgcacttatatgttagtgagttcacagatcccataaattgaagacacacacctatatgtagacattttccatcaaaggtggttttgtgtgtatgattagaatgggaagttaacaacgattatgataaggggtagttaaccagaggaatagttaatcaattaaggttggttacaaaataaaaccaacagattttgccaagatagcaaggattttatggcagtcgccacaatccatgccaattgttgtaagagcatcactgcaaaggtggcagatatgaaggtggccctacgtgattggaagaaatttaagaggttggaggccaactccacattaaatccccaatggactaatcacaattggtgttggcaatcttggggaagacttatcaaaacaaacagctaagcatcatatcgagttgaatgatatattatccaacatgacacacattttatgtacgtagtctaaatgggcatttgctttaatattgaaaagtgaacatttgagcttcttcttttcactactgtaaagagattaataaatgaatagaaaaatatttatgttgatgtgttgtgagaactatacttttttgaaaataaaattgattttaattactaaaaaatgattcataaacttgtaaacataaattgatagtcctttaatttgtaagtaatggtaattgtggagaagttatcgaaaaccatgttcaagcaaccaggttcgacaaatcaaagaaaaacactgggaattaggcaattgtggattgtgggttgcatgaaattggccaatttcttttcaaatagggctttggtttaagctggttttggctggcttggcattggtaggatgcggatcctctcttgcagcatcattgtggtttggatgaattccatggtaaaaaaatggttctttctttaagtgcgatggatgaattttcttatcatcttaaacttattgttgattttaaatgtcgtattataaaatcctttcttttttataaatatactatatattttaaaattattataatggaaaaaaattatattaataatatattaaaaatgaataaaaacaataattcataaaatatatttttaatttgaataaataaaaagtatttagttaaataaaaataataataaataaaacatacaattaagacattattaatatgaaacgtaatattaattatttaattgaatttaattttaaatacaataatagtgtgagatttatctcccattataaattgttatttgtcacaactttttgaatttttaataattattttaaaatttatgccacgataattttaagtggttgataattatatcaaaacattaatttcttttaatatgctagactagattatttagaaaatttaccttaaaatttagtttttttaaaaaaaaatactgctctctttaacaccttttgtatatatcttaaaaaataaataagaggggaaaataaaaaaaatgaaaaatgaattatttagacaaataaaataatataaattgaaaatgccttcttttagttacataaaatttaaaaaggtaaaaataataaattatattaattgaatgttttatttaattaataattatttatttattcaaattaaaaatatactttagtcatcattgttattattttagtatttttatagataaaatacaattttcctattgtaataatttgaaatattatatatatatatatgtttttatatttttaaaataattcttttatatttttaatatgatatttaaaatcaatggttagtatgagatataaaaaaaataaaaaataaaaagtcgattcaaacaatacacaacaaagcacaaaacaacaccccgaacatttactttgaaacgagcttataagagagaaactttaatcacgagattcatccaacggactgtaatgctgcagcagagagctagagaggatccgcatccgccatttgtatgggttcatatagaccaattttaaatttttaatgcttattatagttttatactttgctttgatatgttttcaaatacattatatttattaaatttaataaatatgttttgggtcgattgttaagtgataatgttatatttatagtgatatttttgttgttttgcaatttagtatttttttatttttgtaaatataatttttcattttaatctttttaaaaatatatttgttttatttttcattattaaaatgttttatataacactttgaatagtaaaaaaaaatactttaaatattgaaaaaaaaccttatctaaaacattcaaagacaaaaataaaataaacacattttataatgacaaaaatgaaaaaaatatatttgcaagaacagaaataaaaaatggtaaattgcagagaaaaaaaatatatttaagccattataattgatttaaaaaaaaaaatccaccccccttcttatttgactaacatcaaattttcaaacttttcttttctctccttttttatcagcatttaattttaatttatctatcctctcttctataaagtaaatctaaatctaaaattatgttttgtcaaactaactaaaagttgaaaagttaactaataattgaaaggtggatatcaatagttgaaaattgaaaagttagattattaaattataagttcgataaaattaactgttaattgtagtagttgaaaagtgtaaaactattgaaaaaaatcatgatttatttataaaaaaaaaagataataaaaaattgaataaatatattaaagataaaaataaaataaaatataaaaaactagaaactaatattttaaaaaatgttacttcaattaacattttatgaaatggtaaaaactactaaaaaaaacacttgtttaactaatgaaaaaagttaaaaattaattgaaatagtttgcggaacatagcctaaataattaaaaaaatacaacatgaaatctaatttagacaattgttgagaaattggttcagatttatttaaataataataatatttctttaacttaaatgaatttgaaatatcaaccatttttataaaggaaaatcacgtgaattggaatgttttttttcttcgaatttttatttggtacatataatatatccacgataggggaaattatactagaaatatatctctcaataaaaaaatataaatatattaattattaattaaaaatgttttcacaataactatttgagtgtagaaaataatataataaaaatcttagttaattaaagttataaaaaaagacctgtttaaagttacgttcattttgttgtcaacaaaaaagttacatttattttcatattcaacattttttaattattttgatttacttcctttaataagtaaatgaaatgataaaaaaatataaattggaaagaaaaagcatttatttttataatatatagtttttataatgcatttatattatgaggatagaggagagagaaattaaaattttaattagaataagaagagagaagagtaagtttgaaaatttaataggagagatatttttttaatttaattataattaatatagtttccttaaattagtttgactaaaacaaatcagcttgtttgctttttaaatgttttaagttaaatgataaagtatgataatatttttaaattaaattttgagaaataaaaaattcaattattttttttttttgtattaaatggtctgaccatctagtcaaagcagtttttattttagttaggcttaatttgaccatccttatatatatatatatatatatatatatatatatatataataattaaaccatgtagttagttacacgttggttgcctctcaatatatatagggttctcaattttggttttctgtcctcacaaattaaacggcatagagatagagaatcatggataccaaacaaacacttagtagtttggcgatgataatattactcttaactgggattattttggtgtaccactggacctcttctttctccaaccaattcgttctaactctaaaggaaccactttgcaagcaatcaaattttgtaagttcaaatcacccatattttacattttgcatcaaaacaaaatcatgggaaatcttcatatatctagtttaaattttcaatccttatatatataatcaaaagagaaataatgttgcattgccatatattacttatattttattttgtatcaagtaaagtttatagagtttttatttttcgttttagctgtaatttttcatcattttaattttcctctaatttgtgcatacattatagaccactcccaatattgaagcaaatggagatgaccttgacactgctctggccaaagcctccatgggaaacaaaacagtgataattgctatagtaaataaggcctatgttgatcaagatgtaaagagtgacaccactatgcttgatatatttcttggtagtttttggcttggagagggaacaaggtctctcattgatcaccttctcttggtagcggttgatcaaacagcctatgatcgatgtaaatttctgaatttgaattgcttcaaattggaaacagatggggttgattttaaaggtgagaaaatatacatgtctcaagatttcatcaagatgatgtggagaaggactttcttccttttggaggttctcaaacgtggatacaattttgttttcacggtacgtatttccctttttttccatcttttttctattttttttcagttgattgctctttctcatgtttaagtgcatagaatgtatcggccggtgatctaatctaaaattagtttacttttctctctcttctcttttttgaacttatatttcacacattactttttttacagataatatttcacacagaacttgccaacccactcacaaactatcaagctatcatatatatatatatatatatatatatatatatatatatatatatatatatatatacatgccagcaattatgaaaaacgtattttcaacttctcttcctagctaaagcagtaaaaaacaaacttttctttctaaaaaaagttcaacttctcatatagaattaaattgaatagttgaatatggaagtgcattgaatgtataggtggtctaatataaaattagtttacttttctctctcttatcttttttgaacttatatttcacacattacttttttttacagataatatttgacacagaacttgccaacccactaacaaactatcaagctatcatatataatatatatatatatatatatataattttagattaggaataaatagttccatattaataatattaagagatacaagactaatgaaatttccaaattcaacactggctatattagaaaataatttacatgatggtccttcattttttaattgttatcctaactttgctttaaacttaaaaaatgaacaaactgcatatgctttaaaattatatgtaaaattacctacagatattttttcaagaagattctggagctctaaatttaatatttagaatatattataaagtaactaaaatagattataactttagagctttaagaaaatctaaaaaggatgaaacaataattgttgaaggaaatcttaaaaaatcaaccatacaagtacctagaaaattagatcattacgaagtaatgaaaaatattcctgaagaatggttaatctcatatgtaatagagcaacctaaaataaataatactcaaataagagaaataatacaataagttactaatgtaagattaagaatgaataggtcacagtcattaagagttgataaacctcaaatgatatataaagggcaatcttcaagacattttatagatggttcaactataaatttagattaaacaggattggacaaaagtaatccaaaaataactaggccaatatatcaagaaactaataaatctccttaatactctccaactaggtctcaagtattaaatactttaataagagaagaaccttttaaaatagataaagaattgattaaacaagggaaaaatagaaagtgattttttgaaacatatagttcggaagaaagagagaaaataaggactgaatattataatgatctagaaaaacaagaaattaatacttatttttccattggttttttgagaaaaataagacaataaatcctattactaaaaatactagtatttggaaaactacatagaatttaataatagaatcagcttttatcctccttatatgccctatatttctctcttactcaacccctggatatttctgcttgctcttatcatacatcatcttcatcaaacctagcttaagtaaattttctaataataaattctgaagttttcatacatgttaatttctttcatattatcaatatatattttagtatacaatatcatgataatagtcatgcatatttatgaaagcttaatatttgaatttcaaaatacctacggatatatatatatatatatatatatatatatatatatatatatatatacatgccagcaattatgacactactacaaaagcaccatttgaagacgcacaatctaagacggttgtatgataaccgtcttagaatcctgcgcggtggcatttttgtaaataggaggttattttcaaagatggtcccctattacccgtccttgttcatagcatttcaggccgggccactgtaaaacccgtctttgtttcttattatacaaagacggttcatcttaaccgtgtttgattgcccattttttttttaaaataatttttacaaaagcattaatattctgtgtgccctaattactgcaattcgatcgtgtcttttttctttgtgccctaacccctctgttgtgcactctcagattgtctctcctccgccgcacgccgcccccctccgccgccgaaagatcccgagcgggattactttagggttttctgatcaacctgtttgcgcccatctcactccatctactcactccgcttctggcagcaccaccttcgtcgctctgtcttcgttgaagccaccatcgtcatcgtggaggcattgacgacatattgttgtgctacatatggtatgtgactagttcgattccatttaatttgttttccatggtggcctctgtttccggttttggttttgaccttttatcagttgatgtgtttggtgttagtttgttggcaggcattgttagatttagaattagcataagtccgattgtgggtatttgttgattgcttgttctctgttttggttacctaacacagtccatcatattatatataaattgtgtaaaccttccaaatgcatgttaactaacaacaatgaaaaattttaagcaaaaacggaggattggtagaaactcttaaggtgaaattatgtttgatgcaagtacaggaaactaatcagtagatttactttctttatagctttctctttctctgattttctcaacggattccgcattgtcattccagcgctttatcctccttcagcttcatagtagttaatgaataatatatattcagagggggatcaagatctcaaattaaagtgcttggcccaagttgaattccaaatccaaattacgcttattcgggcttgatcctcaaataaacttccatctgatattctctcatagcttaggcactttggatccgtttcgttctgaaaaaccaaaatataaaataattaattaataaagaagcaaatatcatgatataataatcgttttttgtgtcgacaatattatctaaagtgtgaacaagggaaaaatagaacccacaagggaaaaatcacacacaacagggaaaaactggaatagcaagaacaaaccaagaggcaaggtaaacgagtgtacctccaaaggagctttctccttttacactggcaatagcccaataactgtatattttccaatccccctcttactgaagagaggactctaatttattggagttataattctccaaataacagaactaactaactctcctatccctctcagtggttgttacaactttttgaccctttccttttcctataataaacctgcaaacccaaagtctttcgtgctacagattgttgtttggactcagtcctataagaggattatcaccaactaatcctttatccttaaactatcagtaaaccaaaacacataattttaacccatagaatgctgcagttaaagcccaagtctacatcaaaacagtatatggctctcaatgagtgcaacacttattactctgaattattgtgcaacatccaatatatcattgattaaaaaaaaagcaagttatttatgcttcattgtatgaaacatatcatatcctatccatgacattagtttttcatctttccttgtttatatggtagtggcttttgagggcaggatgtgtatgtgtccaagccgcatataacaggctattggcatgtttgatcctggtgagctttcagtggaacataaactgactagcccagtcttcgaagatcttttttccatttatgtagcaacaatttacttagatttttgtttttgttgtaaacaaagagttttagaagagactagagacgagtaaataagaaaggataagttgtgtcttctaacatagagaaatgggaaatgacacaaatttgttaacaaagttaccctgtcttagtagacaatataggttacggatgtaagcatagggaaaaaggttggggtagcacactgtagaaaagctgaaaagatggtagaatcttgtcttggtttgggcatgtgcggagagacttgtaaaaggcctagtaataaggagactacattgatggatggtaggccaggagttagaagtagagggagactgagaaactataggttcaacaattattaagtatttagaatcagaagtcaataatttgtttatagacatgggtgctaacaacttaattaagtgcttatcataagttgttttataatgaaagaggaaatggatttaacccatttctcatacaagttgtatgttgttttcataatatacggtgaagagcatactaaaaaagctgaaaataacttgtggacatatcataagctattcttgtaagctttcccaaatacttagacaactgtttgtgtcataagataagatcaaataacttgtaaataagcttttctaaatgcatccataatgttaaatgtcattttatgcatgaattaggtggaaacaagatcgttagttaaaagcttaaggtattaggtggaaccacatggatatttatatacttaacatcatcatcatgctaatctgtggtcaaagcaagatactcaatatgcctattttattaccattgaaattcagtttaattatgaaggaatgatagtcacgaggatcaaactcttgactacctagtcaaagaggcttataaatgatatcaacaatgaatcatccaaaagattaaaattttagatggaaacacttgaatggttttatctccctaacaacatattaggaggttcatacttgttgtggtattgacaattctatggactggttttaattttaccatgtatattgttttatgtatagctatttcccagtgatggtttaggaaacttcagtgtttccatttgttatggaatggtctgcgtgtctgtacatataagtgcaattcatgttcttaggtacatgcaaagaataattttgacttcacagttttctgtcttagaattgtggatgtagacatatcctattgtatttggttctggtacaagctggaataattttatattgggttgatgcaatgttccttatttcctttttcaaatgtttgattagaataaatagatagacacaggcataggtatcatttgttttagaatctgacagcccctaatcttgagcctaaagcatcagtcggtaacacaaaagtttgataaaaatcaggcacccccagcacaggcagtttactcattatgtcttcgaacttttgcaccaattttcgattctgtcttctttaaatgaaccgtggctgcattcacatgcttcagctcatttcttgtaacatccatagaggccatgaacttaaaaccttgttctctaatggaaactaagtatttctttgctgcctgtatttcttctgttgcagtctctaacacactaacatctcttggattctccttccacttgctccatgctctcacctctttcaacctttttcttaacaaacttcaactcattcttcaacatatcaatatcagacaatgttgtggccaatttgatttcaagctcttttgactcatttatctctttaatggcctctttcaacttgttccttgtgttttcaacagcttcaatgtctctcatttcattcaaagcgtccattctggccaattcaaccaccacttgttcctcactgccttcctcagtttttgtgctacctttgagaaggacagcatgttggatctcgatgattcgatttccttctctgctcgcagtctgtcctccaaaacagaagccacatcaaatttgcagcatgtagagcagaatgtctttagttcctttatagggatgtgatgatagggatgtgatgatccaccttcctgttgggtggtagtccctttagttcaaaaaatacttgagcatactcctccatcactgctttcaattgctcttgttcttcttctgaaatttaaggctgatcctcaacatgcgctttgttgttggctgattctgactccaccatccatattattcaagtatgtgaatttcaagagcctcttgattttttatttaattaattattggtttgataggcaaatgttagttttgttagatatgcatgtcaggtttagtcagtatcatcagcaaggctgcacacatcgtccgtttggtgctggccttgaaatatgttctcttgtatttgttacaaatcaattaaaatctacgctcttgcatcttggtttttctgcaacagagtgtgacccatctttctttgtttttaaagatacctctcttcatttatcttttggtgtatgttgatgatatcataatcactggcagttctgtcaacttagtccagcaatttactgtcaaacttcactctaatttttcccttaaacaacttgggaagctggaatattttttgggaattgaagtcaagaccgtaactgatggttctattcttctaactcaaagcaaatagataagaggtcttctacacaaaactaaaatggctgaggcccaacctattgcttccccaatggttcctggatgcaagcccactaaaacaggagcagacctcttctctgatcctgttgaagctcagtagttggagctctccaatactccactgtaaccagacctgagctaagttttgctgtaaacaaagtctgtcaattcatggccaatcctattgaaactcactgggcaacagtgaaaagaattctcaggtaaataaaaggttcgttacaccatggcctacttctcaaagcttctactccaggagctcccattcatattaaggccctatgtgatgcagattcggctgaccctgatgatcgcagatctacttcaggagctgctatttattttggtcctaaccttatattttagtggtcatagacaccagcttaggaatgtgtcgagacttgcaacacagaatgataaaaaccatttacaggtttgttcttttcaatggtgcatctgtcctcatttaactcttttcttgaaatttatttaaaagtatcttgcatccgggtcatagtgtcactggttgcctctgtggattcagtaagtatcatatttaaatgctcgcaattccaaattatcctcatttatatgggtttaggcaaaactcaaggtccctgccttctgaatatgattgattttcttagacttgaaaggcatgattattgtcaaggttcattaagatgaattgtcatgttgaaaacaagaatcaaacctaaatattaaataggagatgaaactgtatgtaattgtgactatgtgaacggtatatccttttttcaggttggaacttatcgtgctacatctctgcaagttaattcgaggcctccgactcccggagttgtgagccgaggaattgctcttgagggtttctgtagtatattggctggtctttggggttctggtactggggcaacaaccttgacagaaaacatgcacacaattgacgtaacaaaggttgcaagtcggaaggtagtggtagttggagcagcattcttgatcatgttctcatttataggtaaaataacaacacttggagacaaaatccattattgaattcaatattcttgtccaacttaataagttttcattcctctccatcattctggctgagatggatctaaggatgtgcagtggtttgattttggttcatttgagtctcaaaatatgactgttaatataagatagattgtatgtacacaggctattttgttgtcttgtccgatctctgttgctttattttgtaggaaaagtgggtgcccttcttgcttccattccactggccttggctgcttctgtactatgtttcatgtgggctcttactgcagcattgggcctctctaatttacagtatagtcaatctgccagcttcaggaacataacaatagttggcgtttcactgttccttggcatgtctatccctgcttattttcaacaataccaggctgaatcaagtctgatactgcccagttatctggttccttatgcagcagcagcagcaagtgggccattccgttcaggcataaagcaagtaagtaccttttgccttaaaatgtaaaaaaaggaacaaacaaaagaaagactggctggtatagcttatagatgaatttgtccatcattaattaagtttgacttaattcacaagcctctaacatcttaacggatttatcctgattgaaactgttatcatgtaaatttgtccttaatgacaaatctttacttttgcttgattttcttgtaaattcagctataacttatttcctcttttcaatggtgaagctgattttcagtgtttttggtggtagaagctgatctacttgtatttttttttcctttgttaaccctgtcattgactggtaaccagttgaaactgagaaataccgctctgagctttctaaagttcgtgttgagcttgaaccttgggaaaaagatttgattgagcataatggaaaacttgaagttgcatgtacagaggctaagcttctaaatgaaaaggtgagaatgacttctcttactttcaagtgctattgttctgtccatgccatcaaattattaatcccctctgctgttaacgtgtataatttaaatttcatctgtgttgtgagattttccacattttatgtccttgttatgcatttaacaaatataaaaaacataaacataaataccaaaaaaaaaaatagctgcctgaagctagcttagtcataagatgatatcttagtttcttccagatataacagtttaccctgataagcaacaacatatccaaaaaagggttaaatcataaaatggactgcacataaaactagtaacacaaatcaaagtttctttcccattcactttaattaaaagggcttctttctgacatgcgtgctcaagattcttggggcatacacttatttatctataacgaattactctatacatgtagagcagaatgtctttagattttcctgtaggtgtctgtataatagaagactattcttgatttaatttgcagcatgaaggtgcttctcaagccttttgcagatgctcaaaagaagatgaaaagcatatcagaaacaattaaatcaaaaactgccaccatttctcaaatcaagagtgatatagaaaagtgcaagcatgaagcttcagaagctcagcaaattgaagaagtaagcaatttcccttcttattcttaattttatttctttagcattttttttctgaggcttttggtgatatcattgctcttgatgaatgaaataataattatatattaatacttttagttttttttattctgtttttcacatctgatattgttttctaataaaaaaatatataaaaagaataaacaataaccaataatttaatgcacaaatccaaatactataaaaacccactgtccttcttccaatatctaataataaaaataatgaaaaacaaattattttatatagtgtgcattaaaaacccactctttattaaatgtcatactaattaatacaattcattaaataaatgaaaaaaaatagctgaaaaatgtttaaagtgcctcttttggatgataaaaaaatgaattctttattgttatataaaagatttgactcgtgtgtcatttcttgttgagtattgttgtatattttattttatctcataccccattagttaaacttgttttatgaatgaagccatgaatgggtttaataacttaaactaatatttaaatttagaagctctaattaatgaactgaattttctctcataatgtgtattaatgatttcttttccaatttattatgcaggaccttgattgacaactcaagagaagaggtaatatataatttttctgtattttgattggaaaataatttagattttcttatgtatatgatggaaaagtatagatttctataaaaagtggtttagttggaatagtgacaactaccttgtattgatgtctttgaagctaccgcaaaaagaaaatttccaaaataaaaaaataaaaaatatgaatctaagacggttcccaggatacccgtcctagtagtttaaaaaaagccttcaaagacggtctccaaacatgaccgtctttgtttgtacccttctaagacggttcaagctacacccgtcttagaaacttaaaaagaaaattaaaaaaaaataaaaaagccttcaaagacggtcttctcagatgaccgtctttgtttggcacccttctaagacggttcaagttacacccgtcttagaaacttaaaaagaaaattaaaaaaaaaaataaaaaagccttcaaagacggtcccctcagatgaccgtctttgtttggtacccttctaagacggttcaagctacacccgtcttagaaacttttacaaaaaaaaaagaaaaaaactttcaaagacggtttgttaaccgtcttaaaaagtgtgtactttcaaagacggtggaatcaaggacgggtgcggaaccgtctttgaaagccttctggaaccgtctttgaaggccttctggacgtattttcaacttctcttcctagctaaagcagtaaaaaacaaacttttctttctaaaaaaaagttcaacttctcctataaaattaaattgaatagttgaatatgaaagtatatcatcaatttaacatatatatatatatatatacatgccagcaattatgaaaaacgtattttcaacttctattcctagctaaagcagtaaaaaacaaacttttctttctaaaaaagttcaacttctcatataaaattaaattgaatagttgaatatgaaagtatatcatcaatttaactttacaacatttatcccttcaatctaattcaaatgcaacatatttttcataggacactgatgtaatgtggttgagaaacccatttataaggttgagtaagaatcagacagaagacctccaaatcagcacagatgcataccttggtgatccttggttagaaaaacatccaatcaacactggattttactttgttaggtcaaacaataagaccatttccctatttgaaacatggtatggccaaaaggataaagccatagcaaaaaaagagcaagatgttctttttgacctcattaaaagtggtataattaaagaattgggacttagggttaggtttttaaacaccctttatttcagtggattttgccaagatagcaaagattttagggaagtcatcacagtccatgccaactgttgtaggagtatcactgcaaaggaggtagatttaaaggcagttcttcgtgattggaagcaatttaggaggttggaggctaattctacgataaatactcgttggactaagcacaaccaatgtcaacaatcttggggaggacctttaaaagtaaagggttaagcatcatggttcatacttgtataatttaatcatgatatccgacatgactcacatacttttttatatattttatttatttgtaggaatcaaaaatattaccaaacaatttataataactcatactatatttaatcaaatgagttaagacttttttgtctttatatataatttaaacaaacatttattctaatttaggaaaggaaaaatttgagttatttttctttgtgcactaaatatgaaaagataaaatttaatacatgtttttttcccgtagaaattgaagagatatgataaaaaaaaatctttatgttcttgcatgtgttttaaaaatatacatatgcaagtaaaactactctcgtatttaaggctcgggtagttctctgtttacaatttcgaaagtattaaaaactaaacttgatttatgttttgagttttcgatttcagttttttttttaaaaaaattgttgtaaattaataatagataaaataagtcaattttttttatctttctccattatgagatcatgttatatataaaaaaaaatattggcacaaaaataattaaacattctaaaaataataaaaaattctacaataaatgttaagactaaaaaaataaaaaataataacatactatatatagttttcatatatatatatatatatatatatataaattgtttgtcaagtttttttttacatatatatagtttgcattatgtaacaatatatgtattttatattctttttagttgttatgtatatttattattattattattatattatttataaattttgctattaatttattatatcacatattatgttttatttaattattattaatattattatcattagtatttaattgtatgttatgttttacttaagaaaaagaaagctattggactgaaatcgaggcccaaaacatcaaaacggataagagaaagaaaaaaaaaacaccctgaaaggaaacacgacccagcccactgttaacatgcgcatggatgcgtgaaatgaagtggcagctgcgaaacccattgagacgacgcaaaaggcagcgatctcagcgtgaacgagaggtctcaacgtgaacatgaaagggttttttttttagatagggtaaaactaacaacaaaattcaacaatccaatttttattgttttgaaataaggataaaactgttttaaaaaaaagtaaaaaatcaattcgatcataattttaccagatacgttgtcgttttaaaattatatcttaaaatctaaaatcgaaatcttaaaccaatacttaaaaaattactgtaaatctcttaccataaattgaccatcccttatattatctcaaaatcagtgacataattgagaaaaatattattcatttaaattatgtgaatattatttattatacatattatttatcttatattcttaattatatttaaaaataaaacttaacaggactcatcaattttctttttgtaaaaaataaatttatcttatttaatattatattattatcttaatattattatttaaaattttttaatttaaaaaattgattgccaaactatttttatttacttttattataacaaaataaaatgtggataacttttattttaattatccccaaagcaatcaaagcatgcttcatttgtctccaaagtaatcaaaacatccatgttggaagagccaaggcgtaactcttggtaaaatcatagcaacgtggataaaataatattataaggttgagagaaaagacagaaacaaaggacatgagttggaatttttaactaacaaaagttaacaattaacaactaatatttttcaatcaataaaaggtaataagaaaattgaataaatattttagtaataaaaggtaataaaatattaaaaaaaaactaaaagctaaggttttaaaaatcactaaaatctacttaacaaaacatatgtttatcaaatagtcaaaaaaacttttcaattagtaaaaaaattaaaaataactaattgaaatgacatgctgaacataacctaagtctcacgaaaaatgtactaagactctaatagacatcatattccacaatacaaaaaatctaagagaaaccattgtaataaagagtctaaaaaaaatactatgaggaaccttgtgagtgcaatggctgacgacctaatttggtgcgacaacaaggttgcaatgaagaagacattagctggttcaagtttgaaggtaaggctgatttgtgtgatgatgacaaaaaatggtgattcaacgatgctggtggatgaaggttgcttcgacttcaacaactgacaatgtcatgagacaaaccaaggaatcacgaacctaaccgtgaaccatgaagacaatgtcatgcaaaaaggggaaaacacaaacataaaaaagaagacaaaccatatttgtacatgagaggttattgattttaaaaaagaatttttattatataatcctttaatcaaaacatccatgttgggagagccaaggcgtaactctttgtagaatcatagcaacatagataaaataatattataaggttgatttcctgtgaagagagaaaagagagaaacaaaggacatgagatggaattctttactaacaaaagttaaccattaacaattaatattgttcaatcagtaatcaagaaattgaataaatattttaggaataaaaaagtaataaaaaaaaaaactagaagctaacgttttaaaaatcgctagaatctacttaaaaaatatatgtttatcaaacagtcaaacaaatttttcaattaataaaaaaattaaaaactaattgaaatgacatgctgaacataacctaagtctcacaaaaaatgtactaagactctaataggcatcatattccataatacaaaaaatctaaaagaaaccattgtaataaagaatctcgaaaaaaaaatactatgaggaaccttgggagtgcaatggctgacaacctagtttggtgcgacaacaagattacaatgaagaagacgttggttggttcaagtttgaaggtgaggttgatttgtgtaatgatgacaaaaaatggtgattcaacgatgctggtggacgaaggttgcttcaacctcaacaactgacaatgtcgtgagacaaaccaagggagctcgaaccgaactgcaaatcagtgacaccaacaccgacgtactcgataacgtgaagacaatatcatgcaaaaaggggaaaacacaaacataaaaaagaagcgcaaaccatatttgtacatgagaggttattgattttaaaaatgaattttattatctaatcttataatttgatttttaaattgtttgagagagaaaatacataagtgcttgtgtccaatagtttgagccatgtttgtcgctacatgtgcaactatttgagccttgtacttttaactaagatcggactcaagcctaacaaaactaagcttggctcaacctatttctagacattagtttttttgttttgttttaaccctcgggttcatcaaggcaaatgatcctgactaatataaagtttaacttgagagataaataaagtctaataaataattatttcatcaataatcaaattcaagtagtacccgaataattcaaccttaacttcaacatattaactatttatatctaatcacgtggttggtcattaatttactttattagttttttttgtattacacaatacttttcgcaatttatttacaattaattacgaatgaaatcaaatgcttaaataatacacaaagttgtaataaatatacttattatttaaatgaaattttaaaactgttcttaattccaactttttaattaaaaacaaaaattacttatacgatatatttcacttttttatttattttttattttttaaatgtcagaggagatagtttataaaaaatatgatgcaaattagagttcaaaattttgaaataattatattaatttttatatatttaaaattgttttgtattaaatgattattttataaaaattattaattaaattatatgccttttaaaactgcttttcgttagattaaattttaattcaaaagtaattcttctctattcaatcgagagtgctaattttattttggataaacgctaaaggctcatacagatttagccaaattatcagcaagtcgatgaaatccagttaaaatgtgacatctatcaaccaattatatataaaatattatttgactttaacttttaaagttttattctttttctaactttatcctccttttattctctttcttcaaaacatgtaccgcaccaacggtgggacgcatgtggatgtttggcttggctagagataatgtgaaaaatgttagtgttgagttatggactttgtttatgatagagggagtcatggtctttcaaactttttgaaaatttacaaatacacattatataatatatacttaaagtgataaaaagtttttatttagtgtcatttttcatctattatattcttcaattattttattttaatatattaaattttaaaaattattttaattttttatgtttttgaaatatattatttttgtcttttttttcaattttttagaaaaattagtgttatgttaacttttaaattttttttaaaatcaaaataatatgttttgaaacataaaagattaaaataaaacttttaaatttaatgtatcaaagcaaaacaattgataaacatactgaaaaaaaaaaggtgaaattaagtcttttaaaataattaactttacttattaacgactaaaaatcgccattatctttcttttattttttaaaaaataaataactaaaaaaatcatcatctcctataaacagtgcaaagagggatcgacggtgagtttcattagaagatgattatgattgacctgactggtcaagcctcatccacaaccgggctttgtcagtcttcttcgccttcatcaacacattgttgccgatgacgatgatgagacaattgttgtccttaggtgaggcggcaattccaaccatgtagggaggttgcggtgaagacaaaagcgaggataaggcaacaatatttttgggtcagtgacgagaggtagaacgatagacggagaaaagagtcttatccattatgattgtgaataattggtgaatgatattattattgttattaaatgaataataataataataataataataataataataataataataataataataggagagtgaaggttgttgttgtatgtggtttcaaatccatcttttcttttttacttagtgatttttaatttcttaaataaaaaatatagtgacatttttagccgctattatgttaacttattattttaaaaattaaaacattgatgggcactaacgtttctaatgaaaatttgaaaaaaaaaatgatatattttgaaaacataaaaaacaataataaaacttttaaatataatatactaaagtgaaacaactgttaaacataataaactaaaaataacattaaaccattttaaaatttaaaagttaacataatactaacatttttaaccgaaaattaaaaaattgaccaaaataatacatttcaaaaacataaaagaccaaaaataaaacatttaaaatttaatgtaccaaataaaataactacaaaatataatggaaaaaattacattaattcaaaagtttgtaatgatataattttatactctacattatataacacatacatttataatgtatgactttcggttagttttggtcgccaaatgttttggtaattcggacttggaggctgctagggtatttcattgttttattcagtatatatgattttttaagagattcagtatatatgttgcagtggcttttatttggtatatataaaagataatttattaacaaaaagaataatagaaaagcttcttatacaatcacacaaacatattctctttcatctttaatttatattttgttaagcaactagatattgaaaaatgtattgacagtttaattaagaaaataaattgttttaaaaataatattttaaaattaaaatgaatttaagaccaactttccatcctacctcctttacgttcttgacgattcatctttgtctccgtagaatctttcattgacatcttttgatcatcttctccattacttagaaaggccatcagctataataggttatagtctctagcttcgtaacttagctcccttcatccacttattcactcctctcttgctcaactagaagacagggtctaaaggtacaagaggattatgaaatagaatacgcttgctttggcgattcctacgactacttatatatatgactattccgatttctatttctgtggtgcttgaaatatttaattcacatacattttaaatgctttaaattttaaaatcccttatacaaccactacataagttaatttctaatcatttacttcaatgttatttgtttatcatttgtgtttatattggaatttaaaatttagagatatattatgacattacatatttaatttaagtttaaccattaaaaatttggtttaattgtatttttatcctcaacttttaaattgttttttaaattttatttttaatttttgtacttattaatcaaaaaattattgagataaacttaacaagaaacaatgaaactttgaaattgaaggaggaagtttctcggttcaaaattcgtgaattttgagctgatttgctaatttaatgattattatagttggcagtttagatacccaccccaccgtattatatttttccatgtgataagatgttatttattatttatatcacttgtgaaagaaaaaaaacatagttgccaatttaacattcctccatgcaatatgttttccagaacaatatgtaattgaacataagtgtcttaactaaaaaataaaataaaataaaatttccagtacttgaatgcatagatgatgctgaatcttagttttagtggcaatggcttacaagagaaattcctcctactttggaggatctttgtaagactaacaataatacttgactttaggaaacagaattttgtgaaatttcatcattattaccaaagaaataaaattgaaccagtttgcccagcacatactgaatcattggatacaatgggcatactaatagaattgaattgaatcaataataacaatagaattgaattgaatcaataataaaaatataataaattgagatataaggttgatttggtgattaaaaaaaagagaatatagaagttgtagatttgaatttctcccactaacatgttaacaaaaactaataactaacatttgtcgataaaaagtaatataattggttttacaaaaaagaaaaaccaatccgccatcacatcattgacaagataaacaattttggtaacaataaccatgatcaaaatcagacacgcagacactacaaaaaaaaataggtatttccgatggtcaaaattcgtcgctaacatctaaaatccgtcaataacttaaaatttttgacagaaaatctatctataaaatggtcataggaaattttaaccgatggatttttgttgcccgtcgatagttttcgacgaaaatatccgacggtaagatatgtcaaaaattaccgatggaataggtatgtcggaaatcaccgacgaattttccatcggtaattttccacaatatatctggcggtaatttctgacaaaaattagtcagtaaatttcccgtagatatgtaacaccccgtatgcatccggtatattaacaattacttaatcagatttgcgcagcaactaatttaattaagaaccacagaagcgatttcgaaaaccatatttcttgattcattatgtatggtacgtaacttcaattaaatatacaaatacctatacactaaagtcagcctcattgatcccaaataacataaagaacgacagatacatcatcaggagaataaaccacatgtatatacatatacatcatctcaaccaccactctggcgatacaaaaaaataggcattcattgccatgatctcacaaatcacatcctcacacgagggcatacaaaacatgtagtgtctatacaacataaacataaacagagtccatcaaatgtgtacacacacatctttcctctacaggggtacaaaatacatcaaaacaaaaagagttgagccatgaagctctcatcacactgccaagcagctacacagaatctgtctctactggggcatccctccctgagacctatcatctttgccagatgaatcacctgcaaaatataatccccacacggggtgagatacaatctcaataagcttagggctcttggaggcttctcctccctcttggctcacttccatgatacacaacattaaaggcatcacaatcaattggccacctgaccctcacaacaatacatagccatcacctagctctaatgtatatctgtggtactacgcccgccacaagatgcatcatcatcagcatctaggactctcagtccccagtgtgagaccgaaacttacacccgtgccatctcatcgggagctaccccttttcacatggatacacgtatatggcacctccgagaataggcttcaactgcgacgggaccacctatctcttggtcttaagggatcatcatcaccctttacgtgagcaaaccaaactaggagttgcgctctactcctagagaggtccatatctatctaactggccagaagatctattcaactgataaccatacacacaaagcataaaatcatgcatatatattatcatgaggaaactgtaacaaccaattcaatgcacatgcatcatgtatgcaaccattactccctcagagtatgatggaacacaggcaatggaaaacactccccaagagcaaagagcttacctggcaatgcagtgctctgctatccaatcccagcactgtgatctacgccactgacaccctcggtgtcacgccctatacaaaggcacacaagcaaaatcaataaacaacctaaccttacaaggcattaagtacataataacagttcttaatcgttaaaaaggaaagaaacattattcctttccatttaaacctcttagtcttctatcttaaggttatcagaactaaccacctaatagacaactcacagaccctcagtaggatctatctcggcctaaccaagtcactagagtctcccaaagattcttcatcaaccaattcagagaattcaacactatacaggcccaaaactcaaggattaacaatatggctaaaacagttacttcaacacatcaccgtttatatagcttctagggcacatattgtacaagcatcaaggctcatgcatgtcctacaatcaccaatttaaccaacattttcctacacatgcatttctcatagccaaaatccaaagtccataaaatcaatatttcaaagctaattcttcgtcacaacaaactcctaaacatacttttctaaaggacccatgtctaattacagctctaactcaaaatggtcactattcacctcaagaacaatttcacaaatcaaatggtaaaacttgagtttcttacctctaaacagtcaagaaatgttagaggatcacttctccaagtgtgggagttcgcaaatcgcctcctttccccgccaaactcaagttttgtgaagttccctagagaatgcgatctctccgtttgatggtttttagggaaaagtgatgaaggattctagctcatatgatgattccctacaagtttcatggtggttggaaggtgtttagatgaagatatggagcttcccgattgctctaatggcagaaaaggtccagaggaagaagaaggaagggttttggcccccaaaatcgcgtaaataaccttttatagtggccctgtcagagttcccgcgctgatcgccccaaactcgcgctaacggcgccacatcccaaaggaaattggcttcctagagcacttctggcgctactggcaccaattcccagtacatctggcgctaacagcgccaatcccacgctaacagcaccagattccagccgtcgctaattccgtcgctaacactttttgcgacagaatattgtaaatttaaagttctctttctttctttttcttttatttatttagccttggttattataagatatatatgttgaaaattaccaacagaaaaatctctttaaatacaatcaattttcattcacacattagctaattcaactactagcaattaataaccaagagttagtatccattcatccattattcacataacaaaaacatagttgcacatcacaaaaaattaagtcatcatatttactaccacagtcatatcaattaattatgaacacaacttatctaggattcataaattactcaatgcatgtaattctaacaaaccaattatgagaatgccttattcctgcacaaaatattcattattcacatggcaccaataaacatatacacttatagtcactgaacccacatagcttataatttacttggaaacaagtacttcaattatacgttcatgcacaaatatttatggggaatgctagttatgtacaacaaatttattcaccatttttttacacaaaaggggtgaactcgcatttacttagtttaaaatctgaaaggaaagactcattcaaaccttgacagtagtgtttcattaaacttactttcaaaccaaccctttttcaaacaccaaatcacatccacactgctactaattattgcaaaaaaagccttatagtaacatagatagagagaaataaaataattagtatatataacaggcattgacattacgggctaattaactagcaaaagctacactcaacagtcactgcctgcaactacagtgtgttttgtgtatattgcatatatcaacaattgaaggaacctgagactcagctctctgatgatgcacacaaagagtgacacgctaagacagtggttaattattatgaattggttctttttcttatcaactaaatgcaaaaaaaaaaaatgaaaggtagtctgagagcattgaagtccctcgatttcaatcaacaacagttcaaaaatccattgcagatcccacatatatatcgagggaaacggtaatcttatcggtgacctcttgagaaaaatgttatgtaaagacaaaaaactcctagttcatcaaatttgatcaatactcaacttcaattaaattcgtttaaaaacatataattttgaatgagctaaatttctagaacacatgttgaaataatgaattttcaacacaatttcttgatgcatgggtgacgtacatctgacacatgaagtgtaatggtaagcaatagaagcatccaaagcttgtttaatccaaggatgacgtatgttattgacaacactattaatgagcgaggaatctaaataattattttaatatatatatattaattaaaaacaaacacgatcatattgaataacatgtatttcatattaattaaaagtccaatggagatctaaatctgttctaacctgatcatattcaaaatttcaaatgataagaaacctgtgaaatagaaattcatattttgatggaagaaataataacattcaaacatatgcttgtgtgatcaaacatatgtaaccaaaaacttgcatggaaatatttgggaagtgtctttgatttggaatcacctatcttgtagtgccactttggatgaaggacaaccctgaattgtaaccatcaatgtacaaccttgttaatgtccaacgataacaattggtgcagaaaagaaaactagacagtctaacacaaatttagagatacattgagaagaacaaaataaaacaataaataatttttaaatcatacatgaaagtgaaacccctactaagctatagacagaaatatcaataacctatatgtattctcatctaaaaggcttaaataatatcaagaataattccaaatcaagtgagaagcacataccagcatgtcaagtgaaaagcacataccaacattatccaattaccgacaaaaactctttccagaatgatacaacaaatatcaaatgcaaaaaataagaaaataattccattctaccaagaaggtttgtacggattagctatgttaagaaaatgacaaggtaacataagtaggtgtgcataaacaaacctcgcccacactatactcccagtattatttttctttaattacagcagataaatcagttagagattctaagtaaagagaattgacttctgaaatagaaattcattttttggggcacaccaatggtaagtaatgttgctgataaaaaaaagcaagtaatgcaatatttgaatgctaacttactgaaatagcaagtaaacattttaatactaatagaaggcatgacataaaataacttgactactaagttcatttgggctcacaattaccttcaggaaaatgcttcatatatatatgttattgcaatagaatgagtgtataagacatataatttaactaatcaattaaagacactcaaaagttttggaaagcaacaaggaacattaaacaaaagaataatagagagaagactaagtcaagagacttatataatagagaattaatttggttttagcttgtgtggttaaccataaagcctatgtatgtagttctagtgtgggctttgatgaaaataaaaggaaacaaaactacctgcacatggtttaaatgatttagaaaaagcctatgatagggttccatgagaaactttgtgccttgtggaaaatttataattagttaaccgtataaaagttatttattctattagtgtataaaagttcaagtcttaacttatgcaaaactactaaactagcacgatgcatgcaaccatattatgttttaatcaaattcaaactttttttataaaattttcaagctcgtatatgtgtgtgtatatatatatatatatatatatatatatatatataagtactacttaacattttgtcaaaaaaaactaattaatattatttcataaaaaaacattttcctcttatatatgattgtgtgttaatacttgacattacaattccctttaaaaataaacttaaacaaactaatcttttttaacttaatggaagtttttattttgaaaaactaattcaattatatatatatatatattaaaaaatagtacaaaaataggatgaaggtgccaggggaaccattcccacaaaggcatatgagtaatatgcccgagagaaacaggaacatgtccatcctcttcctttcattattggtgaaagtgaaatttgtcatgtaaaaagaagataggttagataaagtttacaatagaaaatcttgctgctaaaatgcaaaattttaatttcacatcccaaaataattaactcaccaaaatttacagtgattaacctggtcaatgcagttaccaacccaaattctgaggtaatggctcaaatcaagattatggcaagtgtctgctttaattgtaacaagtatacttatataataattattaacgagtcagagttctcaatcacacatgataataaatataagaaacaaagaaacaaaagaaattgagcgagcaaaatgtacacatcatctgttcatacctatcatgttggaattcacaattatttctcccttataagaatagggcttaaaacttgtctccacttttccatcatcacaattgatggatggcttgggataaaatctgcaccaagaaaatataaaatgaaatctctgttagatttaactacttatatcatactctataatatattaagtatatatggtaggaaaataaatttattatcccaataaggactattggagctttccctgttggatatgcctgccaatggcacacaaatccatgcaagcactaattttccaaaaataaaacgaaaagtaaaggaaggaagccacagaagtatctagtgacttttctttcttcattcggaagtcagaagaaaacaagaaacatacaactaagggggcatccttttttctgcaaataattagattacttgatctataagcccaaagaaagctgcaatcagatatagttaccaacctgagaaccactacatactaaactatcatttggagcaaaatgcttaagaaattggcatatttaaaagactagaaatttgtgactaactataatcatcaacaaaagggataaatggattttgaattgtcgataaaataaaaattaggaatgagtatagtatacccttagacaaatatgaaaataaatcttctacaatacacgtactaccccaaggtaaaaggagcaaaacaaaaaacataggcaatcagtttatcccacggtccaaagattggcatgaaatcataaaaaagaacatcaaacctttaatgggtagcccaagcatactgcagcagaaacattgatgtctttcatgctagccaccatgcaaccaactctacaacaaaataaacacaagatacatcatgtcataaatatcttgatactataaactgaaataagacttcccagtccaacataaatatgtcctgttagaatatccagaatatattatagaatatttcttatgattagtttccttaatttttctagtttctatattccctgatatatcatgatttgtattatttttagtcaggattgattacaacaaataagactagtgggcagaaaaatcaatataatattttttaataaaaaattacgaatttgaagttgtttggaaatatattacaaatctggggtagggagacacgctcaaattgggcgtgttacccccttgagtcacgcctaaattgggcgtgactaactccgtcgctaattcgctcgctaatagtttttgcaacggaatattatggttttttatttttttatatttgcgaccacagtattctgtcgcaaaaactgttagcaactgaaataaaaaccaaaattagtgtattttaatttttgacgtaaaatatcatttaatatcatttattgttattttatctaatttgaaagtatttttagaccgatcttcatcatagatatgatcttttttactttttttaatattattttttagtatatttttttaattttatatgattttatttaatatatttggatttttggtatatataatttttaatatatttttatttaatataatttctaaatttttatacgattttgtttaatattttttggatttttatataactaatttttaatataatattttattcaataaaaattttcaattttattttggaatttgaaaaaattgaaatttttattttttaaaattgtaaataattttttaatatagaaagcattttaaataaaatattatattttgatacttctcattttttatatcgagattacccctattaaacacattatcctcatccctctcataatctctttcatcttctcataatttgataattctctttcaaaaaagtagaagacaatccccttttctctttttgttccagtcaaaagcatgtagtcgactaattagtcatcgaagctacaccgaaactcagactttttgtcaatcggtgactcaattgtataaaattagtgtggtcaaaacatatacatccaaacgaaacatatacatccaaacgagaaagggaattagaaatgatcgtccatatttcatggtgaatgatcaatcgtccgagtaagttggattctgtgatttctttcttcatcatcatcaccatctttatctctctgggtaagcacaatgcaattctttgcatttcaatttgattcactttgtctcacgcagttccactcctatttctagagttttgcaatgtttcaccgctccaagtgcactttggaattaatggggtgctacaattccaattattgtatggtgagtgcactttgggatgagtgaaacgagtggtaaagtatggaataagtgcagaaagttaggaatgaatgtgctttgggataaatggggttattatataaaagatccaaaaaatattaaacaaaaccatataaaaatttagaatatcgaaaaaagttacaatgacgtacagtatgtccttcaaatggtctaacttttgatagaaatgtctgattgaggtgtacgatatgtcgaaatgctcgaaattaaagaagtaattaaaaaataaataatgcattaaattaactgattaaataattaaaaagtagaaaacaaggaaatttttggatgattgaagattaaatcctattttgatgcacttagagacattttttggaaaaaatagttgaccaaatctcctttggacatttacttaaggcttttctctcaattccgagcgttttgacacaaactacgcctcaatcggacattcctatcaaaagttatgatcgttcaaagtttatatacacatcgcttcactaatgcgtgacacgtgttgtcacaggtgaaacacgctcaatttaggcatgacccagggggtaacgcgccaatttgggagtgactcctgcccagatttgtaatatgtttccaaacaacccaaattcgtattttttattaaaaaagtattatattgatttttctgccaaggctagtgctttagattttatgaacaacaccatcacactgtagcacattacaatactcaagtacatattatccaaagtctctattatcaccttgcctccctcaattcataaaccataattccaacatatccaaatttggaaaaaaaaaaagaggaatgcctacttgaacccattgatttgcctgcaagtatagggatgacaagggtacttagttgagtttccttgacaaaatttgagtgaaactccaccagtttttccgccttgggaggagccttctttttcgcagacatgtctagtgaatgacaaacccattaaattcacttcgagttaacacaatacaattatctcgaggttcaaacaactagagatcatgcactttttaaaaaataaaatgaaaatgaaaaatggaatacaatggatatagttagaaacaaactcaaaaggatagtcaaaagtgacaacatcaacagcgtacagtgcctcctttaacatgttcttccatctatcaaaaaaatagagacaataaagcctataacaagatttaacgcattatctcgaggtttaaaataaaatccatgaattgtaaggatgatacctttgcatccaattagaagaggaagaagcacggcaccatgagcgaagatcacaaccgatgacaacgttgaactttagtctcgctgtctttgctctcacgacgccgttttgcaggtggtaacgaatccttgccttcggcatagagaaatcccccaatcaaaaccctatcccgctaaatttcactgcacacactattaaattctaatttcgagccaaatgacagacaagagaatgcagtgttcaccttctcgttttggaatttggatttttttttaaattataaaatcaatttaaaattaactatattaagaatgtactttaaaacatattaaaatggccgatcaattgaaatcagattgaatgatatttattataattttttatcatatatttttttaaaaaatttaaaattaagacggagttagggtgagaaaggcaaacatgtttctcaccatggatattttaaaaaaaaactgttgatttttttagttatcatgatgactcaaatgtttttttttttcctttactttaagcacttttttgaagagtttacatttattttttaaaaaaaaaaaaaaaaaaaaaaaaaaaaaaaaaaaaaattcctttactttaagcacaatatttttatgaatgattcatgctaatgatcattagtttagaaatcatttttttctaaaagtactttagagcttacatcaatatgcctaaatgtattggtgaatactgttgtttatcttttcattaattaaattcaaaaacacaccttcattggatttttttataaaatatcgtgctaaatgtatttgtacaaaacaacactgtaactaatttaaaattcacgtgtctgaaaaaaagcactataataaagttgaaaattgttattccatttattcattgatacacacaatacaaattattaaatatatgatattaaatatttaaattacatataaaatgaatattgaataatttttattttttatatcaaatacttttttctgtcattattttttttatttcttgaagaagggttttgttttcttttcttttcttaatagatatatgaatttttttatatgatattttatataaaatgtaatttaaattttttgtcattaatgatctattttctttaaaaatatatatttttatattgttgattaatgactattttttattcgcattcaattgtatctctcatttagtaacaacttctgcttaattttttaagttctgattctttactttaacttataagcaacttttaagtccaaaaaaaggtagcccaaacaaaacttaatcgaaaattataatttaattattttattatatttttcctaacttaattataactcaattatctttattaattttcttaaattattttataactttatcaatataatatttaataattatttttattcaagataagtaaaagaggaccttaaaaggaaatatatgaaattaaaaaaaaaaacttaaccttaactcttttacatattcaagtgcttacatatttatatatgtcagtacatgacttattcttataatataattaatttatgttttaaaaaatatatttaatcttaaattaatttgtataaaatgaaaaattattaatttatcaacgtgtgcatcacacgataacacactaataagttttaattaattattacgctttgattagtatatatgtcacactaaagtcatattgaaccttattgaattttaatcaatcattagtgtatatgttattctaaagtgccttaattgatttcaatcaatcattatatatcacatactttttctaatatttttactttttgacacatgatgggaaaaaaacttttatttacttgttagtcattcacttacctaattatggattcatctctagtgtgaaagaattcatttaaattgattttatgaaaaaaatggaattagtttaaaataattaatttagaaaatcattttacgtacattttaaataaattttattattttatagaaaatattaaaagtatcaataaaagtggaaagcatgtccgatcgaataaattttattatgaattcaaaataaagggtgtgatataactcaaccatttctgacagaatatatttcgtcgaaaaaatctgtcgctaacttaaacagttccaacaaattattttctgtgggaaatgttttgtcgaaaataccattttttgtagtgagacaataccaactaccaagcacttcaaaggtgtcgaagatcgtagtctcatcgaactgttggaatcgaagttctttcacttcaaaaacttctcatacacatagtcactagagtggtgacaatgtgtgaatggttgtaaggttgttaacatagttatttttcgtttgtcgaaaaaatggtctttgataaagtattgaagattagtcttttaatagattattttgactaagtgtcaaaatatagtattttgactaagtgtcaaaatatagtattttgactaactgtacgatggtagaagaaatgaagatttgaaaagcatcaagaaataaaaaaatcaatagtgaaaattgaagatataagtcatcaagggtgaaaattgaagacaaaagtcatcgacaataaagatgatgactgcaagttactggaaattatttggtaagttataggtatgtaggaactattgtctataaatactaattcgtatcatggtaatataatatgattcaacaatgatccaatgacttcaaatatcttttgcaatagatgaaagactcaatgaccaaagtaagactgaaaaagaactaagaagccttttcaaagtttaatcatgcaagtgtacaaaccaagaattgtctcatttgtataacttgaagataaattaaaagacaataatttgaagagcacaaagagtccaaaagtttatactcaatatgcaactatggactaaagtttatttggatagattatataacttttggtctaaagaattaattaaggccattttctaattttcttaaattttcgtattttattttcatgtaataagttcagatggttgttgacatcttttaagtcagttttatgattttaggcttcccgagttattataatggttaacgggttttattgctagttgatgtttaacattggtggaaatttaattctaagtgagaattaattcctagtgggatgtttagaaggaagcctagcttataaatagtagaagctttgtagcttttagtagatttgaatttgaatgaaagtttgagttttctcccttttgtgagagctttccttggttcttgggtaaataactaaatttgatattatcaaggcaacttgtgatcaaatgtatgcttatcactcatcttctcacctatttcttgagtgtggtgtcaatatccttcattaaaagaaagctaagtcaatttctaagtctgaaaacttcaaggcaattcgtcccattttcatgtttatagcataataaggttggaacatgtaatacctcatatcctcttaagtccacatgacgctcataagtccactcaacatttacgattgcgggttagacaatgttttcaaccaccatttcaattccaatattttacttttttcatcaactaactttatttattttcacttatatttattgcacatcttattctcatcctttctcattttatattacttttatttccacaacatcttctcttacttaatacatatccatagtttgttgattgtacttgcaaccatatattttaaatcaactaaacataaaatttaacacatagacccatgacaaagggcctaccaagaggataaaagacctccaaaagaataattgtctctttcctcgaatatactatgagattatgtttgctaatgaaaacaagcgcaattttcaccgttaacaacaataagggtaaaatttggaaagaacaaaaattaaaatgttagtttcttaccattacctttgttatgtaaaatctgtctaagttatgaaatttatataatttcgatgaacttgtctcaaaagaaaatgaagaatgcattaaagaattatcaatatttggagtaaaattgaggaattgtattcgtcatcaaaagaattcattgtcaaaattgctgttgttgataactctattaaagcatgcgcgacagttaaaagtgctaagaaacaagattgtttcgaaactcgaattatcaattgaagcagtcatagaagaagttacatggagtcatcaaatgaacattagatctgtgcatttagaaatattgttgtatacgtgtgtcataaaattctaagtatttgaaatttataaataagacctctgactatcagtttttggtagattgaattattatcacttaggcatggcaacggggcggggcggggacgggtattgcattcccgtcccgccccgtcccgttccccgccgggttttaaaacccatccccatccccgtccccgcttggggtcgggtttttcccgcctcgtcccaccccgctatttgattaaaatttaaaaaataaaaaaattaatttaacttttttattgaaaaatcggatgaaaaagttaattatgtaacaaaaaataataataacaaacccacatttaaaatatgggatcataattttaaaattacaaaacaaaatcaatcaattcaattaaaaaaattagaaaataatatatatttttatttttttattttttaatattattattacggggcggggggcgggggcgggtatcagtaaccccatacccgccccgcccccgctgttggctatcggggaaaacccgaacccgaacccaaacccgaacccgaaaaattcggtttttccccattaaaatcgggacggattcgggcgggtacccacaggttcggatcccgctgccatgcctattatcacttaacttcttaaacaccgacaacgttgtacatcaaagttagctactggttcataaggtcatcgtgtatgtatttattctcacttttaatgaattcgtgcttctttattttactacatctttttaaccttttacttatttcaatctttattttatctcaaattcttaactatttaaatctctactcctgtttactatcaaaattactattgaaatctaacaattatgaaaattaccttttaaatcaaaaatactattataaaatctatttacaatctgtcttataaaccattatatgacattattgtagttatttatcgatattttttttatcaaaaatcattatcattatatgtattaaatattagacaatcctctaataagttgaaatgaaattgtttctttgatgaaaaagaacttccactcgagaatacattctatgtcttatatttaaatatttatttaataaaatcatttagtgaaaattactcctttacaataataaactatcttcgaaaaataaattatgaatttcattcacttacaaagttttttgaatttgatggaagaatcaaaattacaaatataaaactaaagaactaaatacttttattttaaaatagatgaattgaaattgcagaattttataaataaaaacactaaatatctctattttataaaaaaaaattaaaattatatatttaaaaaataagagatcaaaatttaagccaaaatttaatagacaagtgtcaaattttcaatggttagaaggattattcgggatcttccattcggaggctctagcatctctcatcgatctcgctctcaaagttctctctgcctccttcgctggggttttgttttgtttcgattctcgttctttagggttttctcatcccttttcaatccccaattacccttttctttgatcattcagtgttttcttctctttcacttctaatttcgatttcatcgttaggtttttccttggaaccctcaatctcgcaaaaccagcggttcaattcagcttccctacaatctagggtttcgtttcgaaaatgcctccgaagacggcgaagcgagggtccgcgtcgagcgcctcgaagaggggtggcagaggtggcaggggaaccccgaaggctgcacagaaccaacagcaacatgaacctgcggaggagaccgtgaaggttgaagagaaacaacaacccgtagttgttgttgttgctgaggaggaacaacagaaggtggtggtggaagaagagaatcctgctgttgaagagaaacagcttgtggttgaagagaacgaatctgctgtggttgttgaggataaggctattgacatgaatcaaatggctccggaggctgtggaagaagcgtcccatgcggctaatgggttgagcgtggcgaaaagtaagtttcttttctttactcttaagtgattaagataagatttttagggtttcttttagttaggatgggggcagggggttgtgaagtttagggttttgattgtgtttccgagttgagattaatttggttgtaatgaaggttttaaattgcaattatggttatggtttcataactttcattgtgatccttgatattgcgggaaattggaacaaatgcggccagtgcggtcacttgcggttgcagtttcgccacgatcattgggaaattgggacaaatgcagctgatgcggttgctattttgccccagtccttgatattgggacaaatgcagccaccaaaaattgggataatgtggctgcatcgccgcttctggttgcagttttgtctcaatccttgatattgggggaaattggggcaaatgtgtggccaccccaaaaaccttgtagttgtcgccaaaatcatggtggctaaccttttattaaaacctcggtcataattatttttgggttcttatcttgtgaaatttacattgttttagttcccttaggatatattaatctgattttttaatttttttttgaaatgttagtgaatatatgatgtttgatagatctggtctctcctctttgtgtttgctattatgttttggtttgaaggaaatgtactagctaatagcaggaaagctattgcacgatgtatttctccatgaatgtttaaatgataatagttgttcctttgcctctctgctagatgttggaattgagttggggggctattgattggcatgcaacccattcctgttctttagatgataaactttgcatatatttttcggttttttggttaaagttctatttcagttcatttgtgtgttagtgtgctgtcatgagaatagtttcaactaggaatggtgagattgattatggggtgtggagtaccctaatttaatgaacactatgatgctggaaaagtttggtctgttttgacggggatcatttggtatctttatttttgacagacgatgaagaggaggttaaggagtccatagatgaatatgagaaagatgaacgcttagatttggaggataatgatcctgagtatgaacctgaggagtatggtggagttgattatgatgagaaggaaattgaacaagatgagggtcatgaggtaggaaatgaagtagaggaagaagaggctgaagataatgtaggtgaagaagagggtgatacaggtgaggaagaagtcgaagatgttcatgacgaacttgagggtgaagaggagcatgagcatgctggtgagagcatgagcatccagactttgctgacgttgaggaagaggaacaccgagaagttgtgaaggagaggcaaaagcggaaagaatttgaagtttttgttgggggcttggacaaggatgccactgagagtgatctgaggaaggcttttggtgaagttggggtggttacagaggtcaggttgatgatgaaccctcagactaaaaagaacaagggatttgcattcttgcgttttgaaactgtggagcaagcaaaacgagctgtagcagagctaaaaaatccagtggtaattttttttatcttctcaatgttagaatagacttaaaactaaagccgaattaaattacatgtttttcatcaccccaatttcagattaatggcaaacaatgtggtgtgactcctagtcaggacagtgataccctctatttgggaaacatatgcaagacatggacaaaggaagctgtaagttaatgtttctgggtctaatttttgcaccttctgacctcaaacaccttggttgtgtttgatagtttttttttttctacattcaagtctgctgagttttgattatgaatgaaaattctggtgcagttaaaagagaagttgaagcattatggagtcaccaatgttgaggatttaactttggtagaagatactaatgatgaaggaaagaaccgtggatttgcatttttggaatttccttctcgttctgaagcaatggatgcctttaagcgactgcagaggagggatgttgtatttggagttgataagcctgcaaaagtttcttttgcagatcctttattgatccgggtgatgaaattatggcacaggtattttctaaatccaattccttggtttaacgagggatttttaaatggaacccacatacatggttctctggccttctgctgaagcttgggttgctgtaaacattgctgctgggttccaacaccaacagtggttaatttttggttgtctatattttggatattgtatgactttgttttaaattgtagtcacattggctgggagcattttcccacaattttctgcagttttgttggtaatcacaaattcacaatgtgcttggtaacctcagtttaaaactaaactcatcatttatattaaagaaaccacttatggttgatcattaaattactatattctgcaatttttattgaatttacttttaagggtagtcagacacttcagtagtgaccagctatccttgtagcgtggtctttggtgtttagatactattgactctaatttactgataaagtgtgtttaagttgcaggttaaaactgtgtttattgatgcattgcctccttcatgggatgaagattatgtccgggatcttctcaagaaatatggtgagattgaaaagattgagcttgccaggaacatgcctgctgctcgtaggaaggactacgggtttgttacatttggctcacatgatgctgctgtaaaatgtgctgatagtattacaggcacagagttgggtgagggagacaagaaggtctgtcttggatttaataaactgtatatgaccaacagttaaatggggcatttttataatgcttttgcttctttcaggcaaaagttagagcaaggttgtctaggccactccagagaggccgcggaaaacatattagtcgtggggatatcgttctagtcggggatctggaatgatgacgcggccttcatggagccgacctgcacctcgttctttccttctcgtagtgtaagaggagttggaagtcgtgctccacctgtgagccggttagtgtgagagatagacgccctatgttttccataccagcaagaagtaggccagtgcctcctccatctagatcttatgataggagaccagttggtatgtggtatacaattattttaccaaatagactggttggttgttactattgttcattctttttttataacattataaactattgtattatcttgttagctcctgcatatccaaaaagtagcatgaagagagattatggtcggcgtgaggatatacctcctccaagaagtagagttgctgtagattatggctcaagggttgcttctgaaagacgaacatcttacagggattatcctgcccgtggtcctggctacgctgagctccctagaagcacatctcgtgctgcaccaaggagaggctatgtggatgatgggtatggccaaagatttgagagggctcctcctccacccctcctccccatctaagttaccgtgaaggacgtccccgagattatgatgctctgtctggctcaaaacgttcttatgctgctatagttagtatttttctttgtatttattataattgctctgtttttttaaacttgattttgttctctaattatgaatgaaattatttgcttttcatttttaatcaggatgatgttcctccacgatatgctgatactggtgctcgccaatcaagagctcgactagactatgactatggtggtagtgcttcacagtatggagatgcttatggtgataggttagttttgtctaatatttaaggttttatgcattttttcttccctaagccaattattgtgatgcaaataattccatgcttttgattggtagacttggaagatctagtatgggatatggtggtggcagcagaagttctatttccagtcaagattcacatgggttgtatagcagtcgacagggcatgagttatggaggaggtggatttttgctaatagtctgatttattgttgtcggcatcgaatctttgtttcttacttttgacgtgttccatgtcaggttcttttggtagtggtgatgttggtggcatgtattcatcaagttatggtggtgattacatttctcgtggaagtgatgtaatgatcctggtctttcttagtcgctataggaagtagtgttatacatgcatatattttgggtttattcttatttattgtttttcctgtgctgtaggttggtggcagctcatattcatcaatgtattctggaaggggtgtgggtggtggtagcagttatatgggtggtggcggatcaggatcttattattgaggtaagtcatctgataacttcttgggattgcattttgtggagtacatcaggatgcatccaatataagtttatatttttctgagagatatctctatcctcgaaatagcatctcttatttttttcacaagtgccggcgaaggttgcactctggtcaccagtgcatttgtctgtgaacagatctgatatgataaagtggctgctgtaggatgactgttgaagcatgatgtctacaatttggagacaaaggaatatttatagctttttttttggaattgtcacaaaatctagcttatctcaattagagatgagatgtattcatcaagttatggtggtgattacatttctggatcggatgtattatcagtacttgaatttatgctgtatggactcaagttaattagagacggaaaaagtattgagcagtgatgtgtaattaatatcatacttggacggattatgtgaaagatttcccactgctctatcttccttttcatttggacagagatcaggctagagatgctacttgtttgattaaggcttcttggatttttacctcctgaatttatcaataagttggttctttattttgaatctctaagagatgtttagttactttggatggattacttgttttttacagtgatatgatcagaacagaagtgaactaattagccctttgttgagatagtagtaataagagcactacttcagcaattaataaagtcaaatggttagtttcttgggatttatttgacttggtgtcttcctaagatggtaaaaagcataatgcactggtaatatttgttgctggaatgatttgatgcttttaaggtttttgtgctgagggggactacaagacaatgctaaagatgcattgatatctttccttagctagttaacttcttagatttccatgttccaattcaatcaatcatttgtacacaattggttgacctccactgacatggaccttagaagatcaattgcctttgcaatatcttgggaaaatgcaacaatcaagtgattaacagattagcagaaaagggttgagtatagtctgttactgagtttctcaattggaatttaattattaaagttggttctttatgtgcctggttttaccacctccctgcttaatatagccaatccctaacccaaaggcaaaggttgccgaagtttatgcttgtgtggatttgatattgatttcatgtttaagtgggtgtctcctattaccatacaatgtatattgagtttcaaatacatatactattttcatttggctctcaaggcactggaagctattgcctatggaatggggtatcaagtatgtcttgttggtgggctcgtttaagactacaaagcttttaggattttgctaaattagatgcttttacatatctaattttctcatgcatataactcagatttcagattattgttgcattaatattctcaggttcttaggtttttcaaattgttaatcttacaagtaattaggtgccaacctgtgtttcgattctcatttaattatccttcactcggtgagggttatgtactaacttaagttttagtttccagtttgttctctctctcggtgcagggtctaaactctaacttaagttttagtttccagtttgttctctctctgggtgccagggtctaaactctcatcaatcctttgttttgtaactccctgtatatacaatatggaagtttaccctatatttctggtatcttgttttatttattttgatgctgtcacaggtttttgtaagtcaatgttttgtggattggttcatgcatgacattgtaaatactggggaaagtaacatgttggttcagattcctatttattcctcctatgttgtgcatgtatgctgataacgtattgtataactacagaaaacaaggcttttggaacgttaaaatattcttagcaatactagcttttagtttttgacatggtgagctaggtgtcaaatggtaaaatgtaggaaaattgggtgattagatttggttgacccctaccattgactttgggtgattaatctcaatattacattaatgcgcaaaacaggaactaatggtaaatattcgtgcctaacgtttttcatatcattcacctaacggagatggtcaatgcgtgactatagaggtgaaacatgcaaacataaatgcgaacatacctacctgactcgttgaactaaatcaggctacaaccgtaatgagataccggtgtttaatcgattcattatataattataatttaattaaatttagtcacatcattagaaatccccaagaatgaaagataatatacttgcatcccttgttgtataatgcaatgcacaataatggtgatgtatacaaaaggagtaccatatgtattaataacatcaagtagggtcgtgacgtcaactatctttaacttgttggtatcactacaagaagtgtcatagatggtcaaaataaacaaagtaataaaagaatggatatgacaaatcttgaagattaatatatagcaagtagcaatatagtgaggtctttcacactacaaaaaggcatatcgtctcatagccaagccaatcgcgtttaagaaaataaaagaataatttgcatttaaaggggaataaggacttttccaaaggttaaggactaaagtttttccataatttcttaactttgtaacccatctctctacctcttgttttccaaattcacaagcttagagggaaagattaatgaaagaaggttacgtggtgaaggtgattagggtgaagaagataaatagcgtaaacaaagatagctatcttagctagaataagttgggggatcgcacttcaatgcttgaataatcaataagagttgtttaaagtgaaacaaaaccgagaagagaaagagagagtaacgatggtaagagaaagaaatagtaggatatagtataagcatgaaagatattaggaaaaaaaagagaaaagaattaaaatgagtgagaggctcaactacacaaagataaaaatggataaaaaattctcttaaaagtgttgggtgtaatatgtggttaatattctgcaagtacaaaaatgaagtcaaacataataagtgatgatgtttcctaatgtgaaattgtcgtgcaacttctcaaatacaaaataagtaatttttttttaagaatatatctttagagaaatgctagtaacactttatgtgatacacttttttgaacacttcctttttgattggttgaattttttgaaaatcacacaaaattatggattccatattttgtttaatagtctctcataattttataattttcaataaatttcaattaataacaaaatgtattaaagaatgtgttgttaacaattctcatatctctatgatttggaaacaaatgtttcgtggctgttccctaaggagaaggaagtaaatcttatttagcttacaaaatttacagttagtcaatgaagatccaagttggtaatatctaatcaaagagaagtaactaaaatttgatttaactttcacactttatatcaagtcaatgtggatccaagttggtgttatctaataaagaactaacacatttatatttatgataaaaaaaaaagcgcgtatacatataaagctaaacatcactttaagagagaaaaaaaaaagtacattcaaattgatactagtacttaaaaaagaacaaaaaaaaaattatatcgtaaaatattctatttaaagtattaagtataataaaaatatacaaactaacatctattttttatattaaatattactaaggaaaaatgaggaaattacacttcgacaagttcatttcaattttcaaagatgttattctagctaggtatgtttatgatgtgaatttgcaatctaagagacaactagcctccatcttctacaaacttagtcattttttatccagcttaactccagagttattttcaaaacaataaaattgctctatctaatggcaaccacgagaccaacttcttatcaataattatctttaagtagtttgtgtaaaatatggtggcgacctttcgattcatattaaatttactttgttttatataataataaaaggatcaaaagataaaatttcgaaatgccaaccagttagtattttatttttaattttcttttcagaaatccacacaaatattggtacaattttttcaaaaaatattcatgaaaatgtcattcaatctgagacttgtttgggtaagcttctctaaaagtaattctaaaagaagaaaataaaaagaaaaaaaatgagataaattttttcaaaaataaaaaaaaagctcttcattaactaatttttagaaactcaccaatatagtttttctaaaagatgagatgtcatttacaaattagttaatgaaaaatttattttaacttatggagaaactcatttcatttttttcttattttctttttctagaagtgtttctagataaatttacacccaatcatacctttgaattattgcttttaatatattttaatgattttgggggggaggggggttggagggagacacgttttaagttttaaataaaattatgctaccacacattattttgcattaattcaaattaatattttcctttattttcgtaaacaattaaacataaattacttttaaatcgttcattacattattcttacgtatgatgcaattattttctagaattttttttcgttcatgtaactcacgggtttttatctagtttgttatgaaatttgaatatgaaatgtatttttttatcctcactgtacgtgttgaagaaaacagaaaaaaaattgtcttgtaactgacttaggctaattttgctgcaaacttttcatactaaactaaacaagattttcttatggagaagaaatgctgtgtcaagtattaacagtttgttatagaatttgacgaattcaaaacttaccgacgaaatgttgcataaccatgcatgagagagaagggaaagataattgatattggctgatttaaaaaaaagtaattgatattgtaattgtcttccctcaaattttgtaataatttgtataacaattttcttcagagaaatgttatttagtactaatcctttgtcacgttgatcaattagaaattgatgcatgaggttcttgcataaacatatacgagagagtcgataaagaaaacattgtattgtaattgacttttgacaattttcgttaaaagaagataattctaaatatgatttctgtataagagaggagtttgtgattgtatattatattgcatcaatctaaacttagttcgtggcttatattacattagtattcatgttatacacacaatcgattatttagtgatggttggacattaatttagggaactcctaccacatgacaaattgggattgattcccaactttcttgtcaatttatgtcggtggtgttgtaatgagaaataggcaaatagtattaacatgttttttttattatgttaaatatattaatatgtttaattacaaattatgtttgtcaagggagtctagtccatgatttagcaagatgtcctagttattgtaaatatgctaacattctatttgatttctacctatatatatttatatattttataaattaccttcttaatttaaaattataatgcaagtataatctcaaaaattatatatatgaatattgaccttacaactttttcttttttttacatttaaaattctgaatctgtccatttacattgaggttagcacgactgttagtgctggatcagtatcatgtcatgttcttttgatttgaatgcttctcttctcacttgtcacttaaaagtatggggtacatgaatgagacagggacgatgtctatgttgaccaaaggtggcttatttactaacagattagaaatttgtgatccaaaattcttgtaaccctatgtcctaagggaaacaaaacttatgccaagttttttggggttggtgctattacaattgaacttctttaggacactcatacacacccacttttctctctcttgaaccaacttgttatggttgtctaattattgcacatgttccttattcacattttaagaattagcacaactgtcaagtagcacaaagtgtcgtctcttccaaatcatcaaccacataagaatagtacattctcttctcctatataccccaatgccaaactggctctatggtcacaattcattatggatcaagaattcaagatcctccagtgttctacgataactgcagtgggtgcagttcataatctcatgaacctttcattttcgtttgtaatattttttcgattgaataacctcaagtactgttttacagtagagattgagtatagttttggtgaaattgtagatgatctcaatattctgctacaaattttgtctaaaaggaagtgcattggtatcttttcttgctcttaaatgacaatagaatgtgttgctagaatctaaaggtggataagaatgagaatgttaatttatataaaaaaaacaagaaattaaataactagtattttatagtcgcaactctgaaaaagattttacttaatcaccattccaacttgagggttatgcctagtgatagtgacaaaattagaaattttaagttgtgaaaacaatacttgtatatataaatttgtggacacaatacttaacattataaattgactttttttttccttctcttgtattttaaataattaaattacagggacagtttgtaattacgtgcatataacttaatagaaaaaagttcgtgagagcaactataccctcgaacgtgacaacgtagattcgtcccaatttggtgatatttggttaaagacaaaaaataaaataaaaaattaagaaccttagttcaaatggaaacgagttgtctctgattgcttgatccaataccaaggaggatggttttccttcaatttagcgtatcttatccatcttaacaactagtacttagggcttctttataacaaaaattaaaatttttaaaaaaataccagacttttatgtctacactaccaaatactataaccaaacttaagaaactaaagaaaaaccaaaatatttttttttttttttaaaatagcaaaagaaaaagtagaaagaattagaataaaaaaggagcaagcggattgcacaaggaaaagtagtttacttgccagtctgtaatgaatcactacatttacaaatagtcaaccatactacacatgcactgagaaaatgcaaggaatcaaacagctagctgttgttgttgttgctgcttttgatgagaagattcatcctcattgaagcacaagtgggcctttagtgattgtcctaaatttagggtggaatctgaaaaatttagaggttggatcaacaacatttctctttggagatggacacaataggcttggaaggtgcctggggtcacatttaaatggaaacccaaaccaaagaggaaatccaactcaagaaaattcatctctattttggtgattcctccaactttggcatagtgagcattgttgtagaacctgaaaaatattagaccacatgaacaaaaagagaagattaggtaaatatcatgtaaagtgtttttttcttatagaaaattagtaagtcaaacatcaacaatatttggcatttgtttttctttaccattcatattccacaattgtagatatacggagtaaatgtactagtgagtgtataatatcttgagagggtttaatcttaaccacataattaaaaaatctaaatgaatgatgaagattaggtttaaataaaactaatgtcaactatttacatacatttttggttacaattggacttttttttttttggttacagtcaactatttatatatagtcatactatcaagattgattcttctcttttgttacatttccattaactagctcgctatttttttatgtatataatatattaattagaagatatttgcaggatatgtgcagtaaattcatgggatcacatggtagattgtcacttctcaatggaaactggaaagccagcctggccatagtatttttcacaagcaagattatattttttaaagaaatattgttgtcataaacacagtttattacgtcagagagaattatagaagattaaaaaaaaaaacatcccaaaagtagggaaaaaaatcgggtaagctacaattcacaatttggggttttaatatattaaaattttctattggtactagaatacttcaaaattcagaaatagaaaagttcacgggttctccaaacagaggaaatgcagagcaactgaaccatcatcgtttgacttttgtcaaactaactgcaccatactacacagaattcataagaaaaagagaagagttcaaagaaaaagaaaaaacacataattcataattgtttaacttaattattatatatcaaagtttcagaaccagaaaacatgaatttgaaagtttttttaaggacaaggtgtttttgatttctattttcgaaaactatttttagttttaaaaaaattagacacctatgccttattgccatgctcataccttaatacacggaatacctatccagatgatccacactcaagttaggattacaaaacagagaaagaagatggaaaaacctaccaattgtttttttttgtttttttgggaacagttttcgaaacttaataaattttggataataatattattactaagcagcatgaaattaatttttaaaaaaaagttagaatgaaatcaaacaatgtctttgtattttcagcttacttagaagtttgaacaacaaaaacatgatattctaactttgcaagcctttaaaccacccacgatcagtaactagttaactcaactattgttacatacttacatatacatctaagtttaacaatcaagaaaacttagaatttgaaaattttctcaagggtactaactaatttattaagccacttacatgtcatccatgaacttggcagctaccatgacactagtgatcagcaaacggtgcacgttgaaggagttgatgggcaaagagggttgtctctgagtgaatcggtcgaggtagatgtaggcgacgacgaagcaggaggggctgcaattcgcatacttgaagattctctcaaggtagcactgaattgagatgtttggccttgacaggccatggaacactgagatcttctggtgctgttggaggtgttggttgtgatcatttgactcagccaccctctcaagaagagaggagaggaaaggtatcacttttggcatcacacttggagtctcctctgctatggacattttgcaaaaggtttgatgcaacaacaacaacaacaatgtttgaaattatcatggtgtgggatatttgtaagccacttttttatcctatgctccaagaccataggttaaaggaattatcaaatgatttctttttatgctttttaatgtaataaatgagttgtttttaagaaatatttttcatttttgtcctcttaacctaaggcatttggtgcatatgtgatagaaaaatctactcgcacattatagaaaaaagatcagttgacctgagttgtcaaattcaataaaatgacacttttagtaactttgttaaatttattgaatttgaacagaaatatcttacaagttgaaatgtaaatgttagacttaattacatatttggtttctcctactttctcaattttgcaaatttcgttcttatattatttttacaaaattgatctcttattattttaattatatgctaacctaacatgtaatagagtgtcacattaacatttcattatatatattatataaatgaataaaaaaataggagacaaaatttgtaaaattaaaaaaaatataattaagctaaaatatcatatatagagaaaaagagggtgggggatagagagatcggtagcagtaggtgcttttcttgatgcaaaaatggccctagtaatttaagtaatgaattgcaagttggcacatcagtggtggtatgtgtcctttttcggctataaaagttttggggtttgagttgggtaatgattttgatttcctctttaatttcaaaacttgacttgtaaacgagggaaggctggtgcgtttattgtggattaatgtcactttctcgaaattaagtagtggttttgtagttgtgatttatttgtgaccatggagatggcattccatacccttcatgtgattacatgtggggaatttgagactctagtgtaatggtcccactgtttggagaccctagcatgtgttttgattctggtacaagtgggtgacataacatggatttgctatgttggtccacagcattgccatattttgctttttgttcatatatacttccttgaacacaaaaaaaaaaaaaaaaaacagcatagagctggtgttttttgttcaagattggttcatgtgacccatataaatccaaagtttgaataatagtgttctttttgtgataatattaaatattttttaaggcatccaactttgattagattttaatagatttcgtttctaaaaggtgaagattaatgcgtttaaaaatcaaggaacctacttttttttagaaataaataaataaactaaaagaacacatgctacacaatattagtacatatttttcttagttaaatttaaatctcaatattttcgatacacaatcatacatcaaatatgaacatatcttgagggacagatttaagagtgtcagtattaagtggaggaaattttttttacacaattttttaaatatttaacttctaataaataattatttaataacaacatattttaaaaataatttattattaattttatgtgtaaaattagaaatatgatctactactagaagaaagttaaacaaatattaactcatcaaagacttgtttttcttgtacattttcctttactaatattttttctctcatatatacataaaggatcctaaaagaaaggtggatcaagtcccctgcttggcctccctaggatccctccctacatatctctaatgattcatcacatcataagagactagtttcttttattaaatctaacttttaattgtatttttgttatgtttttgttttatcaacaaatgttaattattaatttgttactttttattagcgagagaattcgaacctataactctttctcttttcaccattagaccaactttatatttcctttttattcttgttatgttgattgttacatagcatccatcatgattttgagataacatgcggaagaaggagcaccgatgattttgtcttattaaatccaatataaattgagactttaaatgaaattttgatactttgaagaccgacagtgctgcaatcccttcagtcaatgtgccattaatgggaagcaacttttcacaaagaaacaacagctatagaatgagatgtatttttgccataagcatcgagaaacaaaacacagatggaactatcggctgtaattgcaaatagaaaatagagacacgaaccttttgcaacgtgacacctttatatgtggatccaatctaacgtgccatgaaagcaaaatagtgtaagatttctgacccacaatgtcatgcacattatctaatttggttaactatctaagcattaatacttagttaaccctcggaggaaactattgtttggagacgggtgcttgttagtgaagaaattaaatagtcatagatcaaacttgggagaaagcatgtcttctggtaaaaactattcaaacctaatgttttgtaaaattataattatgagatcttatgctagtttatatcgttaagctagtaagtagctgtttagttgagtacgtgattaatttcaacagcaggtgatcatcatggttatctagataaccaacatttttagtgtgtacggaaccaacatttttccctcatagaaccaataatgcacccccgggtcagtgagggagaacatgattctacagccactagcaaagttatacgatataataatggagacaaagcaagcataacatttaatttataattcgtgctacatattaattagtttaaatggaacaagatttatatcgggttaattggagtttattgagtatgttagcttatacaatgtcataacgtgatacacaacagagacatttgcaactcgatcttgagtagcttcctattagaagattcgacttgaacttttgtttctcaacagttacaaattgagtgtcattctatttttaaacggcttatttttgttcggttattattaaatggcaacaacgacctctatatgtctcatagtaaacctaggcaatcgctctcaaaataaaaaaaataaaaacttaggcaattgttaaacatacctcccttaactattagatgtacatccctctcaatttgaagtatgctccaaacaaattatattgcctaaacttacctatgatgcactactaaagatcctatacgttggatattcacaaagcccatactataatttctaatcaaggtctatccaaagggaaatttgtattctgcacctcccactttgcatcctacacctcccaaaagatttcaatggacacaaacagtcctttactaggtacctcgattccaaaacgactacattggaatataattttttgtattctagagtaggttctgaagtgtttattctattatggaatagttgttctgaaaatgtatcatattctagaatagttgttctggaataggcgacataacccttcttccctttttcaaattcaaaccatacaggacccgcatgaggacaatggtgccgcgttcaatgccgacgatccaagaagagcccctcatagctccaaatcaagatcatccatcttcgtgcaggtcttgttcctcatcttaactttgtggaaatcaatgtttttggctgttgttgtttgaggattcacattattaattggatctagtttttcttgttcaaggaggtggacctcttgtaggaccttcgccacccaccctcatctatggttagcgtgacttcatcacccacccgcttgccttctttgttgcgtccaatgacatcgtcttggaaatctctgttgcctccgatggcatcgtacttgggaggcgcagggaaaagggagaggaggcgttaggaataaggatatttttttatcattgagactttttgggaggtgtaggattcatattgggaggtgtaggattcatattgggaggtgcaggatacaaatgcatccaaagggggttgggagttatcaatttaggcctaatgttaaatgtatgggcttcttagggtattttgggaaaaatataaaaaatgaaggacatatagataacttcacccgcaaattcaatggtgagcactaaccaaaaaatgggctgatacctagtcttagagtattttgggaaaaatataaaaaatgaagggcatataaataacttcaccaccaaattcaatggtgagcactaaccaaaaaatggactgatacctagtcttagagtattttgacaaaaatataaaaaatgaagggcatataaatcacttccctcgcaaattcaattgtgagcactttaccctaacggcctaacccctttctcccgtccgcctccggtgttacgtagaagcaatggacgagaggctgctgagcggaacagaagaaatagaggagattcatgagtctgcaccaccaccggatcgtagagaagccattagagatcggattaaaacttctttgaaagatctactacagcggtgtcaagttgggggagccgaaaagattttgcattctatacaagaaatagacgtgagtggtgacgactctgtggaagagctgtgtcagctgacaagcaaaattgtgcgatgcataccaaaaccggacagagagattttgttcaagaatggtctttcaaagacactcgtggagattataaaggaactgtatcctgaattctttgtttcacctggtaaattaattatccatatattaggattgaagtggatgtagtagataatgataaaactcagcagcagtttgtatttataccgccatcataatttctaacatgtatgcatattctttctttgatttgtgtgcagtgcataacatcgggattatgattgatgtagtttcggaatccatgattcggtctcccgatttcattttgttttttccggaacctgagactgtaagttataactctcatcaactcttaattgccatcaagatcctttaagtagtttagtgcatatttagatttcagttggaagaactcaaaagctattttacttctaaagcaataattccttgcattcaaatttgcaattatgctatgtaaattactttgaactggaaaatcatttcaatagctgtaacctttaatttgtgaaatattttgagatgtgaagggagatcttaaaatgaaaaatagatgacaaatattttgtcaggtacctaacttttattgcttttatgtacagagaagcatacatcgttacatgaatcaaatatatcgtgatcagtataatccgttgcagatggtgaaaaattatataagtattgaactaattgatacaacaagttatgatctcttcgttcaaaacataattttctaagtgctattcattgctattaatattttactgtcaattggatcattatgttagacctcaaataaaggaaagatatgtagcaaggactcatggcaggtttaggaagaagcctgagcattagtgaaacctgtaactggctaatgccagttacagcttaacgaaaatagaaggcttacctgtaatgcttacctgtaattggctgtaacagagctttatatagttttctgttagaaaggagagggtgggggggggggggggggaattcatttgggaaaatcggttagggaggctgggctcactcctagaattgtaaccggaattcattcaataatacaagagttcttgattgttccatcactgctattagagcattcgatccataaccttccgattgggtgttggcgcgactctgatattgtcgttcaccaaattcggaccaaatttttttccgatttggtgatttgcgagagccagtagcttgcgtctgtagtgatcggtgagagtacatggtgtcgatgagaggaggaatggatgcacgcgtggagtttttggaacgcggtttcgagggactgatccaaacaagagaagagttggctaatctgagaagagtgaacgaagaagacagagcagaaagggcggaattgcgagaacaactagcgcaattaatggtgacggtgagaagcatgtcgggcgtcgaaggaggaagtgaaaacagagatcgcgatagaggtgaacagcggaatcgtgagtctgcagggcgcgagaaggaagagagatggcggaagcttgagataccagttttcaatggagatgatgcatatggttggacgaacagagtagagagatattttgaagtaaaaggagtggaagaagaggagagaatccaagcggtgatggtggctatggagggcagagcattgaattggtaccaatggtgggagttttgtgaagaaaaccctaattggaatgggtttaagcaggctgtgattcaacgtttccagccattgatgagccaaagtccgtacgaattactgttgagtttgaaacaagagcaaacagtggaggaatatagagagaagtttgagctttatgcaggacctttaagaggtactgaacctgaatatttgaagggaatatttttgaatggattaaaggatgtggtaatggcagaattaaaacttcatcctgtcaaatccttgactgaattaatggaggttgcacagaagatagatgagaagaaccagctcatggaaaaggggaatgttgcaagcaatagaggacattcatcaaaagtttatagttcgtcaagaactgtgacttgggaacctggaatcaaatcaaaccaggtcagacataaggaggcagtttctagtagtgattctactagtgtgaagcctactggaacatataggggcaggccttttagaaatctaactgatgcagagtttcaagaaaaagctgaaaaaggattatgttacaggtgtgatgggaaatttggacctggccatatttgtccaaataagcagtttcaagtaatgattatggctgaagaacaggaggatgaggaggaaaaggaagaggaaattggggaagcggataagcagtttcaaaaaatccaactatcattatatagtatagctggattaattacaaaaaaatctattaggttgtggggaatgattgaaggaacacgagtcatgactctagtagattgtggagcttcccacaattttatctcaaggtctgcagtgagattattgaaactggaagtcacttctacaaaaccttatacggtagaagtgggagatggaaggagaattcactgtgaaggaatgtgtagaggggtcaaattacagattcaagatctgcagatcatacaaggtttttttgtgtttgatatgagaggggtggatgtggtgctaggtatggaatggttagcttcattgggtgaaataaaggctaatttcaaagagctaaccttgaaaattcctaaagagggaggatcaattgtattgaagggagaacctgctttaacaaggtctatagcttcattaaattcagttttaaaggctataagaggtgaaggtgaagggtttatgttgtactgtcaagagttgaatgctgttaaaaatgagaaggcagttcctacatggatggaagatttattgcaggaatttgagggaatatttctggatcctagtggtcttcccccttcaaggaagcatgaccatgggattgaactgaagcaaggagctgaaattcccaatgtaagaccttataggtatccacactatcagaaaaatgagattgaaagattggtccaggatatgctgaattcaggaattatcagacctagcattagcccttatgctagccccctgttatattggtaaggaaaaaagatggaggatggagattttgtgttgactatagggcactgaataaaataacagtctctaacaagtttcctataccaatcattgacgaattattagatgaattgggtggagctgtggtatttaccaagctggacttgaaatcaggttatcatcaaataaggatgagagagcaagatattgctaagactgcctttagaactcatgaaggccattatgagtttatggtaatgctttttgggctcacgaatgctccttctacatttcaggctttgatgaatgaggtactgaaaccttatttgaggaaatttgcattagtcttttttgatgatattctcatatatagtagaactatagaagatcatcttaagcatgtgaaagatatattaatgctgttgattgagaataaattgctggtgaataagaagtgcagttttggccagaataaggtagagtatttggggcatattatttcaggggagggggtggctgcagacccaaacaaattggaggtcatgagaagctggcccattccaaagaatgtgaaagccttaagaggttttctaggtcttacagggtattacaagagatttgtgcagaactatggaaaagtggccaggcccttgtatgatttgttgaaaaaagataattttcaatggagtgaggaagctgaagcagctgtgaatcaattgaaaacagccttggcagagattcccgtccttacaattcctgatttttctcaaccttttactctagagactgatgcctgggagctgtgcttatgcaacaggggagaccattggctttttggagccaatctctttcagaaacagctcagagaaaatctgtttatgagagagaattaatggctatagttttagctatacaaaagtggaggcactatttgatgggcagcaaattcactattatgacagatcagaaaagcttgaaattcttgacagaacagaggttaatgggagaggaccaatttaagtggacctcaaagttaatgagctttgattttgatattgtgtataaaccgggttgtgaaaataaggaagctgatgccttgtccaggagaatgacctttacagccatctctatgattcaacatgatgaggaagaggagtgggaaagggagatattagctgattcaaagttgaaaatgattatgcaagatttattggtaaataaggctgctcatctaggatatactttacagaataagaagttgtggtataagggcaaattggtgttgtcaaagaactctcctaaagtacaagtgctgatgcaggaatatcatagttccttggtgggaagtcattcaggttttttcagaacctacaaaagaatagcagcactggtgtattgggaagggatgagacaggacattaggagatttattgctgagtgtgatgtttgtcagcaaaataaataccaggctttgtctccagctgggtttttacaacctctccctattcctacacaagtctggtctgatatttcaatggatttcatagaagggctccctaaagcacaaggaaaaaaatgccatattagtggtggtggacaagtttaccaaatatgttcatttttttcctataagccatcctttcaccgctaaggatatggcagagttatttgtgaaagaagtagtgaaactacatgggtttcctactactatagtgtctgacagggataaaattttcttgagccaattttggaaagagctgtttagaactgcaggtaccaagctgaaattcagttccgcttatcatcctcaaacggatggccaaacggaggttgttaatagaggggtagaaacttacttaagatgtattacaggagagaaacctaagcaatggccagcatgcttaagttgggcagagttctggtttaactccaattagaacagctcagccaagctgactccttttagagccttatatggtcgagatccacctcaattgttgaagggcacaactattccttcagtggtggaggaggtgaacaaattgactagagaaagggatgagttattagaccaactaagaaggaatttgctaaaagcccaagaccagatgagaagtcaagcagataagaaaaggagggatgtggaattgcaagaaggtgattgggtctatctcaagatacagccatataggctgaaatctctagctaaaaagatcaatgaaaagttaagtcctagattttatgggccatatcagattgaaaaggtcattggtaaagtggcctacaagataaggctgccacctgagagtaaggtttacccagtatttcatgtttctttgttgaaaaaagctatttcttctactgcaaagtctcaacctttacctgcaattttatctgatgaactggaattaaaagtggaacctatggctgtcaaagctgtgagaaatttagcaagaactgtagaagtgctgatacaattgaaggatctcccagattttgaagcaacatgggaagaggagtcagtaatacagcagcagtttcctgactttcaccttgaggacaaggtggctctcttggggggagtattgttagacctcaaataaaggaaagatatgtagcaaggactcatggcaggtttaggaagaagcctgagcattagtgaaacctgtaactggctaatgccagttacagcttaaggaaaatagaaggcttacttgtaatgcttacctgtaattggctgtaacagagcttcatatagttttcttttagaaaggagaggggggaattcatttgggaaaatcggttagggaggctaggctcactcctagaattgtaaccggaattcattcaataatacaagagttcttgattgttccatcacattataataacaaatttggtatagagaagataatgcaaccactttgtgaacaagaaaaacacaaccataaccttagtcttgttacttgtatagatgaatggagaatttgtctcacattaaggcaaatagacataattacgttttcaacaaaatgtagacataattaaggcatgtatcattttgttcttttgtcccctgcaatgacatttccactgcatgagatctaaaccattgaaattatttaatttattttataaaaaatatattataaactcatgtttaaaagatacatatggatgtgattagttcacatgatcctctcatgttaactttcactataggagatccttcttcatacattaataaaatagaccttggatctaaccaagacaaacttaaacgtttaccatgtgcttgtcctcttttattatgttgattgtttgatatattttgttgtttttttatctaacatttattgtgagaaataataatcaatatttgcaagttctccaagattttgaaagttgcattagtcaatctttttataataattttttggttaaaatatattttcgatccctaataaatactcaaattttgtatttgattcctaatttattttttctttgtgtttgaccatctattatttcatcaaaattctcactcaccaacaatattctccattgtgattgactatcaacagggccattctcatccccccaaccatattgtgatgaagattgacgataatggggtgttgaatgaaaataatagagaggcgacggaatttaacagatttctgaatgttttttgggacacgctattccaatcacattctacttatgaacatcgtcttactgcctgggctaccttatgtggaatgctagcggcccaactatctgttttgggaaaccctctagacaagttatccgaatcaagagacactgacccagtggaattaagtatagtgaaagcatgtcccataacagtatgggtatcaatgtttttcctgaactttatctttgtagcaatgcgtacctttccattgcctcatcgtatacccgcatactcaatattgggattgtctttactacattttagcgataatagctgcaatgtctggatctagcgtttcattgagtggttcagttaaaatatcaggcctattatttgtgtttggaggggccacatgcttaatgctacttcttagcatcataattatcggggtgctctatgctgcatggtgctcctctccggatttgaatgtaagtttgggatcattcctcttcctcctccataatacttcttattttttctattaatctttctttcacatcctaaactctatattacttagacttaattgcattttttatccaaaccttctagcaatgaaactctaatgagatcatatttgacaaaagatcccctatatgttctagcaaatcattttccactagtcaaaagaaaaagaaataaagtatcaaaagctactatctagttggttcaataacatttgagagtcatcatccatgttttcactgtcaacagcatcatcagttctatcagttatatcaatcttgcttggcaattcaccattgtcaatggtaccctcaagttatattcatacttcattttgatttatctatggagggtattatacagttggtttacttcttttttgcacctttagttcacaatgtgacatgcatacaattgtttacatccatttaccccattttatatccctttctggtatgcttgtatactctacctatcttcctttttgtgtcactcaaacagtcatagcacctgcatatatgtccagacacataatatctttaagcaatagcttttagcattacgtgcattattgccctttgttaatttgtttgataactggtttccatattgtacgtgtgatagatctttcccctgcctttttgtaatgttaagcaaattggaaactttattggaggaacgatgcatttctagaagctacctttttctttcattctgacatttgattttcaacatgcaggttccagtgattctggacgccgcaacttctcaataaattgcaaagacagaggtttttggttttagaatgtctaaatcaagcccttatggcacatctggtggtggttttgggtcaactaaagccgggtcacttgatttttagactataccttgtctataacagaagacttgtttcaaccaaaaatacaatagaaatagtgagtcaggctcagttttcttagtgcttgaaatttagccttctaaattgtgttactcttctttttgttcttttgatgatcaacttgtttcaccattggttcatctgcaatgtacagacattttctttaaagttagtataacagtgagaatggcgagtatcagggaaaaaaacataatgaaaataatgaatataagcaacagtgttattgattattgcctaattatgttgtcacttgaccttggtcatggcacacttgatacaagtgtaactacatgtttcttagtttcccattatggttggcaaaaaatattgattactgtaactttccctggagatttttgtctagttacacaaccatgggacccagaccactaaggacaatttaaaatatgtgggttagggttgtcatcccatggggaatgggtatacctggtattaagttttcatataagatgcatgggtatgataccctgattaatattatatttggtgcaacttgacgagttggtcacactccatgattgtgttcatgcaagaattattatctgaaattttgtagacgcttataggcatgtttggataccaggcaagtgcttttgagataattctttttattgaaaatataggttttttagagaaactttcaaaaactatcaaaatgacttgattttgtattcaaacagattctatgtaatgtagctttaatttattcacaagtcaggaagtttagctttcacaaaaaccaactagaactcaacctttacatactatggttttgtttaatatttagaggcatatatatatgttttagaatgttcattaaatctaataccgatttagtttaattattaccatctaatatataaaaataataattttcttaaattgcaaaattgagcttaacataaaaggcttaaaatgttaaattgatactcaacatttgctcaacaacaaaatttagttgatgagtaacatcttgtttttcaaaatcgttagtggcagaatagcttatctgtgtcttttttaatcacaaaaactgaagtcgcaaaattgctaccaatcaaaaagtatacaatgacactgcattgtaaaatttatatgaataattaccatgacaatgtggttgcaagtatgtgaggaaataaatcaacttattgcttactagtgagattataagaagttccgaatacattcccagtcacaaaattgcagtgtagttctgaatttaaattcaaaatgacaaaagcataatccattatagcattttatagaacttcattcatacgctaagcaactcgagcctaattaaaatgcaacctcactaagatggcaaagttcttccgatgctattttttttttcctttcaaaaaactcaactaaggtcttacttcagacgaactaagtttcttggcatttgagttatcaggtggtggcaaaaaatggtacacattttaataatagcaagtctatataacaatatcgttgtataaaaaaccattttcatgttgagaaacaaaataaatccagttatccagtgaccttcgagcaatatttgggcagacgaaggtaggataatttcagtcaaacatgtggggaagtggtctgatagccataaatgcatccaccatctgaaagaattatggagaaagagaacatgtaagttttgcaccatataatagagacaacaaacattctcatcttgttcccataaaacaagttgaaaactctcttctacccaccaaaagaatgtttattttgagaaagtcttgattgtcacattccactaactttttccccttcgatttaatgaaaataagagcacagaaaaaagtagagtgagattttttttctccctctcatttggaggattgtgacctcgaatcacaagtgtagaagctggggattattctccattcattcaataataatcattcttgttcatttctactctctttctttacttttttgctgatccagtgcctatcactggtatcagagctccattctggggctgtgggtcattaatggcagcgaagaacacgagcaaaatggaggcgcgagttgaggcactggagaaggtcttggaggagacgcgtaaagccagagaaatggaccgcgaagctctggaggccaatcgggtcgcattggaagccaatcgggtcacgatggatacccgattgggcgcaatcgagtaggttctgcaacaattggctgcgtcgttggaaacgccgaggttggggctgaaagtgacgacgaagggggcgcgaaccaggagtagggaaggagaggaacttggggcgcgacagtggaggcaaatagagatgccgattttcacgggagaggacccagtgggctagatttcgagagtagaaaggtttttttggcttcaggcagtaagggaggaggagaaaatggaagctattctggtggtcatggatggggaagctttggcttggttccaatggtgggaatcatggagcttgaatcaatcttgggatgaattcaaaagtgaattggtgcagaggtttcagagctccaatctaggtaatccatttcaagctttactttctttgaggcaagaagattgtgtgcaaagttatattgggcttttcaaaaagcatgtgggggctggaaagggattgggagaagtttttctgatggaggtgtttgtgaagggtttaaaagaagaaattgggacagaagtgaggttacatgagcctaagtccctactggaaactatgatgaaagccaggcaagttgaagaaaagaatagagttctggggaatctgcccagaattggaaaatggatacctaatgtccaaagaactaatttttcaggaccaagaagtgggaaagaagtgcagcaggggagtggtaagttgctggaggctgttgggggagtgaaaacagggggagaacagctgaataaaaagaaaaatttccatagattatctccaatagaggtaaatgaaaagatgaagaagggtgaatgctttacttgtaataaaaagtatcacgcaaaccatgtttgtaaaaacaaacagctgagattgatgattatggaggaggaagaggaggaagaggaatggtgggatccagaagaaggtaaatatgaggaaaaagaggaggtgcatcagctgtctttacatagtattgaagggtttacatcaaagaaatcactcaaattgtggggaaacattaaaaacaggaagatagtggtgttaattgattgcggggcaactcacaattttatttctacaaagttggtaaaggaattaaaattggaagtatctcctactcaaatttatcatgtggaggtaagagatgggcacaaggtgagctgccaaggagtttgtaagtctttgcagcgaaacgagagaaggggccaagagggaaagcatgaaatgagagaacagaggcactaaccaaaaaaatgggctgatattttgtgacctagtcttagggtattttgggaaaaatataaaaaatgaagggtatataggtaacttcacccgtaaattggggttttctacctacttctgcttcctcttgcagtagaagcaactcttgagcaaaactgaaatttattagtttgtaaacttgctgaggctgctgagaggaacagaagaaatggacgcgatcaatgagtttgcaccaccatcggatcctagaaaagccattagcgatcaaatgccagcggcaatatgggcagccgaaaagattttgatgggagaaatatcctagagcggcaacaacttaatgaaagtgctgatgagcaaaattttgatatgcaaaccaaaaagggagacaatggcggaagctctgaggagaatgcatccagaaacggtgcttgtaaatggtaaattaatatccataaattaggattgaagttggaagtagtagacaatgatattacttagcagcaatttgtatttataacgccatcataatttctaacatgtttgtatattctttctttgatttgtgtgcagtaccgattaacatgaagggtgtgtttgctgattcagttagggaatccgtgcctctatttagggaagccaaagaggtttttttttatggaagatacagtcgcgagggtgtgcggatccaagtttgggcctcagattgtaagttataactctcataaactcttaattgccatcacgatcctcattatctttaagtagtttagtgcatatttagaattatccttttcatgaaattatgattttttattatacaattttcacacacttcttataatagtgcaaacatgattttattatatattttttctgtcctatatataacaatgaaacatatttctattgtataaaaataggtgtgataaattacattaggtaaacctttttcatgtacaaaatctaaaatggaaacacgattttactgtgtaaattttttgcactcctttcatataatggaaatatgtttttcattagataattttcacaaaaaaattaattggaaaattaaattagtttttttacttgaattacttttgatacaattttgagaaatgatagagaccaatagcaacttcaatgaaatcttaaacattatggtactgtttgggcgacattatatgtaatgtaggagaattgggcctactataggctttggcaattcttttaacaagtacatttacatcatgcaatttcaatgttgcattagacatctaacattgtattttcaaaaatcatttcaaaatccaaatttacattttgaaatgagtttttcagaatataatgaaaagtgtgggatgcaataatagagatgtaggatacaatagcctttaacaagctatctcatttcacaagcattggcatgcttaaatatagtttttgtctaatgcaaatgcctaccttttgttttgcttcgatttctctctttgtgctcaactaattgaaaaatcaattaatagtttttctttcttagagcaagacgaatgaagcgtacccttactcgctgattttcgttgcctgatttaggagaatgaaatgggtcgtgatcgcaagttgttggtgtgcctcaatgaagcaaattctagttgtttttagatgccataaattgtcatgtaaaatttaaagtaaatattggctgttttagaaaccatcaaaactcgcatttcccaaacattttaacacttaacatttttaacctaatggtagggaccagaaacaaaaaatttcaaatatcatggatcaaataaagaaaataatctcttatgagcaatcttctctatgatctcatatggtccatagtaccttggactcagtttctggttcaatctcttggccagtttcttgagtttgtcggattgaatcttcaaataaaccatatctcctaccttgaactcaatgtctctcttatgagcatcagcttgttgtttcattttgttttgggtttgggtcaagttttccttcagaaccctcaataatttattcctatcttgtgtcatctgagtcacttcctctatagatgtctttggaacatcacccctcacaatagggggaggatccctaccatataaggctttgaatggtgttattttggtggctgagtgatagtttgtgttgtaccagaattcaacccagctcaaccacttatgccactacttgggctttgtgccagtcatgcaccttagatagatctctaaacatctattcacaacctctgtttgaccatcagtttgaggatggtaagcagagctgaatttcagtttggtccctgccagcttgaacaattcagtccaaaaggaactaataaagatcctgtctttatcagagactctagattctggaaaaccatgtagttttactacttctctcaggaagacctctgctacttccttagcagtgtaagggtgagctaatgctatgaaatgagcatatttagtgaatctgtccaccactactagaatagtatctaggccccctgccttgggtaagcctcctatgaaatccatggtgatatctgtctaaatctattttggaataggcagtggttgcaacagcccaactggactaagtgattgatatttgttcctctggcacacctcacacttctgcacgtattcttgaatcctcttcttcattccttcccagtaaaacatggcagcaatcctcttataggttctgaaataaccagaatgtcccccaagtgcagtatcatggaattccttcatgattaattccactttggaagaagccttagggacaaccaacctatcttcatagtagagtctgccattcttcatcctgtagcccttgtgctcactgcccttgatgaccaattcttgaattaatcccttcaatttctcatccttgtcaatttcttcttcaaggtcagcccaatctaagaactgcattgtagttatggctgcatattgcatttttctggataaagcatcagttgctttgttctcaattccttgtttgtatttgatctcaaaatcaaatcctagcagtttggaaatccatctgtgctgttcctcacccatcaatctctgatctgctagaaacttgaggctcttttggtctgtatgaatcacaaaacgcctccctagcaagtagtgtctccatttctgcactgccatcaattctttctcatacacagacttgttcaaagctctatcaaacaatgtttggctcatataagccactggcttacccccttgcatcagaacaacacccaatccttttccagaagcatctgtttcaatcacaaaaggtttctcaaagtcagggatggccagaactggcacaattgtcatggctcctttcagcttatcaaatgcctgttgggcagattcatcccaattaaactgatccttcttcaattgttgtgtcagaggctatgcaatcttaccataaccttctacaaattttctataatacgcaatcaatcctaaaaatcccttcaatcctttaatgtttttagggactggctagtctaccatagctctcactttagcaggatcagctgccactcctagcccagatatgacatgtcccaaatattctaagctgctcctcccaaaggagcatttctttctgtttactactagatcatggtttaacagaacttgcagtatagttctgagatgatccccatgagtttctaagcttttactgtaaaccagaatatcatcaaagaagaacagggcgaattttctcaaatatgggttcaatacctgattcatgagagcttgaaaggttgaaggaacatttgtgaggccaaagggcatcactagaaactcatgatgaccctcatgtgtcctaaaagcagtcttagccacatcttcctctttcatacgtatctgacggtaccctgattttaagtctaacttagaaaacaccttggctcctcccaattcatccagtaactcatcaattactggaatagggaatttatgtggtacagttaacttgttgagggcacgataatcaacacataacctccaacctccatccttctttttgaccagaatcaatggactgctataagggctgttactaggtctaattattcctgttgatagcatttccttcacaaatgtctctatttcattcttctgatagtatggatatctataaggtctggtgtttggaatattagccccctcttttaaaattatggcatgatcacaacccctctcaggaggtaagtcagtgggttctctaaacaattctacaaattttgtcaacatagttcccaaatatggctcattctcctcattgctggtgtcagtgaaatcagcctcaggttggtatgaaatcaagtagccttccccttcattatgcaacatcttaatcaaggctttccaagaagcctgagttttgcacaaggaaggatcaccttccaatttcttcttctcacccttgtctctctagttcaaaaccaaacttctaaaattagctctcacctctcctaagctagccaaccaatccattcctagcaccacatcagtccctcctagctccataataaagaaatgttgtacaatgaccaccccttgcactacaatttttaaattctgacacattcctctattttttagtatctcaccactgcccacctccaccagaaattctggtgtctccaccacatgaagtttgagttgttctactactttcctgatataaagtgttaggccacagataaaggaagtatatgcagcaagatcatatggcaggtttaggaagaagctagaacagttagtggtacctgtaactgacaactgtcagttacagcttaatgggtaatagctttagttacctgtaactgagtgttaccagttacagttgaggtagttagctttaaatagtagctactaagctgtgaatagggaggctggtattatggttggttggttagggaggctaggctcaatccctagattgtaacagaactacagagaaataaaagaggagattaatcattctctatcataaatttactagaagctccacaatcaatcaatagcaatataggttcattcttatagtcccatagttttgaagaatctattggatgtcaaaccttccttgctctttagagatagctgcattactttagcagtgaggacctcagggccctcttgctcatcttcgtcttcttctcctgaatcttctcctgttcctccttccaccaacactatctgataatgtttcattttgcagacatgatctcttccccaagtttcaccacattcaaaacataaccccttcctgcttctctctccgagttcagcttgagagagttttccaccacctactgtcttcctgtcagccatctcaccctatgcccctttgctgctagttccctccttatttcctcccttctcccatctagtgaaacctttagtgtgttttgtaacgccacgtgcaaattcagggtcattaacaatcattaatcaaccatcaacacatataatcatcagagtttaagcagtttggaagcataatataagagtgtcatcatcaaatgccactaatataactactgtacaatataatgtggtgaatatacataaaggctctgtttaagtacaaaactgtacatacaactcccctcagggtaccaaaactaaacaaaggcaatatacaaaacatcagagccacagactcatatcatccatgcctaaggtttacaaatagcaactatccctgcataggcttcttgccttgggatctatctgctcctcctgaggaatcatctgcaaaacataagccccacaaaaggggtgagatataaaatcccagtaaactcagggcccttgaaggtatttccttctcctggttcacttcagacatgtacatggaaatagtatatctaaatcagccatactcagattctataccagaaaattactcaaacatccatcatgcatacaaggatctcatttcccttcattaaacatcatttgcatcaattcacatccacttgtcaataatcaggtgatacacacggcctacagccattcataacatacatcactatcctgcagaggctacatctatgtatataggaacatctccacttaggaggctacctttatatactaggaacatctcatgcccggatctcaacatatctatctgaggccacatctgtatatataggaacatctccacttaggaggctacctctatataacaggtacatctctttctagggaggcttcctctgtatatataggaacatctcaatcaggaggctacatctatataacaggcacatctccacctgataaggctacctctgtgtatataggaacatctctacttaagaggctacatctatatcacagacacatctcataatttatctcaacataattgcctgaggaggctacctctgtgtatataggaacatctccattcgggaggctacctctatataacaggaacatctcacaacaggtctttctcaatctcatgtcatctatcctactaccataggattctattccttcacagaattcacattcaaatctaatagtcaaccatgcatatcataggctagacaattcatagccatacacatcaatctcccatcacagggttcagattacatttcaggcatctcatatcaatacacatcaattcccccttcacagggcacataatataattcaacaatcaatcacatcatcatacaatttccatatacatgtatttactcacatcaaaaccatcactccatctggagcatggtggaacacagtaaggacacacatgcaaggaccaagagcttacctgctctaggcacaacaccggctctcctggcttcgtggtcaccaccaccaccagaactatcaagctcacgtcctacataagagcaacacataacttatcaataacggtcctaagccattaaaacgaaaggaaactataatcctttctgcataacacataatcaatcacttcacaagtgattctcagaccctccataggatccctctcagcctaaccaaggctccagagcctctcctaagactctgtttaggctaatgtaaagcatatccttgctttagccctctcaattccaagcttttcaatacaaccaattcagttcataaacaacatctatactatctcatgagcaactttatcaactgctctaaggttcataataaccatataaccaaccttttctctactcatacataactcagccaaaatcaaacttcatcaataatgatgactcaaggctctaacttcatcagaacaaccctctgaacacaattctctacagggtccaagcctaataacaactctaacacctccaaaaacacttctcaaggtacctcaaaatccaacaaaacccaatacacaaaaccaacggctagagctcgagtttcttacctctaggaagtcaaggaaaaccagggaatcacttttcccaagatagatcgcccatgcaaagcctcctttgactctgggttttaagctgtcaaggattcccctagagaactcgatctcgctgtttaccgcctcttgtcgagaataaagcttggtctctagcttatctcgaggcttagaacactttctgagttgggtcggaggtgtttagatgagaaacagagaagatatggagcttccctggtcatcaatggctgctgggcactcaaggaagaagatgactcactctctctctgccaattttcgtccagaaagagctatatataaggttgacccaaagatctcgcgcggatcgcgccataccccacgcgggtctcgccatttgttcgaaagcactgccctgattcgaaccttccacgcgggtcacgccaaatggccgaaagcattgccctgatttgaacctcccacgcggatcgtgccagatccacgctggtcgcgcgagatggctgaatctgcctcttacttttcttaagcttcctcttgaaaacaaatctaatgcatggttatgttttctaatcccaaggcttaatcccatgcttaaattcaaggtattacatgtttcaccaatggtttctcactcatcctcttctctgagctcgtcagcccagccttatgcaaggcattgttcttttcttccaataacaacgctctgtccatcgattcatctaaggttctagaggcgtgtagtttcagtttagcttgaatttcttctttcaagccattgataaaaatccccttcagcataatcctctcctccttcttcaatggagcagattcacgctcaaatctctctctgtacttcattacagagcttgtctgtttaatacatagtaacgggccaaacgggttctacaccaatcccggttggaaatgacagatcaatgcagctttgaactcttcccagcttagctcttcactctgatcttcctaccagtgataccaactcagagcctgatcctctagggcgattacaattgcatcaagcttgtcttcctcttccaccatgttcaatttaaagtaacgttcagctcgcacaatccacccatatgcgtcgtctccacagaatatgggattttgagctttcttcctccaaaatcaaacgacgattcatgactgctacttcacgtcgtctcactcgcaccatcatcactttccactacgcctccttcagcttcatttcgctgtctgttcgtgcgttgtctttgcgttcttccactatgagaacgactgtgcgaagtgattaggttcttcagctcagctagctgctgttccaagccatccatacgtttttccatcacgtttcgcgtcaacaccatgcactcccagaaacgagtgcactgataccactttgatagaactcacaaacagagaattagaaaggaaacaggattacttgtattatgacagcaattcagaggatctctctgaattgttgtaggaaattacaagaaatatgggtaaaaaacaatataacagtgtagttggcaaaccagtagacaattcccaacccagccctgtcccaatacaagcctgaaaagcataaagtaaggctacctcccctatatacacccttctctctccaaatcagcaaatcaactgcaatcattaacttctccaaagcagtagtggtgccccaccccccacggttccatttcccacattcataaaccttaggggaattcctagtttgtcctttattaactaggtctgtatcagtctccaactctctgaaccaccaggaaccataaatgcttctttcaagcaggacagggcttcagaaatcctcttatctgcaatgtggccctcagaaagaatctcccatgtatttgaatttggaatgaagccatcattcgacatctgctcaaagaaactaaaaactttatctgtgtcttctttcttaacataccagcctatgagaaggtttccaattctaggatcataacttgactttactgaaatccattcctcatatagtttttctgcaccctcagtatcatccaatttaaccagagaagaaataatagcatggtatcccaagtttggtatacttcgaaaaattgatttgtaagtattccacacacgatacacttcgtctttctttccaacacttccatataaactcaggagataatgaaaaggtattctatctcgacctttaattccaccctcaacctttcttaagcacttttctgctttttcattctgatccatcctaatgtacatcgaagccattgtgctgaatgtagaccagttagggacaatggtaggatccttttgcatttgttcaaacagttgttccatcttttctactgatccttgagatccacacgaagataaccagatattatatgtatagatgtctagctgtatatttttccccatcatttcagaagccaacatatcaactttagaatattcattaaggttcatgtacagagtcatcattacattaaatggtagggcatgtataacataccctttactcctcatagtatcaaataaagattctgccttttcctttgatctagaatgcacatatacattcaatagggcaccataagtcttcttatcttttaacttatcttccagactcagaaagaatgcttatgccctagaaactccacgaacttttgcaattaaatctaactgaattgctgcatcactctcagaaactctaaaccgctctggtctattgttcatccaataatatacctgaaacattttctcattgctttcaaaaaattgtacatggctgataaagacatttgaagcaaataagtaaacataatcagaaatggtaattgatttcataattcataattccatacattccaaaggaagcatgccattaaatatagtggcccaaaaaaggttttccagattattcaaattttactgacagtgtttgcaaatctagaattaacaactaaaaatgttgttacagattatgttattgtatatgttcatttatcccataaaaccaaatgccctaaataaataataaagaaagaacatttctgatatagcttctatggaatcaatcaggtcttgttatagtctcatatagcccacccctactcctttccctggactatcttttgaaacatgctacatttttctgacaatgccaaagggggtgaagcaatctttgtttcctcggagtgaatgatagtccaaatgttatacctcacactgaatatgtcgtatgtgtgtgttattatacaatttggtgtccatttgtgttgctttagtctttgaaaatgcataactatacaaattagtaactggaaatgttaattcaaagataagttcacctaataatttcgccctttaaaaaactattttttatttattgacaccaaaacagcacaaattgagaatccccccagctgccacggtgcaaaaaaaaaaagtttttaaacatcatacttcaacccctaatggtatgttcttctatttatttggttggagagaaaaaggaaagaaaaaaaacctctacaaacaaaattcaaatttctctgttgttttccttccaccctaccaaacagacccttagtttttctcatacagaactaattcttatttattcctaaatgtcaactatgggaccaaatcatggtttaaaatacagtccacaatagcagtttttgccacactgatgtttttttgaatttccgcaactgcaatttctcacaatatcaataatcacaacaacaccaaaaccacaatttaaaacctgggaccaaataattagttttatgaagaagaaaaactataggctgtctagataaacttctctataagcacttttaggagaagaaaaaacaaattagcttctccttaagctcatattagcttagcacaaattaatttgtagaagctctcttcatttagcttctccaaaatatgttttttcacctatgcacatggttttaaattacggtttacaacgtcaacgtattttgtcactctgtaatcgcatcacaaccgcgattgcagcctgatgtgttgcaaacacatcttagttttaggatagttttaggttataaattagataaataagttaggaattagaataattagctaagtttattattatatttaatttaatctcatatcattaccatttgtgcattttagggcttaaaagaggagaaacaaggcaagaaaagaagaaaagcaagtctgaagtcccacgcagatcgcgccagatcccgcgcgggccgcgccatagtccaaaatcagcgtccaagctcgaagactccacacggtcagcgtgagaaccgcgtcatccgcgccacaaggcctggaagtagttttagttcatccaaaccgtgcgattagcgcgggatcccgcaccatcagcgccacgaaatcgctgttgcctgattttgcaagatttgattcgaaattggcataggagacaggcctagttactctaattaaatctatctataaataaaggcctctggggactgaacaagacaacaatatataccttttaacacctctccacacttccacacatcattctaaacccttggaagacaagaatcaaggctaggtcactgcagaatgttttatttgacagcttttggtttcttgaagcctatggcaggctgaacttgtattgtgggaaggccatgaactaatgagaactcctttgtaacttgactgatattgagcaataaatgttgttttgattgttttattctactctatttttattgtttattcttatttggaattggccattctatctaagtattgagggttaggattcgcaatggggacgttgggattctaatttctgacttgtttagaataacagttgttcatcacctagggatagggatgcatggctccagactttataatatggtcttttgaatgcttaaactgatagacttcactaaggaattatgtttttgattcaggttaaagggttaattcactaagggattaaggattaactaaattaggaaagatttatcctctgagcaatcatacaagaacacttatgatttattctctaaatgcttaatttgacagtatcgctaagggcttagtattctcgatcgaattaaagggttaagtcgctacttatctaggatttacgaatataggagagatttattatttgtgtaacttaaactgataaaccagtcaagtgaaagaggtatgaatcaaaggggattgtgcctaaccacaattgtgtcttccattggtaacatttttactattttactgcacttatttaatttctgtttattattcaaacaccaagtactccaaacaattcttctttattttctgttttattttcaatcacttagaattataattactgtgaatttcaccccaatccctgtggagaatgatactctacttacccacttatattacttgaaaacgatcggtgcacttgctgtagtgtgcggtttttgcaacaagtttttggcgccgttgccggggattggttaacggatttttgcagtaatttttaatcttcgtgattggaatttttattactaattgcttctccaagttttatgcgaggtttagtcaatcctgaggatttgcagttcgatcctgaaattgaaagaaccatccgaaggagactagccatacaaagaagaagaagaagagaagctgcatactttgattttgattcaattccagaattagagtcagagtcagaggaagagatggctgaacaaagaaacaatcagccaagacttgaggatgaactgatggggcaaaagaacccaaatggtgttttttttcaaaatatttaccgataaggggctgtttcacaaatatttacagaaatggggttgtgtgacatgaagtatttacaaaactggggctgtgtaacatgcctggatcaggcatgttacaacatgcctgatccaggcatgttacagcaaccccaattctataaataagcgcccccccacccagttcctcatatattggcttccagtgttgtctgcctctactaaactgccatcattctggtgtttttttcatttttcatagatttttgaaggtgttgtgagtgacgagaaacatgagttcaggtggtaattctgttcgcgttgtcttttatgttatgacataaaccacaaatgctaacttgcaattactaaactatcactacacatacgtcctctcgatccagggattcgaaggctgtcctgtagtacaccaggtcgtgcgagctaagccggggtagtcggttaaacctgttaacaaaacaactaacattaaacaatgtacgccttaattgtttcagttgtaataaaatgaacatgtagtcacacatatcggtggccaaaatgcgctcgtgggtcactaggctgcggaatacatggagcagttggtgggaatctcagccacgcccacgcctgaagtaacatatggcatccaccaatgtcctttctggacgcatctgtacactcgcacatctgtctaaacaaatgtgcaaggaccgcagagccccagttgtatcctctgatatctgggaaatccacagccaacaaagggatatagtgtgctgccatcacgctacctccagatcgatcgcccagcagccatgaaccaataaggcgagcaatgtgcgcctttgcaaaccgcgtcacattgggaaaatctttgtccaactcaccccaatctccaaaatgcctatcgaagtaactcagccttaggtatccaccggtcagctctgtgtcgtcgtcaggttcttcaccgaaaacgtcctcaatcacctctgtccaatcggacaaagtcactccggtgacggcattgccagccgtgggcaatcccaaaattccagccacatcttgtagcgtgatagtcatctcgccctgtggcatgtggaacgtatgggtctttggcctccatcgctcaaccagagcactaatcagggcagcatcaatctaaaacaatatcattaatcaattgacaactatagttatggttaaatcaaatttgattactagtatgacgtgttccatacctgaatatgtcgcatgcgtgcgacatgaagaaagccagtgtcccggagcatatcagaaacgacttcaggaatgtcgtcatatgctggtccccccgacgccttgccacgtcgagtctttagtaatcgtactgtgccctcgttccacacagattgtgaaacatgggtatgttgcgtacgcctacgcagagcgccccatctgtacggggtaggaaccacataagatgtcggatccatcggctcagcctcatgatcggatacagagcgaggcgaatcagatccagataaatcggccatattatcagtaacttcatacaccaaaaataaaaacccatgttaacaattatttaaaattcactactcagtaaaacaacaaatttctgaacactagaccccatttggcctacacccataaaccctaatgaccgcaccccgaaccctgaaccaaaccctaatccatgcaaccataaccatgacaccaaccctaaagtcaacgctggactaaacgtcacatacgtggccaaccaaacactaacccctaaaccctaaaccatacaaggccaaccaaaccatacaccgcacaccatcgtcacatgactatgatccaaacgtcaagaaaccatgcccaccaaaccctaaaccattaaccacaaacgaatatcacataatcaaaccataaacactacctaaccatgcccagaaaaccctaaattttaaattctaatcattttagccaaaagtacagtaccaaacatctaaagaattttctatccacctaaatttatgtcactaacaaattaacatcatcctaacatttttctaataaataaaccttaaagcctaaactaaaacaattatcaactaacctaacatctattgtgctaaaaaataagtacatgcatcattaacaatataattaactaattaagaacaacatcactaaaaggcagagcagagcgcttacttgttcgcaagattttctctgaacaacttcgaaattcagcagagcttcgctgcacagaatatccaccgaaaactctagagagaaggcagagcacttctagagagatagtggaaagtgaggaaatggtggggggggggcttatttatagaattgggcttgttataaaatgcctggatcaggcatgttacaacacgcccaaatctaggcgtgttgtaacatgcctgatccaggcatgttataacaagcccaattctgtaaatgttgtaacatgccttaatccaggcatgttacacagccccatttctgtagatatttgtgaaacagccccttatcggtaaatattttgtaaaaaaacaccatttaggttcttttgccgaactgatggaggatattctgtctccaatgttcaccagaccccactccagcattgtaaggccaccaatacaggctaaccattttgacataaacccttcattgatagtattggtggaaagaagtcagtttggaggggaagactctgaggacccacacgatttcatagacagatttctaaggatttgtgacactatccaacaccaaggggtctcagatgatgcggtaagactaagcctattcccttttgatgttaagggaaatgcactgagatggttaaatagacaaccatcaaataacatctcaacttaggagaacttaatctcaagattctttgcccaatatttttccatggataaatacaaccgggtggtgaatgaaatcactaactttacccagaatggaaaagaatccatgtgtgctgcatggaatagattccaagaattgatcaggagatgcccacaatatgacatgcctgtgggtaaacaggtacgtattttctttaatggtataactcctgaaactcgtatgattgttaatgttgcagcatggggcacaataagatcaaaaactgcagctcaaacatatgagctgattaaatctctggcttgtactgaaaataaaagcatcaccattcagccaaagagagaaccaatacaattgtgcagcaatgatgccatgcttgcagagcagaaaattttagcccaacaattggctaagttgaatgacaaaattgatagattacaagtctctgcagcccaagtttcagccagtaaaccacaagtcagttgtgaatactgccaaggtgagcatgactctaatgtttgtcccattcttgttggagctgaccctgtgcaggttaatggcgtttggaatgatcaaagacagcagcagccctatcagagaaacaacaattttgctgcaggaaaaacctaccagaggaacatttaaggaggaggattagactacaagtccaataattatctacagccccatcctattcccaccaccagtatttctgaacttgagaaggtagtaatgcagctgtcaaaaacaacaatagaatttatagcagagactagagctcaccacagaaatcaagatgcctccatctggaatctggagatccaaattggtcacttggcaaaacaaatttttgagaggccacaaggacagttccctagtgacactgttataaacccaagggaacatgtcaatgctatcaccaccaggagtggaaaagtgctcaatccaccaaaaaagcctaaagcaagcaacaaggaagctgagaagaaaaatacaacagctgatgcagaagaaaaatctgcagaaaatccccaggaacaaaaatctgcaccaccaatgaagcaatgggatttctttcgctttgagaaacccccatatccagtgcagaccaagcagcaactccagaaacagcaaattgccaggttcttagacatgtttaaaaagttacacattaatattccatttgctaaggcattagccaatatgcctaattaggcaaaattcatgaaggaacttttgtctaagaaacataaactaaaggactgtgaaaccataacactcactgaggagtgtagtgccatcattttaaggaaacttcctcctaaattgaaggatcctggaagttttaacatccctatagccataggaaatattaatgtaggaaggacactttgtgacttaggggctagtataaacttaatgtcattatcaatgtgtaagtccctaggcataactgaattaaaacccactagagtttccttacaattagcagactgttcattaaggaaaccatcagggataattgaggatgttttagtaaaagtagacaagtttattttccctgcagattttattgtcttagatatggagggtgaaagtgaaatccctctgttgttaggaaggtcctttttagcaactgctagggccttgattgatgtagaatagggaaaattggaactaaggatggataacgagtctgttgttttaatgtttttaatactgtgacaaatccatccgacatacttaattgttctaggctagattttttggataatgctgttagtgcaggttttacagcagatgaagaagctacagaagagaatgcagctgcagcagaaaattcagcaacaagtgcagcagagcagataggaaatgcagcagaaaattctgcagaagcacatataacaacagcaataattgctgcagaatccagcaaaacagcagacaccattgaaccggtgctgaaagtgctgcagaaaaaggaagatgatattctggtgggagcaccaaaggtaaagctgaaaaagatttcagaaacagctgtggcaacatctgagaagaaaggtgctaaaaagctagatgctgtgcaaaagaagcaccaaattgcaggacaaatacatgtggctgcagatgagaaggctgaaatctgcaagaagaagaagaccaagaaggggcgtaataaaattcgccaaaatgaacttgagtcaggacaaaaggtaatgctttcaaaatatcacctgaagtttccaggtaagtcagaattcttttgggatggcccatttttggtacaaaaggtttgttcttatggaatcatagaaatcactacattaggcaaggccaagacctttaaagttaacaaatgccggctgaaacttcacattgaagaccaagtggatagagatgcaattcctattccacttaaatccactaatgattaaaaagcatgatgcgtctagctaagatgctaaacaagcaacttttgatgtaaatacatctttttaagttttgtttttcttgtgataacaatagatttataattatgcatgtttaatttctaggcatttaggttcatgcatttttaagttaataaaagcaattaaaaataaataaaaaggttgttcaagaatgtggcgctaattgcgccaagtgtggcgccactcgcgtaagagacacggccaattcacgctgaccgcgtggacactcgcgcggatcgcgccacccattcgaccctgaggctcttatctgcatgatctggcactgatcgcgccaagtgtggcactaaccgcgccaagccacggtcatttcatgctactcgcgtgaacctcagcgccaaccacgccaagttttcgaattgaaagctctttcagtgcctattggagcgggtcgcgccggacaccgcgctaaccgcgcgggattgggaaaattgtttttaaagttgaattaactggatgttcaagtagatttaaattgagcctatacatgcaaggacccaaatctgggaatcattaaggttgttctcatgatataaatcaaattacttttaattcccgtgcatgtttggagtgaaattttaacttgcaaatgattgaaatatgaattgctgaagcaatggttaatgttagggttatgcttgcatgaaatatgtgaactctgaattctggtggaggtaaggaccttaaatcttggaatctaggtgagattattcaattctctgtcatgattgcatagtgtgtactgccactagtgaatttgaagtgtgtctgcataagatgttgcattatatctggtttagcacatctaatgaattaaatatgggaattgttgtcaggcacatccatggataataatgatttttgtggttctttgtattgatttgattatttcaatttgtaatatgcttgagaacttaaatctgggaatccacattgttaagccttgcagaatgataattgctctttgatacttgaagcttggcttgcattttttatctgcatttacaggtgtctgagacctgtttggggttgtggtgtaattgattgtaaacattgtaatttgtgaccccaaagtggacaacaaacagctggtgatgtaaaattttgtaatgagataaatctgggaatcataggaacactgcgaaattctgagcagtttgaattcccagatacgtgtaaacaaacttgcttgctgtgttaaaaactgtgctgtttattttgaatactaatcactaatgcacagtctagctgaatctgaaccaatgaaaggaataaatctgggaattcagccactgcatcaggtatatatatgttttctgttctgagttcagggtccacagagtgagacagacaagaaggaaagtgcagctgcacctggcaacaaattgatagaacaggaccatttattttgttttaattttactgtttttatttttaattttcagtatgcttttagtttagttgttttgttagttagctgttttacataagttctgtttggattaatgttcattctagttgtgattctcaaataatgcatacatgattgagtatttagcagcacataatcattttcaattattgttggggacaacaattttctaaatctgggaatgggtgcatatgcattatttgctgaatcacattcaagaaaacaaaagatgtccaacagaaaattttttttttagttttatcttaaatttttagctgaagatttcaataaaagttggcagcacatcagatttttttcagactaaaagtgaatggacatagtaattgataggaattctttgatgaaagcttgtgtgaaatgaaatatagcatgaattgcatgatacatgaatgaatattgattgttggtatatgatatgcatgttgaagttgaaatgttgcttgaaatgaagtcagcagtgattgacttgagtttagcacttgtgagattttgagccaaacagtaattatttttctttcggagagactccattttcactgtactctagaacttgaattgtttctctggatgcaggtgtgacttgacatgtttaaggcaattttttcttctgaaaaccagggccaaattgacttacctccaattatttttccatttgcacctaattttgagctttagcctttcatttctattacccaaatcagagccatatccagtgaccaatctccctgaggctagagaaggtacaatacaagtctatgacagcaaaaaaacagtgaagtgttcatcaaggcaagaaggaaaacaagtgaattcaattggtgtgaaagaacaagaataaacaagcacaggccagttgaaaaaaataataagcctgagattatcagctgaaaatctgaaagttgttgtattttgaaagaaaaagaaaagaaaatcaaaaataaagtttattgtttttttttatttagaataatgtgttgaataaagtaccagattttgaagaaaatagacaaggaagatggaagaccacaggattggacttaagggactggatctagcctcatcttagctacttttccaaagattttcctacccttagcccagccaagttacaagcctaaaagaccttttgatcaaattatgcttgcatctgttgagaatattttcaagcttatggtagtgctgtgactatgttgagtgagaaattgatcagcctgatacacttgagtgcatgagtgaataaacacatttttgtgaggaatactcaagttaactctcactaattgacagatttgaaagtaccatagaagctttgatgtaaattgattatactcagcatgatgactctaggattgtagattgtggtttagcttgattgttaatccttgctcttatcttagagttatgtctgttgctgaggacaacaattaataaatctgggaattgtttgatgtgttgcaaacacatcttagttttaggttataaattagataaataagttaggaattagaataaaattagctaagtttattattatatttaatttaatctcatatcattaccatttgtgcattttagggcttaaaagaggagaaacaaggcaagaaaagaagaaaagcaagtatgaagtcccgcgcggatcacgccagatcccgcgcgggccgcaccatagtccaaaatcagagtccaagctcgaagactccacgcggtcagcgtgagaaccgcgccatccgcgccatctagtcgaagctccagcgcgatgcgcgccacaaggcttggaagcagttttagttcgtccaaaccgcgtgattagcgtgggatcccgcaccatcagcgccacgaaatcgctgttgcctgattttgcaagatttgattcgaaattggcttaggagacaggcctagttactctaattaaatctatctataaataaaggcctttggggactgaacaagacaacaatatataccttttaacacctctccacacttccacacatcattctaaacccttggaagacaagaatcaaggctaggtcactgcagaatgttttatttgacagcttttggtttcatgaagcctatggcaggctgaacttgtattgtgggaaggccatgaactaatgagaactcctctgtaacttgactggtattgaacaataaatgttgttttgattattttattctattctgtttttattgtttattcttatttggaattggccattctatctaagtattgagggttaggattcgcaatggggacgttgggattctaatttctgacctgtttagaataacagttgttcatcacctagggatagggatgcatgactgcagactttataatatggtcttttgaatacttaaactgatagacttcactaaggaattatgttttcgattcaggttaaagggttaattcactaaggtattaaggattaactaaattaggaaagatttatcctctgagcaatcatataagaacacttatgatttattctctaaatgcttaatttgacaatatcgctaagggcttaggattctcgatcgaattaaagggttaagccgctagttatctaggatttacgaatctaggagagatttattatttgtgtaacttaaattgataaaccagtcaagtgaaagaagtatgaatcaaaggggattgtgcctgaccacaattgtgtcttccattggtaacatttttactattttactgcacttatttaatttctgtttattattcaaacaccaattactccaaacaattcttctttattttctgttttattttcaatcacttaaaattataattactgtgaatttcaccccaatccctgtggagaacgatactctacttacccacttttattacttgaaaaagatcggtgcacttgccgtagtgtgcgtttttcgcaacacagccacattagccgaattttccagtgatgtaaaggttttttggctcacacaacacaaccgcaacggcaattcaaaaccatgctatgcatgagctaaataaattaacttattggagaagttaattaatctttcgttcttattttcttctcctaaaaaaagtacttatagagaaaaagtttatccaaaaatagacatatatatcaacatttcattagtaaaaatcaaaaacacccaaagaaagagaccaaactgaaaggaaaaaaaaaaggttttaaagatagaattttgacctcaagagctcctcgaaatctcttgtacttcctcaactctttaacgactcttgaaagctccgccttgtgaggtgcctcccttcgtcctcccattggttgagcacctctacggaccccacttggggttttggtggagagatatcctgcggtagacgtcattccaacgcacgatggggcgacgctcacagtcgacggtgccgtagctgtggatgttggagatgcagcacgtgagcactgagatgttgggaaaaaaaataccaatttccccttccaggacctgttatgaatggtcctgcacaagcaaaatactttatgcacaaacaataattatacaaacaacacaacatcatttttaacgtggaaaaccttctcaatgtgagaaataaaaaccacgggaccgatctcgaagtccactcaaattcttcattatcaataaagtgagattacaaaatggttccaacaaccattacaattgtaataccctgagatttaagcatgtaattaaccctgggtttaaggctataatcatgtgctaattatccaaaagggcgcatttagcagaaaaccctgtcaggggtgcggcgctgatggcgccaggtctggcgctgagggtgccagagcactggagtgtggcgccaagagcgccaggtccacgctgagggtgccacggtctctgggttgtggcgccaggagcgccaaaggtggcgcctggggcgccaagtttcccaggtggtgcggagagcgccagatgcagcgccggtggcgccagggtttctggaaggtggcgccaggggcgccaggtgtggcgccaggtttccagctggagcgaatggcgccagatgcggtgtggatcgcgccagaggttctggaacgtggcgctaggagcgccagatacggcgctgatggcaccggagtttctggagcacggcgctgggagcgccgcgggtcgggctgagtgactatttaaagcccaaaacgcgaaaattgaaggggaaaaggtcttcttcttcttccttctgccctaaactccattgttgaccatcccaagcttccttgagccatatttcttgatcaaaacacttccctttggctcttgattgtgagagaaacactatggaagcttgaatcactcatcctttctcttgagaaaccccttttggtgagttttgaaatccccaagagaaagcttagagaacttgagtgtggctgagacccattgcgtggaaaggacaccggagctcgaggaggtggtcctagggtcgtcttggatgccgttgaggtaaggaactcaagtttctccgtttgattttgagattgagggtttgcatgaatagtaacccatatgtgatggggttggaattagcccaaagtcctgtagagacttgtgttcagggggttgttgtgatgatgttagagccttcagaaatcattattgatgaagtttgattttggctctgagacatgcatgtatagagaaaggggctgagtgcatggttatgttgaaccctagagtagatgatgaagtactcttaagatgttttagatgttgtccatgagctgattttgggttgtatgattgagcttggacatggtagggctaaggcatgttataactctgcctgtggcgcggttggcgccaagttccgcgcgggtagcgccgggaccatttgtgagaaaaccctgtggagggagcggctcgggtcgcgccagggttggcgctggtcgcgccagaccacactggaaagtggcgctggaggcgccaggccggcgctggtagcgctagggtctcgaaaggttcacgcttggagcgtcgttggtggcgccaggggcgccaagaatcccagttggcgcggttggcgcggggtttggcgcggatggcgccagaggttctggagtctggcgccagtagcgcgggagtggcgctggtagcgccgcagccaccgacatgctggcgcgagtcgcgccgggtctggcgcagatcgcgccagacctcgggcaagcccagtatataaaggggaatcgcgttttctgaggagaaaacctctcctccttcttccccacgaccccagcagccattgttggccttcccaagctttctaggaccctatatcttggcataaacaccttccaatagcctttgatcttgagagaaacctatgagagcttgaatccttcatcctttttctttaaaaattccgttgtgagcaaatcccttttcctcagagaaacctcaaaaatcaagcgattggcgaggacccaaggccgggggaaggactctggagctcgaggaagctgtcctgcaaccttcggggtcgccactgaggtaagaaacgtgtgtttctgcgaatgatttgggatttggaatttcctgtgaatagtgacccatttgttatagggttagaattagctctgggtccagttgagagaagtgtttagaatgatgtatggatgaaggattagctttcaatttgtgatttggggaacgttggttctggctctaggatatgcatgtgtgacttggactgagtcacttgacttgtgacatgcaagagccttggtgaggggcttgtggtgcctatgaggcccaaggaacggtgtctagtaggaaagaccgttcaagccctgggaaatcctgaggttttgggttatgtgagctcaaagctcatgaagaatggcgaaggctgagtctatggtgactctgaggccatatgtgtttggaatagacaactgagggtctgtgaagaggcttgtagagaaagaagcctgaggaaccttaggctgaggacctaggttagtggagaggattgtgattcctttccctgaggcaggagtgactgcctgatgagcttaatggttgatgatatgtttgaatggtctgtaatgtgctgttgtgtgccttgtcaggacttgacactttgagtgtcaatgaagcagaccatcaatcaaggagcagagctgtgaggcacggataagaggtaagttcatagttctggggattcgtccctttatcttgtttgccaccctggtgggtgaagaaatgcatgccacgcttgtgttgatataagtatatatatagatatatgtgtgtgggcatgctgtgtggatttaatggccaatgtggcctatctgttttattgtgtttgagcagacaccaatatggtgtcatgatatgatatatgaaaccccaggttagacactgagagtgtgaggggaatctacacctgtgtgataggtgtgagaggccttggggcctggatggatgaacactgtgtggtgttcgatgtttggatgagagctgcagatcagggaaaagatctgtgatggaacctatagggtaccgcgatggtatcgggctagctgaggttccctagccaaaggaagagtttgaggactccctggaatagctgagattccttgggaggtgccactgctctccaataaagtcctaaggatggtttactttacatggatgttcctccttaggcagagatgatgagagtcctgagtgattatccttaggcgtttgtgttgagattgataaagaccatagtggtggtctgtgtttgaggagagagagacactgtgattgtgtctaagttctgagattctctggccagtagaatagagttctatagtgataggacagcggatatgtgattggaagtcctaagagatagagtgcctcctgtgtgagatgatctctcttaggcatgtggttgaggacctgagggatagagtgcctcctgtgtgagatgatctctctcaggtagtggtttaacagtctgagggatggagtgcctccctgtgtgagatgatctctctcagaccatgattagaagtcctgagggtagagtgcctccctgtgtgagatgatctctctcaggtagtggatctggaagccctgaaagatgagtgcctcccggtgtgagatgatctctttcaggcatatgttgtaggcagatctggggaacggtgttacctatgtggataattccccaggcatgttgaaaagaagtcctgagtcgagaggattttcaggcagtatgtataaagacctaagtaagtgattcaggcaatgtttaagttgttatgagacggtgcccctatggtatatgtagtgtccagtggattgacactgatgattaggtacctctgtgagacctctgtgagacgtttgaaagagacagtatagtatgtgaataccatgataatggcatggctctgtgagataattctggtatggcttgagagcctatatgagatagaatacctctgatgctgagagcatcggatgatgtcccaggtagttgggattgtgtgaaagctaggctgtggcctaggtgctatgtgtatgagctgggataatatccttagctctgttatatatttgtgtgtgtgcttggaggtaaaccagggtaagggaggatctcccagacctgagcttactgagacgtatgtctaaccctgtgtgggttttgtggttttcaggtgcacttcgggagcagagaagcgactttagggcaagagaccctagtggatctgataggctggagagtgggctgcagtagaagaccagagttgagcttcaggactcgaagcctgtcttagtctccctgtatagttgtaggggtgtgtacacccgcttgtactgtacatatttgttgtaagaccagtatgatctagttgtcgaatatgtatatgtatagaggtttatcaacagggttgtcaaagggattaaattcagggtaagcttatttggcaagaggcttatcagaacaaaaatgccttaatcatatccaaacatgcatgagaaccaagaaatatcaaacagagtcaagacaaggcaactgtgcaagcaatcaagaggtatagcacacatgaaagaacagatagtggctcaaatcctcacacagggtatatctgtcacatttaaatcaacctttcaaacttcataatcatctttccaagtaaagaaaaacatggatttcaaaccatacagtatgaagcaactcttatctaagcagaagtaggtgtcaacacttattcaaaacccagaaataaaaaagaaacatgcaaaactatacacaggataacaaaacaaacaaaaagaaaacaacaaaaacaaaacaaaaagaaacagtctctcccccccccccacacttaaaattacacattgtcctcaatgtggcacaacaaaagttcagatggacaagtgcgataaaataaaggaggagaaagaaaaagaaaactccctaaagtgtagtggaagatggaagggagtcaggtttaagcagagatatctcctccactactgcatccagcaaggaaggattgctgaggaatggtttgagacagtgtccattgatcttgaagctctttcctgtggactcacttttgatttcaactgtaccataaggataaacattagtaacaacaaaaggtccaatccactttgaccgtaacttaccacccatgagtctgagcctagaattgtacaggagaactttctggccaacctcgaagtctttcctaactatcaggctatcatggaacttcttggtcttctctttgtagaactttgagttctcataagcttgaaggcggatctcatctaattcacttaattgcaacttcctttcctcaccagcttgatccatggaaaagttgcaagtcttcacagcccaataggctcgatgctcaatctcaacaggcagatgacatgccttaccaaagacaactcgataaggagacattcctatgggtgctttgtaggcagtcctatgagcccaaagagcatcgtccaatcttatactccaatcctttctgttgggctggaaaactttctctaagatcctcttgatttctctgtttgaaatttcagcttgcccattagtttggggatggtatggtgtagagattcgatgcacaaccacatatttcttgagcaaagcttgcatggatctgttgcaaaaatgggttccttgatcactaatgatggctctgggtattccaaacctgcaaaatatgttagatcgaacaaaatctaccacaacccgagcgtcattagtcctagtagctctggcttctacccattttgaaacataatcaacagctaacagaatatatgagaaaccaaaagaagcaggaaaaggacccatgaaatcaataccccagacatcaaacacctcacagaatagcatgggttgttgaggcatctgttgtctccatgtaagggatcctcctgctctctgacactgctcacaagtgctacaggtctttgccgcatctttgaagatggtggaccagtataaaccacaatcaagaaccttgcgaactgtcctctgtataccgagatggccacctagtgcggaggaatgacaaaactgcaagaccgaattaatctcatgatctggtatgcatcttctaatcacctggtcactgcacaacttccacaaataggggtcatcccaaatataatgcttagcatcactctttaatttatcaatttgagctcgtgatgccaagggaggaaaaacagaagcaactaagtaattcacaatattagcaaaccagggggtggaatttgaaacagaaacagaagaaacagtcaaaagattttcatcaggaaaattatcctggataggcaacacctcatcattattctcagctccttcaattctgctgagatggtctgctaccaaattttgagctccactccgatcacggatatccaaatcaaattcttggagcaagagcatccatctaatcagtctaggcttggagtcagtctttttcaacaggtactttagagctgcatggtcagtataaacaataacaggaaaaccaagcaaatatgatctaaatttatcaagagcaaacacaatggcaagaagctctttctcagttgtggtgtagtttgcttgggcagcatccaaagtcctggaagcataatatatcactctaggcagcttatcaactctctgtgccaggacagctcccaatgcataatttgatgcatcactcattaattcaaacgagactgtccagtcaggtgcctggaggataggagtagtggtcaatgcttccttaaggtgatcgaaagccttcttacaactatcatcaaaattgaaatccacatctttttgcagcagattggatagcagaagggcctttttactgaaatctctgataaagcgcctgtagaaacctgcatggccaagaaaagaatgaacctctcgctcgcaagaggggtaaggcagatgtgaaataacagatacttttgcaagatctacctctatgcctttactagaaatgacatgtcctaaaactattccttgttctaccatgaaatggcatttctcaaaattcaagacaaggttagtttcaatgcatctattcagcactttatccagactgtctaaacacatgtcaaaagaagatccatatacagtaaaattgtccataaacacctctatgcaattttcaaggaaatcagagaatatgctaagcatgcaccgctggaaggtaccaggggcattacataggccaaaaggcatcctcctataggcaaaagtgccaaaggggcaggtgaatgtggtcttctcctgatcctcaggagcaatatggatttgaaaataaccagaaaaaccatcaaggaaacagtagtgagatttacctgccagacgctcaagcatctggtcaatgaatggcagcggaaaatgatctttccgtgttgcttggttcagccttcggtaatcaatgcagaccctccaactgttttgcactctggttgggataagctcatccctgtcattctttacaacagtgaggcctgtcttctttggaactacctggactggactcacccactgactgtcagagataggataaatgatcccagcctgaagaagcttggtcacctccttctttactacatccaaaatcaccgggttgagtctccttcgcggttgtctcacgggtttagctccatcctccaatgatattctatgcatgcaagtggatgggctaataccagatatgtctgccagggtccagccgatggctttcttatgctttttcagaacttgcaacagcttgtcctcttgatcaaaatcaagggaagtagaaatgatcactggcaatctctcatcactctccaagtaggcatacttgaggtttttcggtaaaggttttaattctggaatgggggcaggctgatcagaagaaggaaccaaagatggaagaagaatgggttccacagcctgtacctcaacctgcaagtcagattcttgtgtactccctgaaacatggttagtgtattctgactctaaagaatttatatgcagaggtacaacacccaatacatcagaattaatctcagaactaacatcagaattaatttcaggctgaaaatcaaagatggattcattgtcagattcatattcatccatgcatgcaagagaagtataaagatcagatagaaaacattgttttgtatcatggagagaataaaaatcagaaacatactcatcaacaacatcatcaagaatctcagcacggaaaacagaatgattttcagatggatgtttcatggcatcaagaatgttaaagtgaacaacaatatcaccaaactccatagtcaatgtaccagcatacacatcaatcttagttcgggctgttttcataaatggtctgcctaaaatgagggggacagaaccagaactatgggagaatccctcctccatatcaagcacatagaaatcagcaggaaaaatcaattcaccaaccctaactaagacatcctcaatgaaacctgtagggtaggcaacactcctatttgccaactgtatcactacaccagtaggttgcaagggaccaagagacatagatttaaaaatggacagaggcataacatttatggaggcacctaaatcaagcattgctttgtcaaatatattattaccaataatacagggtatgctaaaagtacctgggtcctcacatttttcaggcatgtttggaacagaattacctgtcatagaagatacatttctacccatgctgactctctcaattccagtcattttcctcttcctcttattagtgcacagctccttcaagaattttgcatatttcggaatgtgcttgatggcatcgagcagaggtatgttgacctctactttgttgaagatctccaatatttccttatccatctcttccatctttttgtttggaatcgatctaggaggaaatggaagagggatgggaggctgctgctgcacatcagaactagtgctagaagaagatccacctgcacgaatttgttcatcactttgctcatgtattggtacaggtgcaggggtaggaactggtatagatggaggtggggacactgcagcagtaggtatatcaatctgttttcccgacctcaatgtgatagcactaacatttttcggattctgcacagcctgagagggaagtctatctgaattttgtgactgtgcttgattaagttgagtagccatctgccccatctggttagtcagactctggatggaagctctggtctcttgctggaattgtaaattttgaagggtcatctgtctcacaagctcctccaatgaaggttcagaagtagaaggttgaggtgctggtggtacaggtacatcttgttgttgcctctggtactgctgctggactggtggaggtacataaggtctggttggagcagcagaaccttgaaatggtggtagtggaggctgttgctgttgctggttgtttgaccatctgagatttggatgatttctccaccctggattatacctgttactggacagatcataattctgctgctgttgttgttgaggcctattgttataaatgtttgcagcataggcttgaggagcatcagggccaacaggttgctgcagagagggacatgcatcaatatagtgatcattggaagtgcagacaccacaaactctggcaacagaggcagacttttggttaacagcaagctgagtcactaaattaaccaaagcatctaatttgccctctaatttcgtagctgcagatgaagaagaattattagcagctacatcatgaacaccacgaatcacaatagcatcatttcttgcactaaactgctgggagttagaagccatcttttctatcaagtgcctagcttctgcaggagtcatatcaccaagtgctccaccactggcagcatcaatcatactcctctccatgctgttaagtccttcataaaaatattggagaaggagctgctcagaaatctgatggtgtggacagcttgcacacaactttttaaatctctcccagtatacaagctttctccaccaagctgcttgatcccagaaatatccttcctgatggcagtggtcctagatgcagggaaaaatttctccagaaacaatttcttaaggtcatcccaaccagtgatggacctgggagctaggtagtacagccaatcctttgccactccctctaatgaatgtgggaatgcctttaagaatatgtgatcttcagggacatctggaggtttcattgtggaatagactatatggaattccttcagatgcttgtgtggacattctcctgcatgaccatgaaacttaggcagcaaatgaattagtccagttttgagaacatatggaacatcctcatcaggatactgaatgcataagctttcataagtaaaatcaggtgcagccagttccctaagagttctctcacgaggtggaggttgagccatattattctcagtattaaaataatcagcagaatcggaatcagaaatattatgcacagaatgctcagaaacagaatgctcagagtgcaaactaatattatctaatggtacagaatctaatgaaaattgcctagaatgcctaattaatctatggtaggtcctatctatctcaggatcaaagggttgaaagtctcctggattacctctagtcatgcactatatgcaacataacaagcatttggcagacaagcacaaagaggggtaaaactagagctatactcaaacgaagtccaaatgaactaaattttgtgagcaacaccctaaaatcatgaaaagatagcacaccaaatttcaaaacctaattcaaaggataactaaataaaaaagattaagaaaatatagaaaaataggaaaataaaacttaaaaaataaaaataaaatagaaaacggcctatttttgaaaatccaacggtggccagcaggcgacgcttgctgggttggctagatcttttttttctaccccaaaagcatatataattaaaacagaattcacaattaaattgcagtgattaaaaaaacaagtcaaacccttagaacagattgcgcctctaatatccttggttcacgaaagataatctgtcctgcttaattctcatcagtccagattaatcaactaagcgaagattaatctaaaacgtcattacacgaattaagcaaacgtaaacctcgttaaggcaagctctcaaaattaagcaagctgagatttctgaatcattcaattcagaatcattaagcatgattcaaactcgaaaaacgcagaaaacgaattgcaaatacaaggaacctccagtaaaggaacctccattaattcgaaattaacaacagaaacgtaatttgaaacgaagttgaacattaaactgtaacagaaacgaaattaaacagaaacgaaaaacctaaagctaaaatgaaatagcagaaacagagaccaaaaacgaaattaaaagatgaagatgaagcagacagaaacaaaaataaaactgaattgaaacgcgaatgtattcagaaaatagaaaacgaaaacagaacagaggaagcagaaaacgaaattattctaaaaaaccctaaaaacgaaatagtgttggctgctaaagaaaacagaacgaaaattgtattgtaggttggttatctctgtatgggcacagttcccaaatatatagagtgactaacctagacgaaaaatgggcttttcctaacagttttggcccaaaaatgaaaaataaaaataaaaggaaataaaatgctctgaaaataatgctgacgcgacatcccaatcttcaagtccatgaattaatttcaagcccaattaattattaatctgccctgaaaatcaaattagaataattaaacttaaaataatccaaattaattaaaatctgaattatcggtccaattaaatcctaaatgagaaacaatgcaaaatataaacaattaagcacaagttagggattaaaatgagtacagaaagatgagtaaatagtgataaatagtgactcatcagtgttacctatgtggataattcccaggcatgttgaaaagaagtcctgagtcgagaggattttcaagcagtatgtataaagacctgagtaagtgattcaggcaatgtttaagttgttatgagacggtgccctatggtatat

SEQ ID NO: 40 - DNA, 750092 bp, Glycine tomentella
agagatgccacagaggatttcaatcctgataacaagattggagaagatggttttggtcctgtctactaggtattagagtgaacggccttttttcttccaagcataaaaatgatgttcctccctagcatttaaaattctaaacaactgttggattgcagggtcaattatctgatggtacaggtagcagtcgagtaacactcatcaaagtcacggcaggaaaccatgaatttttgaatgagataggcaagatatcttgtttgcaacaccctaatcttgtgaaacttcatggattttgcatcgaaggggatcaattgatattggcgtatgagtacatggaaaataatatcctggccagtgctttattcagtgagtttctacccagagtgcaaactattatgtttgtcttttgccttgtcatttattatatattttgtaagataaggtgccaagtgttaattatgataaatcacttggagatctgattaatctgaagaagtttgtttcccgcccttttccatttttctggatacaaaataaggaatgaatgagtgctatagctagttgtttttccttccctttgtctagacaaattaataccctgtgcttagattttatgctgttaaacttttcctttttcccatttctatcactttagcagctaggcaatagaattttgcaaccgtgattcatattaattcaaccataacttctttctgcatcttttataggctcaaaagatcaactgaaacttgattgggcaacaaggcttaggatctgtattagcatagcaaaagttcttgcatttctacacgaagaatcaagactcaagattgttcatcgagatatcgaagctactaaggtgttactggatgggaatttaaaccctaaaattaacagattagtagctttggatatcaaagctactaatctgttaattttgttttacagagggtatatggcaccagaatatgcttatggggttacttgtcttacaaggctgatgtttacagttgtggggttgaggtcttggaatttgttagtgggaagaactataagaattttataccaagtgataattgtgtttgccttttagacaaggtattctactatgcttcaatccctgatacatttttggcattatgaatcccttttgttttggtagttatccaatgcaaatatccatattttcaccattctaaagaaaggtaacaaaatttccattgcaggcatttcatctgcagcgtgcagaaaatttaatagagctggttgatgaaaggttgcgaacagaggtaaacccaactgaagcaatagctttgatgaaagtagctctcctatgcaccgctgtaacaccttcacataggcctacaatgtctgaggttgtgaacatgcttgaaggaagaatcagcattccaaatgctatccaacaaccaagtgattttagtgaagatttaaggtttaaagccatgagggacattcatcaacaaagggaaaatcacagtttgagtacaagccgaacaaacaatataacagaagtccttacacttagctctccctaaacatttggcaatgacctggtgttagttcatgatttcattgttgctgaccatattgcaacatgagatatccttagagcatagctgagatttaatcttttgggataaccaactgtaatgatcaccatttttaggatataacatttttcactccgtctttcagagaatatatttatttctagatccgtgtaaatttctaattgctcttgaagggtactttttttaacctgggtatttcattttgagatattattgtatggttcggtgcagtcccagttaatcttcatatgacacaatcacaagttttcaatttatgaaaacaaaattggcgtgtcatgtggagattgcttgaactaaaatgatctcggaccatataataatttctcatttaagaggtgcatatgaactccttttcactggatatacacaatatttggaggaagaatgtacatacgcacccttgaacttgggtgttatagcaaatagcaacttggagaaagaatgtacatacgcgtcttattaatctttgcgcgactgaaaacctgtttgttatatcttgctcaacttaagaacggcacattgagtttctcctttttatcaggtgtgtggtgtgtgggttcactgggttggggagttagtgagaattacaagttcagtgttatgctccgtatgacaatttttagggtaaaaagtaataatgggtgaagtaatacacctacgtagtgaagaagtgtttctaaggaataagaaatcaagtttcaacgctgccagccatcacagttatgagaaaagaaaacttcgagcttgttcagattaatttgtaaactaagccaccttccccctctttgacaatgatttagttaagactgatgtgtctaaaaaataacttcagtaaattttaaatctctttattttgaatattctactttggaaaaaaaattattattataaatttttattctcaaattaattccatctttgattctaatccattataaaggtgctgcaaacatgagcataatcaggtattaaaggtttaggaagagatgcaacacaagcaaaaatgaaaataaccatcataagttgataaaaagaaaccaaacatacttcaagaaaatataactaaaaagacaaattaaactactaatgtgcattccctaatgatcagcttggggcgtaggacgggataatatagagaataggtaacattcatgaacactttcaataatcactgtgggttccaattcggtcaattatgttagcaacagtttccttgctctcccttaggactttgacactcctctgcagcttttcacgctttccagaaattgaaggtgactcctccaacaacctctcaatcccaccaccactaggggatagcagatcatgaacaatctccttttccaaatccttgttaacaagattgttaatactcagcataagatgtaaggcaattgtgtcaatcaatcttttttgcactatcttccagtacgaaatcatcctcaccttcaaatcaaatgcttgagtaagcacagatgggtattgcctcaagtgaccaacttcaattttgcccacaccttcaagattcacatgcgatggattatgcggattgttcaaaacttcattcagaaaagtatcttgctgagatattaacttgttgtattcctgcacaaactccggattacaagtgtaatcagtatacatctccatttcaatggcctctattacatgattggtggaacttctctttttcttagaaataagaacctggcttgctcgcctggtagacatcaaaagctgatagtagttttcagaatgacgcgtgataactgaaaccagcacatcttcgagatagttccacacattttcaacaaaacctataggcttgttggcaatccctttcaccttcccttgcaatatagaaagaaaagcagtgcgaggcatgaaatttggaagaccaatccactttgcctcctccagcacctttatctcttgcataagaaaattcttgcttgcatcactttcagcacaatggtaaagatcattcgagtaggaatcaagcatctccaccaaccgggcagtacaatgcatgtttttgtcctccaggtactcatcaaattctcctctaagcaaaatttttctgagagattccttagtcaatccaataatatgcataaaagctgtcatggcatcagctactgaagccaagtttgttggcaacttttccaactcagacaaattgttagctagcttctcattgatttttttactatttctggcaaagttttagatatgctcatagcctgaacctgaaccagtttctgtgctagaactggaacacccacgatagacttgtctattttggaaagaagtggatggaactcaaacagtttctgttcttccactctagcatcctcatatgactcatcaccaatgcggtttctcacacaaacataaccaagaccaatgttcacatcatcggcagtaactttttctaacaagccctcaggagacttgtctgcctttgtgaccacagccagtgtcctgaggccagtttggtcaacactctgagacattctaatagactcacaagtagtgaaatcaacactagcagaaagaacattcaggataatactttcttctggcttaatgtactccatgatcatgtctttaatctggtcataaatgttctcaggttgaccatgaactggaacccgagttataccaggaagatcaaccattgtgagatcaggaacaccattcttcttcaccagcaaagtcaaagggttgttggaaatccctttaccatggcctgcaagctcttctgtggcagcatttatggcatgagaaacatttgcttcatcagtggaaacgattttgccattgaactccaagataagctctggggttggaagagggtggttttggagcctcatgaccaagggcaccctagtgcaaatgccttggccacgtggcaagctgataccagcaagagattcaagaacacttgatttgccagatgattgatcaccaacaacaacaatggaaggaagctgaattccctcctttgtaatgttaaggcgcctgagattttccatagcatcaagaactggacgtatcctctcattgtaagaggacacaattggtgcaacaatagcaagaggctgaggctgttctgcagatgggtcagtttcacattgagaaacagatagtgcaacaatagccttagtgctaggtctccttcctccagccattttcaatcacaatcacaatggtaaaaaatatagagagagagtgagagagggatagtttggtatgcttattcttattatgagtgagtgagtaaaaagccagagcttaaatgcatatttatagattaaaaaaaaaaaaaaaaaaaacttagaggaaaatgaaaggaaaggacagtttggtttggtatcttgaaagttgaaaacaagcgtgaattgagcttttcatgggaaccgcagttacagagctgttggggtcttccatgtttaggtaattgaaaggtttctcgttaaatgcatgcatggtagtaattgaattgccgtaaatattagtaacgaaaatttcttacattaattaattcaactcaagtagttttagtaaaaccaaacctgaaggggaatatgtaccaaaaaagaaaaaaactgaagggaatgtagttaaggaaaagggacaattcattttataattcatctgaggaagctataaagttttatttatgagtagttattactattgataacatgcttcggcagtatgtcctctctagtctctcacatactatggcatatgtatggtcgtgacctgtgacctgtgacctgtgacctgtgagaaaatctttgggtattgcttttgttgtcttaaaataaataaaaaattaatggtgctatttaattagtatggaaaatggtgaatatatactttgtttctttatgtatttttttgtgtgagggatttttgtttatttttggatgtatgacaggaaaaggaagggataaagagagaaaatactaatagatgataaaagatgcgatggaaaataaataagttttcatcattgataaaaaaaatactattacaatttaataataatataaagttctcttagtatttggaattttagacttaagatagaaaaaataatttgtttcattttttttatttttaaagaatttaaaatatttaatataaactctaacgaaataaattatagaggtttagagtaattctattctctataattatgaaattatgagccagctattttaggagaagaatttttatttttatgacttttagttttcgattaaatcctagtaaaactaaaagtttatagtcctgcattagttattcttctaaaatagtattttcgtttacaaacaaaagggtgaaaaaaataaaaatgaggaaaatacaattccatacaataaaatcatattttttttattttttttttatcattgggtgtttctgttacgtaaatggaagtaaaaaaaataaaacacaattttattatgcaagtgtgcatgagaatcatatttttgttgtgcttttttttttatccgatttacataattgaaacacatttttgtttgttgtgtttccattcaagaggcaatttggaaatacagctaaaaggcccccacttcgctagtgccaataggcaatactctgtagaatatgcaaaggcccatgattttcattcttctactgggccaacacaaacagcctcgggaccatcaattttatatgttcgagttaaggcatgtgcttcatacaccatttcattttcttatacaccatttgtttttttcgtaatacccaaaatgccctcctagtaaatggaaaataatatataaaggttaagcaaaaacgaccgagagagagagctgggagcagctgccgttcatgtttgcaatccattgtttgaggctttgagcttgtggcattgcttggaatcgccattggtgaggtcgttggaggtgtgcgagctgcagttcgaggtttggtgtcgccggagaggaagagcggaggttggggctgaggtaagctgtattttctaacgtacggattcggtaatccgcaattcaatggtgcatgcatttacggattaggcaatccgtatggtctaaacggattactcaatccgtatggactatacggattatacaatccgtatagctcatatggattgcctaatccgtatgatttgcacggattaagcaatccgtatgatctttacggattgtgtaatccgtatagtccatacggattgagtaatccgtttagaccatacggattgcctaatccgtaaaggtcatacggattgcgtaatccgtgtggatttgaaccatttaaaaaaatattaaaaaatggaatttattgtgaaaaaaataattttaaatattagtaatgccattttaatataaaaagtaattcatacaaaatagatcaggacaaaacatcagaaacatgataaccaacaatagctaaaaaactggagatagggatgacatgacgttgtaacaataacaattgtcaagtgcgaaataagcaaagtaatcatcgttgattggttatttaggtttcctgggtgactgggttgttgaaaatagctaggatttgtattggaccaaaacgtttccagtagttggattccgctaagacctttaacacatcttcatcggttatcaactcttttatgtcatattggattgtgttgtctgaatacgcgtagtgggatggttgtcgaaaaaataattttcttaccacctgtgagttgtgtattccataagggggaaccccaacaggtgcaacttgcttgatgacatccttgagtgtttgaatgttgcatcctgagggtatttgaaacatttttggatttgttccattgaacgaataacccacaccgtaaccgctctgtcgtgttctattccatttgccgttgtaatatagcattgcatcatgtgttcggccaattgtagattgaagtaagtttagtataccgtcggctgttctgttgattgtacaacatatttctataggaccaatagttgacatgttctcactagccattaacattgtgcaaacatcatcatcatttgttagttgtagagaatggaaaaaaatttcctgacctgcatttatagatggttgccgatagtacatttcatcaacaaattggtcatgggttagtacaagtgtgttgtgaatcctggtcttcagtgcctgagaagaacattcatcaggaactcgcattggcactggagtagaacattgaaaagaaacaccagtttcgtcgtgtatgattgatccatttggaaaaatgaatgctaatttggagttagcaatggtttgagtgctggtttctcctaagaatgccatagttatgggtgattttattttgcagatgtatgttatgtgggagaatgaccaaacaagtagggtgtccgtgttatttatagtagggtatgtgaaatttgaccgttgcacatggtgtgtcaggcatgtgtcatttgaccgttgcacatggtgtgtcaggcatgtgtcatttgaccgttgcacatgatgtgtcgagcatgtgttgtgtgcagttttttgtccagcagtgttgtctatgtcgttatgtcattttaccgttgcacaagctttttgattaactgtttaatgaatatgatttttgtgtgtggttttaacatgattaactgtaattatttaccgtgtatgtgtgtgttttgttagaatggacgacgatgagtggatgtatgagagtatcatggctgaagatatttacatgaatgaagacattgcaccagaccctaatgactttgaccacaaagactgttttatagattgttcggcagcgttccaaacaaatgaggtgagagtgtggatgacttataatttagtaatatgaatgtagtttaagtcgttaaacgattatatttgaaactttaaatatcaattatccttttgtgtaggtgtttgaatcgcgtgatgcggtattgaggtgggcccgtactgttgcgtctgagaatggatttgtggcggttatcatgagaagtgacaccaagaccggtaaaataggaagaacgtcatttgtgttaattggttgcgaaagaagtggaaagtatagagcgtggaaaaaaggttttttaccttcaagcacaagtagtagaaaatgcgagtgtccgtttaagttgcgggccaagccaatcgcgcaaagtgaagggtggatggtgaaggtaatatgtggtagtcataatcatgtaatggccaagtcattttgtggacacccatatgttggccgaataaatgttgaggagaagacaattgttgctgatatgacaagagcgatggtcaaaccgaaaaatattttgctaaccttgaaggagcacaatgcagataacgtaacaagtttgaaacaaatttacaatgcaagatatgcataccggacgcgtacaagaggtgataatactgaaatgcaacagctaatgaagcttcttgagcgtgacatgtatgtacattggcatcgagtgaaagatgaaaatgttgtgcgtgacttgttttgggcacatccagatgcaatacaattgaccaatgcatatcatatggtgttcttgatagacagcacttacaaaacaaacaggtatagactacctttacttgacattgttggtgtgacacctactgggatgacattcagtgctgcatttgcgtatttagaggcggaacgtacgaacaatgtggtctgggcccttgaacggtttagagggatttttcttaaaagtgaattttttccaaaggtaattgttacagacagagatttagcattgatgagtgcagtggagacagtttttccagaggcaaccaatttgttgtgcaggtttcacattgacaagaatgtgaaggcgaaatgcaaaacttatatccgacagcagaatgcatgggattatgtcatggatgcatggggaagtgttgtcgactgtgctaaggagaatgaatttgatgattatgttagtaagtttgaggttgcatgtgctccgtggccaacttttgttgattatgttaaggacacctggttgacttcccacaaagaaaaatttgtgacagcttggacaaacaaagtaatgcattttgggaacacaacaaccaacaggtgactttctttgtcttaaattatgattcgcatatgtataaatgctgttaaattaattgttttttctgtaaattgtagagtggagtctgcccattggaccttgaagaggttgctgcagaatagtcttggtgatttatgcacggtttgggatgcgatgaacaatatgataaccttgcagcatactgaaatcaaggcatctttggaaaggagcacacatatggttggacatgtttttaaagtgacgttatacaagagactcattggcatggtgtccaggtatgcgttaaatcaaattgctgctgagtatgagcgggtgcattatgcgggaaaaaacccatctcgttgtggatgtgtgcttagaacagcgtatggtttgccttgtgcatgtgagttgtataagtatgttcttgcaagcattccaattaacagcgttcatgtgttttggaggagattaaacttttcggataatggtcaagatgaaaaccaagtaaccataacagatgagatggaagccatatctaatcgttttgataagcttgatttgtgtggaaaaataacactaaagtcaaagcttaaagaaatagcgtttcctgataagaattcgatgtgccctccagctgctaaggtcaaaactaaaggtgctcaaaagaaaaacatctcaaagcacgaacgttcgacaagaagggacccgtcttacttcgagtatgtcgatgagttacattctgtgcagaatagttgttctacacccgtacagtgcagctcctcatctgatgttctaatgaggaaccggatggttcctatgctcgatcaatttcatccatttatgcagaaatttattgttgacattactgatgtcaaagctgatggaaattgcggatatcgagttattgcttcgttattaggttacggtgaagagggttggtcattagtgcgcaatcatctccttaaggaacttgcacaatggaccgatcgatacattgcgttgtttggtgggatacataggtttgaaatgttaaagcgatccctattggttgatgggttgtcaaaggtgaaaattcatttttattttacttaacattagttgccaatctgttatgttatccaggcatgttttattaaacaatgatctgcaggtgaccatggagaagtggatggatatcacagacatgggacatgtgattgcatcaaggtataacgtcgtcctagtatcgttgtcacggcaacaaagtatgaccttttttcctttgatgggccaacctccgacagatccacgggttcatcgagttttgtgcattggtcatgtctttggaaaccattttgttaaggtaagacacctcctaattactttggatgcatgcttgaaatttaatatattagattcatgatttctgcattaaacaggttactctggccgacaattgtccattaccgttgacggcatgtttgtgggctagtcactgtacaaccgaagctcaacagtggccttactattacgttgatcgaatgcagttgtatacgaaatcaatgaagatacgaacagaatatgttgatttgggaaatgtttagacaatagacgctcagttgacaattgaattgtatgcgttttcttatttaatgcataagaatcattaaaaacatgttgtgtgtcttaaaaaagtcaagcgcgaagtaagtgcaacataatgaactatactttaatatcgatcaaaatatatatcaatcactgtccagtaaaataatgctagtaactcatgtaagtcgaggtcaaatgtatacaactaaaatgtacaaaaaaaaataaacatcaatgtctatgctaagcaagacgcctcctctgtggtcggaaactccgtcgacctctgctgtagacaaggccatcctcagtgacgcctctaacatgctgaagcagctgctcaaccatggcccatgcatctgtgccttctgtcaccatcctcatgtcaagcatatgctgcaggccctctgcaacacgttggcacgcatgctgcaaataaacaacacaatttggttaataaactgaacatctaaaatgtaatccgtagagactgcaagaaataaacaataaataccaaggcatgaagtggtctctgctcatgtccaccactaggtggctcagatgaacgagcatgtccacctgtgggtgcatcagaaggagcatgggaatgggtcggtgcacgctgaggcagtggtggaatctgggaagtcgcctcctcatacgcagatggagtcatgaatggatgggacatgcggaagaaccaccccaggtatgcagcaccacagtgacctggatagtcaaccaagtctccggtgtccaccatgtgctccgcaaagtgaacccacctgtcctcgatgtcttcaaaagaaggaacaccgcccacaggctggggtggaatatgctgcacatggccaaactgcctaagcaccctctctggtagatacctagtaacgtgagggccccatctaaggaaaccggagaataaactgatggacggaaactccctgtgcggccgatgctgagtgtacggtgtccaagaaatatcagatggggtcaacctatctatacgtctacgataggttgccaccggtaaggccttcgcactcggccaccgacaggatcgaggctgcctctcgtcgtagtgctcatctgcaggaacatttcctatagtaggaaaatgctcgtatatccagcactaaaaattcaaaagcaagccaatcagcaaaacaaacgacctataaaacatgatttttctaattatacacatcaaacaacattactacctgtaacagactgatgtatcctgcaagatgcttcccgtgatgctgacatgcgtagctcaagttctcatacatgtgaaccagagcacccgcaccccaggcgaatcctgcagatcggtcgaagtctcggaacgcctccaagaataccacagctatatgtgtggcactcttgttggcgaacaatgtgcagccaacaaggtgaagtagatatgccctggcggccaaaatccactgcctcgcctccaccttcgtgtaatatgtgtcccggagccatgaaagtctgacataaggcccatgacactgggatgtctctgctgcagcctcctccagagtcacgtcaagtagctccaccaacaatgtcatcgcctcgcccacatccatctgctcgtatgagtcgaatatcccataacagggagatgcagcagtgatgacacgtcgtcaagtgtcaatgtcatctcacctacaggcaagtgaaacgaacatgtctctgggtgccaccgctcaacaaatgcagatagcaaccccctatcacctgtctccactgagcatcgaatcaatggactgaggccagtggcagccacaaagccctctatctcaggtacaggcttccccatcttaatgaccttacggccatgggaagcaagcttcaactctgcacgatcctgcatttaacatattatttaaggtaaaattgcatggataaccaaatgcatgacgacattcaactatgttttttggcatgtcaatacctctccggcccagacgcgtacggccacatgatcgcgaaatccgctcagcagagatgaatcctctggcactccagggaaagactccgacactgggtccatatcgtccatgaccgcatgaccctcctcagtgaccggatcagccgtctccacgtgtggttcctgcacggcaggaacatcgtcaatagcaacgcccgccctactacgacgtgcagatgcagtgggcctacgcctctcaggggcaccatgctgatgacctctcccatgtgaaatcgctgaagggtcaggacttcggccaacaggccgacgcactcctcctctggtcctagccataatctgcatccgcatggtgtatttcagtttttcagcttcaacaacaacatcattctttacttgacttgaccttgtctcataacatgcaactatagtactatatatctaggttatctcagccatgcttgtcacaattgtgaccaagcataaaataaaatgccataaaaatgactaaataatgggagtgttcaagttagactttaattactctattgtatccttatgttgtagttagactgttctatttaggcttctcttggtcttgctttaagaaaacctgatgatgggataggattcttgaaaataagcatctcattggctccattttactggagtgccacatgtgattattacaatccaggttattctcttctcctgctcaggagctaatattacaatctttaacattcattcctacctttcaacattaacaatactatttaactcttccaagttttggcttttgtaactgcttatttagtgtacctatctaaaagattgttatcactttaacactgtttttgcaggcaaatcaaataatcatattcataaccgaagcaacaggttttactggtagaaggttggattcctccattaggtgattcactaacaccatattaatggttcaactactgcaattcacaatatgtgtatacattaagtcctactctaattaaaagcaaccaatacatattttcaaatttcgacaactcagcctcacaagcatagttaatttctaatcatataaaaaattaaattatatttttttcggcgcaatcacatatattgacagctcctctttaattattttccagttttccaaaaaaaaaaggcaatttttatctgcagtgacatgctacggattacaggatccgtacgaatattacggattgttgaatccgtaaaattcatacggatcctgtaatccgtagcagtggcacggattcctcaatccgcaagatggacacggatcatccaatccgtaggacttttatggattacgtaatccgtatcatgggtacggattgaccaatccgcaggatttccacggatcaactaatccgtaagacttttacggattacataatccgtaaaagtcttacggattagttgatccgtggaaatcctgcggattggtcaatccgtacccatggtacggattaccggatccgtgtccgccatgcgcgaccaacagacctccaccagacctccatgaacggcgattcacaagccttaaccaacaaagaactcaccggggtgacgacacggactaaaacgcttcaccaccaaagcaatgtgcttgccctgtcgctgcaacaaaccttcgacaaactccaatgctgcggcgacgacaacacggaaccgaatgcgaacaacaagcccggaagaagtctaccctctcaatgatgctgcaacagagggaaaatgaaccgtaatagagtgatggtgttgccggaggagaggaggagaggagaagaagcttgaaccgtgcgtgtgggagggagggagaatggaagaggaaaagctttttcaaaataatagttaattttttttaaattgaagggtatatctggaattacactgttaaaaaatggtgtataagatattgtaatggtgtaggaagctcaccactcgagttaaatccctttttatggcccatgattttaactttttcaaaaagatatttttaatttacatgtagtataatttaattttagtttaccagataattttttttatttctttcttctataaaattttatgaaaaagtttattcaaaaggaccttaattaaaataaattaactttaactcattttttaactttcaaaataatattcggtaaaacaaaactatcaaaatagtaaaaaaaaaaggaaaaattgtatgagaaattcaaaacaccaattaataatgactcgtggcatttgaagaatcacaggattaataagtaagttgccataacaaaataaacctcgttttaaaataaaaattagtatttgcaaattacaaaaattatgaataaaatatttatgttttatttctcttaaaatttcaataaaaaattcaggatttaatcccacaaagatgataaatcttacattgataattaattataagcatatattttttaattactcccttcataaaagatatgtgtataataataaattaataatggagggagtataatatcaacaatttttttcataagagatactccctcaatcctaaaagaagagttatcttagattgtttacatatatcaataaaattaataaataatgaaagacaataataattttacaaaagtaactttaatattaacatttattacatttaaaaactataataacatttagtggtaaaaaataattaatattatattaaaattaaaatacaacacttattttaaaatacttttttccaggaactttagaagatatattctctccaaggttgtattattctatatggatcaaacatagatcctccccacaaacacaacttatattgttaacggaattacatctattccattggattgttgaagttttatctattcctatgttacaacatttataagtttaaggtttcattcttaaataaaactataagactgattttaagagttattccattcttcatctaatcatgtatgtatggtttcttttctatagactattgagcatcttattttacttttttttatataattttttattcttttcaaatactattactcaattttagtttttattttatttcaattttaaattctaagtttttttatagatatagttaaattttagggttattataatcttaattaatgcaaataaatttattttgaattttagcattatattatatataccaataatgaggatttgtttaaaatgattatgatttatttccataatttcttctccaatttggaaagtcttatacctataatttattcctatttaatataacaaaatattttattaattaataaagtactgatattctccttaatttttttcattaataaatttatgaaaaatcatagagtgtaaaaaaattagaaatatttcatccataattgaacaaaatataaaaaaaaattaaatatactgtcatttaattataaactactacatgtatgataaaattgttattgtttataataattatttttataaattataaataaaatcaagttgattaactttacattgataacataaatgaaaactatagtcaaaaataaaattacaggtatagtaagctagctaattatatccattgcctgtgtgagtaaacgaagatgacgaatcgatgatacaatattttaaagtgaactgaatcaactcatcttcgcagtcatactattatttagccggctatagcttgctaattgaatttgtatagattgaaacatcatccaatggctccaagtgtcaagtgggattctgttctgctaccctacctgaatcgaaaagataatcaataaagcaaattaatataattttcaccatcatccaaatttatatattgtatgatgtgatgtgaaccccatgatgtctataatatctgttggtactcttttaaattttatgtaaagtgtatgaacaaaattattttctttgtgacattcataacagactggagtttataagttaattaatttattgcccagtcagtattaattaattacgtactaaaccatttttctcagcaaattgtttagttttaataaacaattaatctccaaataagaagttttagtatgccatattttatttttagccgtgagtgattgccaacgattcaaagggtgccctggcgttgattaaatagaaacactcaagtgttgggaagctcttgtcttggatgatccccaagtctttttcttgctggagagttgctttggttacatgcataacctacaaagaagatttcaaatgcctaatattttatggaacttcttccatgactaaaaataaagtaattaatcttaatttttttataagaaaattaacggatattttttttaatatatatgtatgatttgttatatgtgtatacacacgaatatatataaactttatgttgattttttcattagcaatgaaaattagttattttattttctaaagtaatcctgtagtttaaattggactacattactgaaaacaagtacgtgatgaatctttttaataaaatatgtttttttttatctttataaatatccttaaatttaatttattatgtcctttatttttatttttttaaaaataaaaataaaagacatgataaattatacaagattaaattgaacttatatgaaaaaaatagttaaacaatgagatatagattggtcttctctgaaaagatggtgatccaactcatataatccattttttagtcattttttcttttcatctctccctccttctttcatcattcttttcttttatttttttaatctcctcgtatttattattgggttcatcaactattaatcccaattaacttaagtaaaagatgctatagatgttaatgttaattgtcgtttatttttatttttatgaatttggttttgataagtttttttaaacaggtccctctcatcacttaatgacttaatgatgatgtgtcagtcagatttatatatatatatatatatatatatatatatatatatatatatatatttctaggacactaaattatatgatttagtaagaatttaatgttttcttttttattcgtgtgagaatcaaattcagatatcatcaattttatattaaggcagaatgcacgtatgtagattagattatgttagttgtttctaattttagtgcttgagaattgagtttcactgtgttataatcataatttgagatcccccaatctattttggtaggatatagccattttgtactcgtcattatgcttcttgctgacgctgatggaaaactaccttcgaatcttcctgttctagagtcggcgaatttccatgtaactcaattttgctatcaaccaagaacactacattctccttctaattccgcagaactgatcataagccaataaatgatagtgaccttattaattaattatgaggcatttggtgtgtgcataattatcttttacacatgcattgcctaattggatggatgtatgtatatatagggaagagaatgctcttcccttgttgtattttactacttccatttcttttgaattggctattacaagaagttttaatttctacagagtcatggtatttcattatttttgcttcatttgtttatattattacatgcttgttccttactgttttcaagtttcttgcatgccacttactacttcatttgcacgcaggaaaatcgtgttgttgacgggaatgtggagaagatgcagcgggaggagagagcagatgatctggttgttcatggaaaagttgatcggaaaggaagaaaagctttgaaacacaaacatggggggatgaaagtttcattgctcgtacttggtaaactaggattgacatatataatatgagttcataaacagtaattaacatgaaaatgcatgtatatacatatactaattaaggtgtggattaattatactacctcgtagtactaattaaaccctgaagtgatggcaagtccttaatttaatgaccacttaccatgtgtatataaaacaatacaagtttggtgtggattaattatactacctcggagtactaattaaaccctaatgtgatggcaagtccttaatttaatgaccactaaccatgtgtatataaaacaatataagtttcattacatattgttgtgtctttaatgtttaaagcaattaattaattaagacaaatggataaccagttacacttactacattggtaaataaattaaaaaatatatttttatgaaatacataaaattatattatttataatttttttttacattcttttataatttttacactatataaatatattttttaaaattttttaaccaatattctaaggagaggtcgacacaagactcattaattaattgtgcacagtgcatatacacctcgttcattaattgatgcagtaagtgttaatttgggtttgcatgggtgcagcggcatttggtatagagaacttagcaactctgtctctagcagtgaacttggtgtcatacttcactggtattatgcattatgaactagcagatgcagctaacatggtcacctattacatgggtgttaattacatgctctccattgtggtggccgttcttgctgatacttggattggtagatacaaatccgttgttatttctggaatcgtcgagtctttggtaagatccaaacttaccttaattccttattgcataataacataagttactaatcgttattggtaaacccaagattatatatattgtttatgtgagtttgaccacatatagcaacgtaatctattttttaaacccacctttatacctattctctttttttttttcgattacctcatttattatttttattactttctttcttttatctctcaaagtatgtatataaggaataataaacctagattcaaaaaaaaaaaaaaaaaaccgttgactctcaagtatatagtgggaagagatatacatataaagaaaagaggggggaaaataaatgtgaaagattatatgattggaaaacatcaataaaaacgtaaaataaatataaaaagtgaaaaatatatggtgctgatttttctctatcatgctcttgaccaatatatttacatgaatcataatcaagtattataatttatttcttataaaatgtgatatttttaaatatgtgttacatataaaaagtgattgggatgcatgaataggtggttgtctagaatcatctaataatttttctttagtaaatagatatgatttttcttgttcaccaatagttttcactaattatgaaataaaataaaagatatttattggacaaaatatgaaaatattgaagataaaaatgttttttaatagttttaattacttattttgatttttggaaaatatttttaaaactaaaaaggttaccctaaacataatataacagcccagtaacatcaagagctggaacatgaaagagaatttgataattaaacatataaatgaaaaacagtacagtaaacggagatgttaaactttattaaatgacacctttagtttttttttttactctaaatcaattaattttattattaaatttaaattaaattcttttaaagttatatatagttaaataattagtttatactttattattttattttaatgtatgatatattttatatatctgccaatatttaaattaatcatctaaaatttaacaaatatatataattactgaaataataccctatttctctgtcactcggataacagattctagctagggtgattattagacattatataattgcaggtactcatctaatgattaataatgatatcaattatttaatttaatcaaataaaacaaattagataagaagtatttttaagttattatttaacaacttatatttaagtaaaaagtttaatatctttaatagaaaatctcattttaagatcttagttattatttttacgaatcctacaatgttatattactttaagattttatttatattttattttaataatatatctcattttaagattttaaatcattttttgtatatcctacttacactaatagaatacaagtcaattttgtgaaaagagtaaaaaattattatttttaaatggatactctaatagtcatatgcactaacattatacattgtccaataaataaatcaattatatatatatatataaaaccaataaacttatcacatataatatacaaatgttttacatattatcttttttctcttaaataaaaccaattgaaagtaagcccaatttatatatgcaactaatttactttaaataattttctaaagcttattcaatcacaagtgcatatatgcatgaatgtgttgtagggactggcattgcttacgatacaggcacgcgtgggtagcctgacaccacccatttgcagcctgtactatgtgagagatgcacattgtgaaaagcttagtgggaagcaagaagcatttctcttcattggcctctacttgttggcctttggtagtgcaggtttgaaggcttccctgccatcacatggtgctgatcaatttgatgaaagagaccccaaagaagcaatgcaaatgtcaagcttcttcaacggtctctttttagcactttgcgttggtggtgcagtcagcttaacatttaatgtgtatatacaagacaataatggatgggtctggggctttgggatctccaccgttgctattgttttgggcaccattatctttgcctctggattgccactataccgaattcatgctgcacatacaacaaacggaatattggagatcattcaggtatacactcttttgcaaaccttgttctgcatgtgctgtatatatttcaatttgaaaatcatatttttttttatactcacgatattagtgtgaaatatttattgattttattgataatcgattaatctccatcgaaaaacctagttgacctctttaagtggctctttcctctccatcatgtttttttcatctacaaaatttaaattcgagactttatgtaaagaaataaagtccagtattacccagactaaaatttgttggttgaaaaagtatatttttgagttcattaggcatgcattatgaaagtaaatttttttatacaaattgttaaccaattaaaattgattcatagtatgacttttaaatagtatattataaaaagacaaattaataaacttttatgaaaaccctttacattgttggtagatatattacttaattctatttttatttacttatagtctgattctgatacaatacaatagttgaagtttttaatttagctcgatattgcaatgatcaagcgcattagttttgaattcttcgcgtctattttccaggtctatgttgctgccattcgcaacagaaaccttccccttcctgctatccaactatatgagattcaacaggacaaagaagccgcagtggaaatagagtatcaaccgcagagatattttcaggttcaatccgaccgtgtctaatatgagtgaaatactatatgttaattgttgatagcttaagtattaaagagtaatgataaatgtatataccatggggattctccacagtgtctacctgtcacacatggctaaccatgtgtgcaaataaatatgattaattttatacaattatcgatttgaatttatagtgcttgtatttaattaactatgtctgcaagtggttaatagtatcacgaagttatgaggttattgaaatgtttaacgttggttaactttacctcacaagtcggaaatgattaataggaagggaacttgtatatataattatcattatgtactattgacacaaataattaaatatgtctcacaagtgattaattttcttttgcacaggttcttggacaaagcagctatcaaaagtagatctaatgagcaacctgagaaccaagagactccaatgttggattaaactttaataataataaattagaaatgtgaagattcatatctctaagagaagaagttactcatgtgaaaagtcatgtctttacatgagtcatgtctttaggagaagaagttactcatgtgaagagtcatgtctttaagtttcttataaatagcatctcatgtaaaaggtcaaaagtgtggcttggcagacaattatctaaatacatcagaagtattctaccaaagagattgttgtgtgtttgtgcgagtgcaccagtgtgtgtgaggacctgtgataccacaaattggtatcagagcattgagaaaatggagagtgggccaagtagtagtctgccattaccccgccttacaaaggctaattacgaaaattggagtatccaaatgaaagcccttttgggagcccatgatagttgggaggttgtccatggtggtttcgaggaaccaacatccacagcaggatatacggcagcgcagaacaagacattgaaggagacgaggttgaaagacaaaggggcgttgtacatgttattccgggctgttgatgattccgggtttgagaagattgttggtgcaacgacttcaaaggaggcgtgggacatacttgcaaatgtctacaagggtgccgatcgagtcagacaggttcgacttcaaactctccgtggagagttggaaggaatgaaaatgaaggaaggagaaggggtatccggtttcatcacccgggtccagaccgtggtaaatcaactaaacagaaatggagaggtgttgtccgattccagagtggtggagaaaattctgaggtctctcactgacgacttcgagaatgttgtatgtgcgattgaggagtcaaaggacctagcaacgctcaccgttgacgaacttgctggttccttggaggcgtatgaacaaagaaagaaaaagaagaaagaagagtcactagagcaagcactccagacaaaagcttcaatcaaggacgaaaaggtactctattctcaaaacttccgaggaagaggacgtggctatggaggtcaaggagatggtctaggtagtaaaggccgcggtcaagaaggaaggaataaggagtatgctgaatcaagtcggcagaattggcgaggccgaggtcgtggaagaggccgacattcaaatcaatcaaatgtagaatgttttaaatgcggaaagtatggacattactcgagagattgcaactcggacagatgttacaactgtggtcgagtcggacattttgcgaaggattgtcgagatgaaagaagaaatgaaacttcaaaccttgttacagaaggggaagtaagagatggaggaattctgatgatgactagaagtgaagtcaaccagggatccgagatggaatggtatctagacactggtgcaagcaatcatatgtgtgggcataaacatttgttcagtaatctgagacaaatagatgctggacatgtttcgtttggagatgcttcaaaggttgatgtcaaaggccgaggtacgatttgtttcttatagaaagatggacgaattgtgcgcatccgagatgtctattacgtgcccgatctaaaaagtaatattcttagggtggaagagaggattcaaaattctagaaaagggtggagaggattcttgtttgtgtctccagcattaggctgttgagagagcgtctccgagaggttgagagcaagttgagagcgtttccaccattgttgttggtgaggttgagtgtctccggctgaaggccgttgagagtgattgtaaccattattattgagaatagtggattgttctagactaggtcccgtgggttttccttttgaaggttttctcccacataaagctattgttggttgagtctggtgactccccagtgtttgtggttggttgaggtgttgctcccaacagagaaggagattgtgtgtttaatcccatcaaagtaagacagtccaaccgagatccgtgtagataataagtcagcaatcgagttagctaagaacctggtcaatcacgaaaggagcaagcatattgacgtcagattccacttcatccgagatcaagtaaaaggaaagaaggtggaattacttcatgtggcaagccgagatcaagtcggagatgttttcacgaagccattaccgacattactgctggaaaattgtaagaagatgttggggatgaaagacggaagaaatatttaaagtttatagggggattttgttggattaaactttaataatagtaaattagaaatgtgaagagtcatatccctaggagaagaagttactcatgtgaaaagtcatgtctgtaggagaagaagttactcatgtgaagagtcatgtctttaggagaagaagttactcatgtgaagagtcatgtctttaagtttcttataaatagcatctcatgtaaaatgccaaaagtgtggcttggcagacaattatctaaatttctttttctttatagccactgtctgcatctctgcacagaatcctttgcattgttcttgcataattaatgaagcatcattcaataactcctcctgaattctccttaggctttgtttgggagttaggaggggaagagaatgaaagaaattcaaggagaagggaggggaatgaaagggaggaaaatgagaaaagtttctttctccctgtttgggagttaaaaatatattaagagagagaaatagagagttcataagatacttttacaattttgtccttatttcaaaaattaatacactctatattttacaaataaaacttaattttaaattaaaaaaattatataatggtttgaataataattttattacttttccttctaaaaacctccaaatcggaagaacaacaattttaatggtttggaggaattcagagaagttttaaaaatccccaaattatttttctcaaaaattaaaactcccaaacaatgagatgttataacccaaacctttccctttgcaacaccccgtgtgcacccggtgtattaacattgtacaatatcagagtgacgcagcatgcatggaatcaaatagtaaaggaagcgtaattcattataatatattaaaactttgtacatacatggtgaattactgtcatatacataccatcttttccagaactatacataatgacctctcagggtaccaaaatacaatcaaaataatcaaaatgggagcctacaagctccggtgatctagacctaaatgtcttctaactatcccagtgcaggccttttgccttgggatccttcagggacttctgactctgttcctgcaacataagcccaacaggggtgagataactatctcagtaaactcagggtcctcagaggtcaccctcccctggtttacctcacaacacacatacacaaatataatctatacatgcataacaagaatgattaaacacaatcatatttcaatctcaacatatcatgagaacaagtcattcacaatgcttaacataaatcatacaactctatgcatccgcaatcaaaactcatgctatctgtgcctgactaggctcatccacctactcgtgggtacctctagtcaggacttaacgtccaatacctgaataggctcatccacctactcgtgggtacctctattcagggtttacatgaacgcctatggattaccctaaggaggatcatccacctgctcgtgggtacgtctccagaggggtccatagtttctcagtctactggccagtagataacaaacaatcagatcacaatcaaacaatacatcatcagcatcatactcaataatgcatacactatctcagtgtgatcaggaattcatactcaatatcatcataatcataaggcatctggcatatcattcaataccatatcaccacaaggcatataattatgtcaaacaaacatccagagggttgaagcaaacacaagcaagagaaacaaactctaaggacactgagcttacctggtcgtagctcagaaccagttcccctagtatctggatgagttctaccaacaagctgtgcctcacgccctacagtaggcatgaaccaaaacatcagaaacggcattccaccgttatcagggaaggaaataccttccactcataatcaataccaaaagtctgctatcctacagtttatctcaacccagcatctcactaggccacacattgcccttcattggcttgcctcagccttgccaatgcctcagagttctttcagaactctgtatagttcaattcaagcctatatcagaatcaaggatccaccttgattcaattcagcccaaatgcagatacaactacgttttcaccggttattaggcgtcatgagtaactttaataaagacacttgagctagttcagaccctaacatagctcaggtcctcacacttttctcattctagagtcaaactcaaacctcatcacaatttagatttcaacatgttatatgactcaacaccacctcctgattacgtctctctaaagaacttaagcctaattccagccctataaccaattgatcactattcattcaatttctcaattcacaatagaacggttaaacagaggttttcttacctcaaatcaacggaggaaggctggagaagtctttctccttgctctggtatcctggaaccagctcctattccttcctaaacccactctctgagaagattcaaggaggtgaggttttctctcaaaatctcactctcaaggctggattttggctcttacgtggctccaattagatttagaggtgtttagaaggtgttttatggctgaatgatgaagttatgaagctcaggaggtgctccaatggctgctgggacgagggaggaagatgaacagtgttttcttcctctcaatttcgcgttttgcctttatatagggtgtctgccagaggtctggcgcgactcgcgccacctccggcgccacccgcgccagaatggcggtggacatggcgccattggcgccgtcccggcgctgttagcgccaatttccagagactccggcgcctcaagcgccgcatcccacgccccaggcgtgagattccagagaaaattgaacttccacccatcttcccgcgccacccgcgccaaccctggcgctatccgcgcggactggaaatctgtggcgcctcttggcgtcaacttccacgctccaggcgtgaacttccagagtgtatggcgcccttggcgccaggctggcgccgtcagcgccaccttccagaggtctggcgctggtcgcgccaataacggcgctactcgcgccacagctcaaaagttgttttctctcaagaaacctggcgttgattgcatgaaaaccggcgctaattacgccaggtctcagggtattatacccttccctcccttccctttagaatccctctcccaaacaaaaccttaaaagaactttcatggtcattgttgttctcctccgatccttcacattggttgtttcctccaaccattattagtatatgtttcacctctatatataaaggaacttcagcaacatatgacatccattgtactcatcatattttgcaataacaataaagtgaactttgatatcatattataatttgaaaaaatgatacaaatgatattattttcacgtatccacttatcataaagattaaagccggggggagaaattttataaatatgaaaatgtgattaatataaaaaatatttgaatttcatatttatttgttcacattatctttctatttattatttttcattacaaaagtttgtcaaattaataacatgagagttcatataatatattatggatggtgctataatactaaagagtcctatttaacaaattcagaattgaactaaataaagttgcatgtaacagataacaagtatagtatagatttctgaaacaatttttttaatattacaagtaattccaaaatctaagttgttttttcccctctaaatattgataattcctgttggaatatgagcgtaatcaactagagtcaatttaatggtcgagagtttggagatatatatatatatcaatatagaaggatcggaatatttctccaacattatgtgataatacatatatatatatatatatattcctttctgatttcatttaaggagttttgagaaacattttcctactaaataaaagtagatgataactaatgactttcaatttcaatttttctgccccaatttcatcgtacatgtagccctcgaagtattatgacaagaaggtacgtagttgtaaaccaggttaccgctaacacctacttatcaattacaaaggataagcataccaagtgttaattccctagctaattaacacaatgtatcatttcactttcgaattcaacattccttcgatgtaggaatttcagcctaaattaaccaagctagcctccctcgtaaagcctcattcctgcaaaataaacgatgcctaggatggttaattaattcttaattggtttcatcgatatatcattcaatcattttgtttactccccagcaatataatcctgttaaagacatcacatgtacaaattcacttttattaattacaaattactgttatcctttggaggaatattgaaatatatattagagataaaagtaatctgttcccccatctcatcgaaaataacaaaaggtgaacactaaagtcatgcaaatcgatatatatatatatatatatatatatatgtatatatccatctcaagacgggtaatatgatcatttgcaattcattcatgactattaattaataatattattaaccatatggatgaaacaagctcaatgttgttaactgtaagccattaaccagaaattcatccatcaaactattttcaactaaaacagcatacagttctgatgtaattcaagtttcaaaataacgagtcccagaatgaatacataaataggactgtatgttaagagaaaacagtgggtgcttggttattcaagtattgccaagtcataaaaaaaaaactacgtactccattgttcgaaggttccacgttatgcgtaggtaagggagagggaaattgtacgcagccttatccttacatatgcaaagaggctgtttccagattcgaacccatgaccaacaagtcatcaagtcttcaagacacaattacgtgcctagtcataaataagaaaatctttaaatgctaacgatcaaaatgcgtgcgataaagataataattcatgctattaatttcatcaaactaatgattaatacttaccaaccaatttggatgctttgttgattactccccttgaaacgccagtcttgcaaatacatagacacttgctttgtgatcaaagtgtttcaccttctcaatatatgtttttcaatctccaaaagcaattagcatagaagcatcaaactctttaaagctcgatcgacatcacatgcatcatcaaatagcaaaaattgggcttacttctaaatcagtttctcacccggagtttgatccactcgtgagcaggttcttctcttttctcctagctctttgataacgtttactcttgagcacatagtacgtcatagtaccaagaacaccaagcattataactcccccaacaacagtaacaaacattgcagcccacttgtgatgcctaccaacaactatataagacgctgatgtgaatgcaatggtggtgcatatagacgccaaccacatcatcttattgatccccttcactaccctcatctcagactttgttctccctgtcacaagtgtgatttgaaccaccacaacagccagcgaagagaaaaacgcaacagcgttgaagatgaagaagatatctaagggtactgtgcctaccatcactgccaccccactatcatagtctccaccgggaatgctgaaaatggccgcaaacgcaagcgtggcaaagagaaccacaaccacctttacctgttggaatgaaattttagaagtgaagaaaatatttgagaatgagagattagaaatgttttggaggaagagggtacttgtggcttgttccattgtttctggtgagttgtatgatgattcacctagtgtattgtaattttaatgtgggatgactttttgttagatattggattataagatagcatctcaactgcaggtcattttacatatttcagttcccctaagggatattttagtgcatgtaatataaaaacaggctactaggttggttatgacaggacatctttccttagtttttcttgtataactctattagtatttgtaaaaaaattccaatttgaaaattcttagctcctcactaacaatgattagcatgggctgagtactttgagtttgagccaaacttaggtggaggtagtccaaccacagccactcttctatactggtttgtgttctcaacttatctgggactaattactgtttttatatttgtatgctcaagtgttcaataaaatgacccctttacctgcaacattagcaattgtatcaactcattatctagtctgatcattagcttgtgcgaactttcagagtcatttagatgtagcaaacacggagctttgtaaaatttgtaatgatttcttgggccctttattttcaacaattgtagatagtaaccttcaacttcacgatggtgctatattttacatggtaaactttattgtttaaacgagtttatatatgcataatgaaaaggaattgcagtaggacagctctcttattctccacaaccatcctttattcatatagatggataatgagcttgtttgtttaatttttccatttcactggtatgagaaataagcataattgtcctgcccttggtatatggaagaatttatgggatatatttaacatgaataatattcaaagggaacgaaatggagttgtgctatcttaaattgttggaactctagaatttttcttacacgctacaatttgttacattgtattattgtatgggacttggaaagtaaacatgcttccctatccattgggcaagtcaattatgaataatggcatggctaagctgagtttctttacctttattctgcattaacactaagcttcttaacatttgaaagttgtagttctaatttaaatattttggcaccgttttcttttatgagataattagatctcatgatttttttttcttttccagattctaaaccttgtacagaccaaaaaaatgtaaggcataagatgatcgttggagttggatttggagttacagttctattccttgtcattatcatagttggaatcttttggtggaagggctacttcgaaggaataattaggaaaataaaaagtaaatatatactatcatgttcttaccattctgaaattagtttacttcatttgcttcttaaagatttccaagttcaacttcccaaaaagtcaatcacttgacttagcgtataggaactgtgaagttagctaggtgctacaagacgtggttgatatgttgctagcatataatagttttaggctaaaataatcaacaatttaatcataatttatcaataaagattaggataagattaaatttcatcaattcttggtccattacttattttatgcatattttgtttaataggaatcaagaaaagaagaaaagaagcagaaccaagaaagatttgtcacaaaaataaaacagcaggagggtttattaccctaattaactatatggatgtggaattataaatagggacttaggaggccaaaagaaaaacacacagaaatacagacagaaacacagtggagagaagatcaaggccagaatttgaagacagattaatgcttctgctgtctttatatttcttgaggttagacatgaacatgtcagactaactttctttattgtggttagggccaagaaccaatgtgaactcctctgtaatttgattggtattaatatgagattattatgattactttgttttactctattcttcattgcatcattctttattaaatttgaccattctattaaagttctgagggttagagttcgcaatagagatgttgggactttaatttctgacatgagtaaaataacagtttttacattgcatacggatagggatgtatgattgcagaatttttatgatgtattcttttaaatgcttagcttgataggaattgctaaggaattaggatttctgattggattaaagggttaaattgctaaggaattagaatttaactaaatttggaaagatacatcctctgagtaatcagaagtaattgaatttaataaccaattcaagtgaaagaggtagggatcaaaggggattgtgttctaaccacaattatttctcttaactgcgtcacaatccatttaaagttgattttaatttcttaattttctgttatttatttaattcgcataattctacaacataacactactttttttaaacatattgttttcttccaatctctcagattgtgagttacgataaaattaggaatcaatccctgtggatacgatactctacttactcactctattacttgaaacgaacgatacacttgccgtttcacatcacaacagtagtcaggtaagattgaattaatatagtgcccattatgatagacctcattagggattaactatgaccaaagtgggtaagaaggttaagataataggtcaaaagcaaagaacttgccttaattttttactatggcctccaaggcatccaagaatgtgcatttagaaaagtattcattcttggatccaatagcctttgaggattggagataacgatttatctcttctgtgggtggtgttttatgcgtatgaattatttgcatccacttattgccttttatggtgacaagcatttctatgtatattgacacatatcaagcatttgacacataacaagcatttgtactttcctcaaatactcttaaacaatgcagatacgtttaacttactacgtaaaatgaaactggctgttcctctggaacacttattttacggctgacatattgaacaggtactgaaagacaagattgtttaacggggacatttacgttaaaacaaattagagatgccacagaggatttcaatcctgataacaagattggagaagatggttttggtcctgtctactaggtattagagtgaacggccttttttcttccaagcataaaaattgatgttcctccctagcatttaaaattctaaacaactgttggattgcagggtcaattatctgatggtacaggtagcagtcgagtaacactcatcaaagtcacggcagggaaaccatgaatttttgaatgagataggcaagatatcttgtttgcaacaccctaatcttgtgaaacttcatggattttgcatcgaaggggatcaattgatattggcgtatgagtacatggaaaataatatcctggccagtgctttattcagtgagtttctacccaggagtgcaaactattatgtttgtcttttgccttgtcatttattatatattttgtaagataaggtgccaagtgttaattatgataaatcacttggagatctgattaatctgaagaagtttgtttcccgcccttttccatttttctggatacaaaataaggaatgaatgagtgctatagctagttgtttttccttccccttttgtctagacaaattaataccctgtgcttagatttttatgctgttaaacttttcctttttcccatttctatcactttagcagctaggcaatagaattttgcaaccgtgattcatattaattcaaccataacttctttctgcatcttttataggctcaaaagatcaactgaaacttgattgggcaacaaggcttaggatctgtattagcatagcaaaagttcttgcatttctacacgaagaatcaagactcaagattgttcatcgagatatcgaagctactaaggtgttactggatgggaatttaaaccctaaaattaacagattagtagctttggatatcaaagctactaatctgttaattttgttttacagagggtatatggcaccagaatatgcattatggggttacttgtcttacaaggctgatgtttacagttgtggggttgaggtcttggaatttgttagtgggaagaactataagaattttataccaagtgataattgtgtttgccttttagacaaggtattctactatgcttcaatccctgatacatttttggcattatgaatcccttttgttttggtagttatccaatgcaaatatccatattttcaccattctaaagaaaggtaacaaaatttccattgcaggcatttcatctgcagcgtgcagaaaatttaatagagctggttgatgaaaggttgcgaacagaggtaaacccaactgaagcaatagctttgatgaaagtagctctcctatgcaccgctgtaacaccttcacataggcctacaatgtctgaggttgtgaacatgcttgaaggaagaatcagcattccaaatgctatccaacaaccaagtgattttagtgaagatttaaggtttaaagccatgagggacattcatcaacaaagggaaaatcacagtttgagtacaagccgaacaaacaatataacagaagtccttacacttagctctccctaaacatttggcaatgacctggtgttagttcatgatttcattgttgctgaccatattgcaacatgagatatccttagagcatagctgagatttaatcttttgggataaccaactgtaatgatcaccatttttaggatataacatttttcactccgtctttcagagaatatatttatttctagatccgtgtaaatttctaattgctcttgaagggtacttttttttaacctgggtatttcattttgagatattattgtatggttcggtgcagtcccagttaatcttcatatgacacaatcacaagttttcaatttatgaaaacaaaattggcgtgtcatgtggagattgcttgaactaaaatgatctcggaccatataataatttctcatttaagaggtgcatatgaactccttttcactggatatacacaatatttggaggaagaatgtacatacgcacccttgaacttgggtgttatagcaaatagcaacttggagaaagaatgtacatacgcgtcttattaatctttgcgcgactgaaaacctgtttgttatatcttgctcaacttaagaacggcacattgagtttctcctttttatcaggtgtgtggtgtgtgggttcactgggttggggagttagtgagaattacaagttcagtgttatgctccgtatgacaatttttagggtaaaaagtaataatgggtgaagtaatacacctacgtagtgaagaagtgtttctaaggaataagaaatcaagtttcaacgctgccagccatcacagttatgagaaaagaaaacttcgagcttgttcagattaatttgtaaactaagccaccttccccctctttgacaatgatttagttaagactgatgtgtctaaaaaataacttcagtaaattttaaatctctttattttgaatattctactttggaaaaaaaattattattataaatttttattctcaaattaattccatctttgattctaatccattataaaggtgctgcaaacatgagcataatcaggtattaaaggtttaggaagagatgcaacacaagcaaaaatgaaaataaccatcataagttgataaaaagaaaccaaacatacttcaagaaaatataactaaaaagacaaattaaactactaatgttgcattccctaatgatcagcttggggcgtaggacgggataatatagagaataggtaacattcatgaacactttcaataatcactgtgggttccaattcggtcaattatgttagcaacagtttccttgctctcccttaggactttgacactcctctgcagcttttcacgctttccagaaattgaaggtgactcctccaacaacctctcaatcccaccaccactaggggatagcagatcatgaacaatctccttttccaaatccttgttaacaagattgttaatactcagcataagatgtaaggcaattgtgtcaatcaatcttttttgcactatcttccagtacgaaatcatcctcaccttcaaatcaaatgcttgagtaagcacagatgggtattgcctcaagtgaccaacttcaattttgcccacaccttcaagattcacatgcgatggattatgcggattgttcaaaacttcattcagaaaagtatcttgctgagatattaacttgttgtattcctgcacaaactccggattacaagtgtaatcagtatacatctccatttcaatggcctctattacatgattggtggaacttctctttttcttagaaataagaacctggcttgctcgcctggtagacatcaaaagctgatagtagttttcagaatgacgcgtgataactgaaaccagcacatcttcgagatagttccacacattttcaacaaaacctataggcttgttggcaatccctttcaccttcccttgcaatatagaaagaaaagcagtgcgaggcatgaaatttggaagaccaatccactttgcctcctccagcacctttatctcttgcataagaaaattcttgcttgcatcactttcagcacaatggtaaagatcattcgagtaggaatcaagcatctccaccaaccgggcagtacaatgcatgtttttgtcctccaggtactcatcaaattctcctctaagcaaaatttttctgagagattccttagtcaatccaataatatgcataaaagctgtcatggcatcagctactgaagccaagtttgttggcaacttttccaactcagacaaattgttagctagcttctcattgattttttttactatttctggcaaagttttagatatgctcatagcctgaacctgaaccagtttctgtgctagaactggaacacccacgatagacttgtctattttggaaagaagtggatggaactcaaacagtttctgttcttccactctagcatcctcatatgactcatcaccaatgcggtttctcacacaaacataaccaagaccaatgttcacatcatcggcagtaactttttctaacaagccctcaggagacttgtctgcctttgtgaccacagccagtgtcctgaggccagtttggtcaacactctgagacattctaatagactcacaagtagtgaaatcaacactagcagaaagaacattcaggataatactttcttctggcttaatgtactccatgatcatgtctttaatctggtcataaatgttctcaggttgaccatgaactggaacccgagttataccaggaagatcaaccattgtgagatcaggaacaccattcttcttcaccagcaaagtcaaagggttgttggaaatccctttaccatggcctgcaagctcttctgtggcagcatttatggcatgagaaacatttgcttcatcagtggaaacgattttgccattgaactccaagataagctctggggttggaagagggtggttttggagcctcatgaccaagggcaccctagtgcaaatgccttggccacgtggcaagctgataccagcaagagattcaagaacacttgatttgccagatgattgatcaccaacaacaacaatggaaggaagctgaattccctcctttgtaatgttaaggcgcctgagattttccatagcatcaagaactggacgtatcctctcattgtaagaggacacaattggtgcaacaatagcaagaggctgaggctgttctgcagatgggtcagtttcacattgagaaacagatagtgcaacaatagccttagtgctaggtctccttcctccagccattttcaatcacaatcacaatggtaaaaaatatagagagagagtgagagagggatagtttggtatgcttattcttattatgagtgagtgagtaaaaagccagagcttaaatgcatatttatagattaaaaaaaaaaaaaaaaaaaacttagaggaaaatgaaaggaaaggacagtttggtttggtatcttgaaagttgaaaacaagcgtgaattgagcttttcatgggaaccgcagttacagagctgttggggtcttccatgtttaggtaattgaaaggtttctcgttaaatgcatgcatggtagtaattgaattgccgtaaatattagtaacgaaaatttcttacattaattaattcaactcaagtagttttagtaaaaccaaacctgaaggggaatatgtaccaaaaaagaaaaaaactgaagggaatgtagttaaggaaaagggacaattcattttataattcatctgaggaagctataaagttttatttatgagtagttattactattgataacatgcttcggcagtatgtcctctctagtctctcacatactatggcatatgtatggtcgtgacctgtgacctgtgacctgtgagaaaatctttgggtattgcttttgttgtcttaaaataaataaaaaattaatggtgctatttaattagtatggaaaatggtgaatatatactttgtttctttatgtatttttttgtgtgagggatttttgtttatttttggatgtatgacaggaaaaggaagggataaagagagaaaatactaatagatgataaaagatgcgatggaaaataaataagttttcatcattgataaaaaaaatactattacaatttaataataatataaagttctcttagtatttggaattttagacttaagatagaaaaaataatttgtttcattttttttatttttaaagaatttaaaatatttaatataaactctaacgaaataaattatagaggtttagagtaattctattctctataattatgaaattatgagccagctattttaggagaagaatttttatttttatgacttttagttttcgattaaatcctagtaaaactaaaagtttatagtcctgcattagttattcttctaaaatagtattttcgtttacaaacaaaagggtgaaaaaaataaaaatgaggaaaatacaattccatacaataaaatcatattttttttattttttttttatcattgggtgtttctgttacgtaaatggaagtaaaaaaataaaacacaattttattatgcaagtgtgcatgagaatcatatttttgttgtgctttttttttttatccgatttacataattgaaacacatttttgtttgttgtgtttccattcaagaggcaatttggaaatacagctaaaaggcccccacttcgctagtgccaataggcaatactctgtagaatatgcaaaggcccatgattttcattcttctactgggccaacacaaacagcctcgggaccatcaattttatatgttcgagttaaatccctttttatggcccatgattttaactttttcaaaaagatatttttaatttacatgtagtataatttaattttagtttaccagataattttttttatttctttcttctataaaattttatgaaaaagtttattcaaaaggaccttaattaaaataaattaactttaactcattttttaactttcaaaataatattcggtaaaacaaaactatcaaatagtaaaaaaaaaaaaggaaaaattgtatgagaaattcaaaacaccaattaataatgactcgtggcatttgaagaatcacaggattaataagtaagttgccataacaaaataaacctcgttttaaaataaaaattagtatttgcaaattacaaaaattatgaataaaatatttatgttttatttctcttaaaatttcaataaaaaattcaggatttaatcccacaaagatgataaatcttacattgataattaattataagcatatattttttaattactcccttcataaaagatatgtgtataataataaattaataatggagggagtataatatcaacaatttttttcataagagatactccctcaatcctaaaagaagagttatcttagattgtttacatatatcaataaaaattaataaataatgaaagacaataataattttacaaaagtaactttaatattaacatttattacatttaaaaactataataacatttagtggtaaaaaataattaatattatattaaaattaaaatacaacacttattttaaaatacttttttccaggaactttagaagatatattctctccaaggttgtattattctatatggatcaaacatagatcctccccacaaacacaacttatattgttaacggaattacatctattccattggattgttgaagttttatctattcctatgttacaacatttataagtttaaggtttcattcttaaataaaactataagactgattttaagagttattccattcttcatctaatcatgtatgtatggtttcttttctatagactattgagcatcttattttacttttttttatataattttttattcttttcaaatactattactcaattttagtttttattttatttcaattttaaattctaagttttttttatagatatagttaaattttagggttattataatcttaattaatgcaaataaatttattttgaattttagcattatattatatataccaataatgaggatttgtttaaaatgattatgatttatttccataatttcttctccaatttggaaagtcttatacctataatttattcctatttaatataacaaaatattttattaattaataaagtactgatattctccttaatttttttcattaataaatttatgaaaaatcatagagtgtaaaaaaattagaaatatttcatccataattgaacaaaatataaaaaaaaaattaaatatactgtcatttaattataaactactacatgtatgataaaattgttattgtttataataattatttttataaattataaataaaatcaagttgattaactttacattgataacataaatgaaaactatagtcaaaaataaaattacaggtatagtaagctagctaattatatccattgcctgtgtgagtaaacgaagatgacgaatcgatgatacaatattttaaagtgaactgaatcaactcatcttcgcagtcatactattatttagccggctatagcttgctaattgaatttgtatagattgaaacatcatccaatggctccaagtgtcaagtgggattctgttctgctaccctacctgaatcgaaaagataatcaataaagcaaattaatataattttcaccatcatccaaatttatatattgtatgatgtgatgtgaaccccatgatgtctataatatctgttggtactcttttaaattttatgtaaagtgtatgaacaaaattattttctttgtgacattcataacagactggagtttataagttaattaatttattgcccagtcagtattaattaattacgtactaaaccatttttctcagcaaattgtttagttttaataaacaattaatctccaaataagaagttttagtatgccatattttatttttagccgtgagtgattgccaacgattcaaagggtgccctggcgttgattaaatagaaacactcaagtgttgggaagctcttgtcttggatgatccccaagtctttttcttgctggagagttgctttggttacatgcataacctacaaagaagatttcaaatgcctaatattttatggaacttcttccatgactaaaaataaagtaattaatcttaatttttttataagaaaattaacggatattttttttaatatatatgtatgatttgttatatgtgtatacacacgaatatatataaactttatgttgattttttcattagcaatgaaaattagttattttattttctaaagtaatcctgtagtttaaattggactacattactgaaaacaagtacgtgatgaatctttttaataaaatatgttttttttatctttataaatatccttaaatttaatttattatgtcctttatttttatttttttaaaaataaaaataaaagacatgataaattatacaagattaaattgaacttatatgaaaaaaatagttaaacaatgagatatagattggtcttctctgaaaagatggtgatccaactcatataatccattttttagtcattttttcttttcatctctccctccttctttcatcattcttttcttttattttttttaatctcctcgtatttattattgggttcatcaactattaatcccaattaacttaagtaaaagatgctatagatgttaatgttaattgtcgtttatttttatttttatgaatttggttttgataagtttttttaaacaggtccctctcatcacttaatgacttaatgatgatgtgtcagtcagatttatatatatatatatatatatatatatatatttctaggacactaaattatatgatttagtaagaatttaatgttttctttttattcgtgtgagaatcaaattcagatatcatcaattttatattaaggcagaatgcacgtatgtagattagattatgttagttgtttctaattttagtgcttgagaattgagtttcactgtgttataatcataatttgagatcccccaatctattttggtaggatatagccattttgtactcgtcattatgcttcttgctgacgctgatggaaaactaccttcgaatcttcctgttctagagtcggcgaatttccatgtaactcaattttgctatcaaccaagaacactacattctccttctaattccgcagaactgatcataagccaataaatgatagtgaccttattaattaattatgaggcatttggtgtgtgcataattatcttttacacatgcattgcctaattggatggatgtatgtatatatagggaagagaatgctcttcccttgttgtattttactacttccatttcttttgaattggctattacaagaagttttaatttctacagagtcatggtatttcattatttttgcttcatttgtttatattattacatgcttgttccttactgttttcaagtttcttgcatgccacttactacttcatttgcacgcaggaaaatcgtgttgttgacgggaatgtggagaagatgcagcgggaggagagagcagatgatctggttgttcatggaaaagttgatcggaaaggaagaaaagctttgaaacacaaacatggggggatgaaagtttcattgctcgtacttggtaaactaggattgacatatataatatgagttcataaacagtaattaacatgaaaatgcatgtatatacatatactaattaaggtgtggattaattatactacctcgtagtactaattaaaccctgaagtgatggcaagtccttaatttaatgaccacttaccatgtgtatataaaacaatacaagtttggtgtggattaattatactacctcggagtactaattaaaccctaatgtgatggcaagtccttaatttaatgaccactaaccatgtgtatataaaacaatataagtttcattacatattgttgtgtctttaatgtttaaagcaattaattaattaagacaaatggataaccagttacacttactacattggtaaataaattaaaaaatatatttttatgaaatacataaaattatattatttataatttttttttacattcttttataatttttacactatataaatatattttttaaaattttttaaccaatattctaaggagaggtcgacacaagactcattaattaattgtgcacagtgcatatacacctcgttcattaattgatgcagtaagtgttaatttgggtttgcatgggtgcagcggcatttggtatagagaacttagcaactctgtctctagcagtgaacttggtgtcatacttcactggtattatgcattatgaactagcagatgcagctaacatggtcacctattacatgggtgttaattacatgctctccattgtggtggccgttcttgctgatacttggattggtagatacaaatccgttgttatttctggaatcgtcgagtctttggtaagatccaaacttaccttaattccttattgcataataacataagttactaatcgttattggtaaacccaagattatatatattgtttatgtgagtttgaccacatatagcaacgtaatctattttttaaacccacctttatacctattctctttttttttttcgattacctcatttattatttttattactttctttcttttatctctcaaagtatgtatataaggaataataaacctagattcaaaaaaaaaaaaaaaaaaaccgttgactctcaagtatatagtgggaagagatatacatataaagaaaagaggggggaaaataaatgtgaaagattatatgattggaaaacatcaataaaaacgtaaaataaatataaaaagtgaaaaatatatggtgctgatttttctctatcatgctcttgaccaatatatttacatgaatcataatcaagtattataatttatttcttataaaatgtgatatttttaaatatgtgttacatataaaaagtgattgggatgcatgaataggtggttgtctagaatcatctaataatttttctttagtaaatagatatgatttttcttgttcaccaatagttttcactaattatgaaataaaataaaagatatttattggacaaaatatgaaaatattgaagataaaaatgttttttaatagttttaattacttattttgatttttggaaaatatttttaaaactaaaaaggttaccctaaacataatataacagcccagtaacatcaagagctggaacatgaaagagaatttgataattaaacatataaatgaaaaacagtacagtaaacggagatgttaaactttattaaatgacacctttagtttttttttttactctaaatcaattaattttattattaaatttaaattaaattcttttaaagttatatatagttaaataattagtttatactttattattttattttaatgtatgatatattttatatatctgccaatatttaaattaatcatctaaaatttaacaaatatatataattactgaaataataccctatttctctgtcactcggataacagattctagctagggtgattattagacattatataattgcaggtactcatctaatgattaataatgatatcaattatttaatttaatcaaataaaacaaattagataagaagtatttttaagttattatttaacaacttatatttaagtaaaaagtttaatatctttaatagaaaatctcattttaagatcttagttattatttttacgaatcctacaatgttatattactttaagattttatttatattttattttaataatatatctcattttaagattttaaatcattttttgtatatcctacttacactaatagaatacaagtcaattttgtgaaaagagtaaaaattattatttttaaatggatactctaatagtcatatgcactaacattatacattgtccaataaataaatcaattatatatatatatataaaaccaataaacttatcacatataatatacaaatgttttacatattatcttttttctcttaaataaaaccaattgaaagtaagcccaatttatatatgcaactaatttactttaaataattttctaaagcttattcaatcacaagtgcatatatgcatgaatgtgttgtagggactggcattgcttacgatacaggcacgcgtgggtagcctgacaccacccatttgcagcctgtactatgtgagagatgcacattgtgaaaagcttagtgggaagcaagaagcatttctcttcattggcctctacttgttggcctttggtagtgcaggtttgaaggcttccctgccatcacatggtgctgatcaatttgatgaaagagaccccaaagaagcaatgcaaatgtcaagcttcttcaacggtctctttttagcactttgcgttggtggtgcagtcagcttaacatttaatgtgtatatacaagacaataatggatgggtctggggctttgggatctccaccgttgctattgttttgggcaccattatctttgcctctggattgccactataccgaattcatgctgcacatacaacaaacggaatattggagatcattcaggtatacactcttttgcaaaccttgttctgcatgtgctgtatatatttcaatttgaaaatcatatttttttttatactcacgatattagtgtgaaatatttattgattttattgataatcgattaatctccatcgaaaaacctagttgacctctttaagtggctctttcctctccatcatgtttttttcatctacaaaatttaaattcgagactttatgtaaagaaataaagtccagtattacccagactaaaatttgttggttgaaaaagtatatttttgagttcattaggcatgcattatgaaagtaaatttttttatacaaattgttaaccaattaaaattgattcatagtatgacttttaaatagtatattataaaaagacaaattaataaacttttatgaaaaccctttacattgttggtagatatattacttaattctatttttatttacttatagtctgattctgatacaatacaatagttgaagtttttaatttagctcgatattgcaatgatcaagcgcattagttttgaattcttcgcgtctattttccaggtctatgttgctgccattcgcaacagaaaccttccccttcctgctatccaactatatgagattcaacaggacaaagaagccgcagtggaaatagagtatcaaccgcagagatattttcaggttcaatccgaccgtgtctaatatgagtgaaatactatatgttaattgttgatagcttaagtattaaagagtaatgataaatgtatataccatggggattctccacagtgtctacctgtcacacatggctaaccatgtgtgcaaataaatatgattaattttatacaattatcgatttgaatttatcactactagaaaaataggttttaacatcgcctgtttaacatcggttattgggaaaaccgatgttaacgaaaacgcggtggcaaatttgtaaataaatggactttgttaacatcggttttcaagattttaacgtaaaaccgatgttaaccatgtactgttaacatcggttttcaagattcttaacaaaaccgatgttaagaatgtaatgttaacatcggttttgaagattttaatgtaaaaccgatgttaactatgtactgttaacatcggttttcaagattcttaacaaaaccgatgttaaccaagtaatgttaacatcggttttccatatttttaataaaaccgatgttaaactaagatagttaacatcggttttgttattgaaaccgatgttgttatttttataaaacccaccccgccactgattaaacccttcactctcgcgcctacctctgaaaagctctcaccttcactgtgacgacgctttcggtctaaaccctgcactgtcacccactgctcctaccttcgttgtcgtcgctgtcattgttggttccaggttccagtcaccattgtcgcttccagtcaccgctgtcattggcattgttggtgtctttttgaggtcacaactgtcggcacgcagctcccacaaggttagcattcctctgcttccatctattagttggtttgaaatggaactgaatcatatgaaatgctctgtggctcattggcaccagctgaacaacgatttcatgattttcatttgtttccataaattaatgtgttaatgtaccttatttgatatctttaggtgtatgttgaacaaaaggtttaagaaagcaaagatgaaatttgtaaagaagccgtagtgctttaggtttatgttgtgtgggttttttgttgattcgagttttctgttgttggttgtggtgaagggatcaatgatgggttgtaatatatagggcctttttatgtgtgaacatctcgagtatttaatggttaacatattctgctgttgaggtaaatctggaagaatgtaggactctagataaacaacaagagagttgttgggataaccattgtgctttgtttgtcactgttgaggattattagagggcccctgagaaaaccaataaaataaaggcaaaagcaggaccatactaaattgatgctatagatgttgtaagatcataaagcctataaggttactataacatacaaaatgaatatagcatagtacttaaggaacaacgcagtgagtagttgtcataacatacacaaaaagaataaatacatatatactaacaaaacaaggatatgagagccattcgaattagactttgaagttacaatgtacgttcactaagtgcgctataaaatgcctaaactgtgtatgatattcattgtggttctgacattgtgtccgtgtctgcaagttacaatgtatgttcacatgaacctcatgcattgctagatggtgagtgttgaagttcatttcgatatttgttggtgcttaattggttggtttttcatatatccttgtgaactcaatacttgtgtacagttgtctccgtgaggatagagcaatggatgtcaaattcttatttggtttgaattggtagctttagtagtttttgtttgtttggttccattgttccaatgttttagaaataagctatgtctccaagtttgttgacaacatagaagcaaaagaaaaaatacagaaagcacccaaggctaggacagaaagtacataatgatttcttctaaccaagtcattatattagatagtatttactgccatgagtaacttacccctgatgttgcatgattcgtctgatagactgcataatgggttcaatatcctttagaacatcctgctcctcagatgagtaaatgtccaatctctgtccaggtgctctaggcaggcgattcctatttttccagtcgccagcatttgaaccccgaccttgcgaaccttcaaatcgatttttcttaaacgagtctctaccttttccccactgaaaacctttctcattttctgaattagctgaagcaatatgtgattcccatccctgtgaacttgaattttgatttgactgattatattagttttgtttgcttttgattaatataatagatagggtcttaggtcttaaattgttatatgatgaatgaattgaaatgaattgagtaattaagttgatggatctatatgcgtttgttggattgatgataactaataatggtgaaccaattcagacttggtggctgctttgttttggtttatgaagctcgcttgagtgaagacttgaaccagtgctaggaggtgcttgctgaaccaattcagactgtaagtatatgcttctggctttatatgtttatttagtttaatctatttgtattttaagtgaaaaacaagatgtaatcttgctttaggtgatttagacatatatgaagaagaccaagtagatgtattttaagataatgataaggataggcataacattagaagtacatataacatcattgagaaggatatatagagtaagggtagtggattattagtgtgaaccttccaagctggagatagaagtaacacctaccaattgagctgcaagatttacaaataattcaagattgttatttgtttgaattgggaggagctgatgtgctgttaggggtggaatggttggcaggtttgagtgaagttgaggctaactttgagaagctaaccttagctgagggtacagaataggaagatcactttgagggctgaaccagaattgattaaagatgccattagaatgaagttgattaaaggaaccttgttggaagctgatcaagggtttgtagtggagctgaaggcagtagacagagaagagcaaatagaagaaattccagattcaatcgggcaggtattggcagaatttgagcaggtttttaaggaacctcaagggctgtgataggaactggatcagttttagtgaaaacagagaagatattattgaatttgggagcaattcccagctattacaatgtgattttcgaggaatcttaacctccatacaatgtcattggtcccctcctctctactgcttacagtgtatttatattctgtttccaactaataactgatagttagtttcagttatttcaactatccactaactaaaagctcctattccaactaacccactaactaaaagctcctattccaactaacccaccatcatttcacgattcagctctatgcgaagcaaccaaggtgaaattttttcacaagcaacttcttcatcatccatttcatagtaggacttcacaaaatgaacgtcctcttcaattattgtactcatcgggtctggatcataccatacctctgtagcttcagtcacactcctgagagtggtatattctaaagcacagacaaataaggcgttttaattctctttgccacattaatgatttcccttaacctacgaacaccaagagtaacattctttgcactgacactagcatagtggaaagtgttgagagtcatactgcttctgtgtttgttgtcattttaatatgaatactcccctaaatatgacgaacatagcattagtttattgaatagcgcaacccttgacaatgaacgctcctataatgatctgatttgatccttatgattatataaatatatatggtaagtattttgggataatgttgatgttgtcactacattgactaactttctacttctaatgcttgtattttgatttggctcagtcgcttgataggttcccattgtttgcttctcattcccagactttgatttggcgcatgtgtgtcaggtactatgattttaattgtctagtgcaatagtagtaatgaaaggtattattgtgtatgaaccattattatttatgcacaaatcaatgcaatagggtagatcactcttcaccatcatttgtatgtagttgtccgttgcctctgtgtaccatcgtcaccatatcaactgttggacattagcattcaccatcatctcaggtacttacaaatgccttgcatctttttttatcttatgtatgtaaattgttttatgccatttaattagtatgtctatatataaataatgttcattatgagtgaaccgtagtttcccgtttgagattcattacagtgattcttccggacagtttggattaatcattgtattgaatcttgaattgttcgtttggacagtttcggagggcttatatttttttagtatattcatgtttatacgttgtcattcttgtcttaaatatgataaaatttcggtccaatgcatttcactttgttctccgggtgcatacttgattgtggtggaactcatgccaccgctttcatttcgtgtacttggagaccaaagcgaaatgctgccgaaattttgtcatatttaggataaagactcaacgtatagatatgaatatactttaaaaatatgtcttcctgaatgggatagggccacaccttgaattaaaaaagtgaggttttcatgcatggatgaactttgtcaatggatctcagacttggttagcacatggatcgatcttggatgaatgcaagtcgcatcacggttgagtacgaacaaggagttgaaaatttcttacaatttgcctccgaaagaggtccacccgatggggatggaaaatatttctgcccctgtatcaattgtttgaatggtcgaaggcaaacactagaagacatacgggagcatcttctgtgcgatggaattaagaagacttatacgacatggatatggcatggtgagttgacagacacgcagagggtctcgcatactgaaagggttgatgttgacatcggcgatcgactagaggatatgatccgtgatctggggcatgagtcttttcagcaagcacatgcccctatgtatgacacgttggagagtgattcgaaaaagccgttgtatccggggtgcaaggagtcattgacactgttgtctgcggtgttaaatctagtgaatgtgaaggccaaatatgggtggagtgacaaaagcttcagctcactgcttgaggtacttaaggacatgcttccagaggaaaacaccctgcctagcagttactataaggcgaagaagatactttgtccgatgggtatggagtataagaaaattcatgcctgtcctaatgactgcattttgtaccgaaatgaatttgaacaaatgcataaatgccccacgtgtggggtatcacgatacaaagtgaaggatgttgacgaatgtggcagtgatgacagttcagcgaaaggccctcccgcgaaggtgttgtggtatcttccaatcattccaaggtttaagcgtctgtttgctaatgaagatgacgcaaaagaccttacatggcatgcggaggtaagaaactctgatgggatgctccgacatccggcagattcagttcagtggaaaaagtttgatcgtttgtatccggagttcggcaacgagccaagaaatctaaggcttgcacttgctagtgatggaatgaatccgtacggtagtttaagtactcagcacagttcgtggcctgttttgcttgtcatatacaacctgcctccttggttgtgcatgaagcgaaaatacataatgttgtctatgatgatatcaggcccaaaacagcctggaaatgacattgatgtttatctcagtcccttgattgaagacttgacaaacttgtgggatgagggggttgccgtgtttgatgggtatcgaaaggagacattcaagttgcgtgcaatgctattttgtaccattaatgattttcctgcctacggcaatttgagtggatacagtgttaagggccatcatgcatgtcctatctgtgagcaagacacgagttacttgcaactaaaacatggaagaaaaacagtttacactcgccatcgacgttttttgagatcttatcatccttatcggcgattgaaaaaggcatttgatggaagtcaagagcatgaacttgcaccgattccgttaaccggtgagcaggttcttgagcgggttaatgccatccatactgtatttggaaaaacgcaaaagaagcagaaaggtaatacatgcttatggaagaagaggtccatattgtttgagcttccatactggtctgatctagatgttagacattgcctcgatgttatgcatgtggagaaaaatgtgtgtgacagtgtcatcggcacgttgcttaacattcaagggaagacaaaggatggtttgaacactcgtcaagatcttgctgagatgggtatacgtcaacagttacatcctaggtccgatggtaaaaaaatttacttgcctccagcatgccacacattgtcaagaaaggagaagatcagtttttgtcagtgtctacggcgagttaaagtgccacaaggatactcttcaaatattaagagccttgtacagatgacggatttaaaactaacttctttgtaatgcaggctgagtttgatatacctgaagcctcagacgaaaggacaaagaggaagatacttcagacagtgggtgagcggtggaggcagttcaaatccgacttgacaaggaagtgggtcctcgcagaagggaacgcggacgttgccgacgctgtatgcgagaaatacggcatcagtcacgaacagtggacccaattctgtcagagtaggcgagcagcttcctgggaggttagtggttttaccccttttgagtggatatgtgttaaccaaacaattgtccataactatctctatataaccgtgtatttttcataaccctgttttttttcatttatgttgtcatacactcttttatttgctaactttacgtgtcaacttgttacaggatgtgagaaagaaggcccaggcaatccagaggcaaaacaccgcccctcacgtattgtcacgcgggggttacgagttgctcgagaagagattaatggaggaaaagcaacagaagcaagtcgagggagcaactcgtgatgacagcacggagactatcattcatcctccgtcccccgtgcgacgacacgtgaagtggaagctggctcgcacgaagaagagcggcgacatgacttcggaggcggcacgcgagattgctgcgaggattgtaagtaaaacaatacaaatgacatagacatttatttatgtttcgtatcacaactaacaaaacaaatgatctactttacgaattgcaggattccctggaagagcagtccacccagggttcttttgtcgccagtggtcgtcaggatgtcctggctgctgccattggacgaccggagcaccctggacgtgtccgtggtgctggagttggtgtgaccatcacccagtacttcggacccgctgcatcatcctctcggaagtcgaggtcttcatccatggcgcctgaggacttggatcgcctgaaagacaacatcagggccgagctggagcagtccatcactgatcgacttacacagtcgatcacagagagagttacccagcaggtgatgatgagcttcagccagctgcaatcccacatccagtctcaggcagccattcagcctccggaggtacagtcatgtccccttggtgctcgtgtcagcaccaagggaagctgcgtcgatccctcgggcaatgaccctgacacgggtgcatctgacaggcgtgggttgtatgtggatggcaatcctccccgccttgttgcccttggcagagttcatgagggatcgacgactgtgcacaacgtccctcttgccgctggtcaggtaaaggtgagtgttgaggaggttcgcgatgcagacgctcccgtccctgttcccactgacgaggttgtgttagtggggcaggcacttaacactttccttgcctggccgacacatcttgtacagacaattttgacccaggttttgttctttttcccttatgtcttttattttacgaatgatttgtcacatatgaacttaacatgatcgctcacccttggttgttaactgtgtaggataaacaagaagccaagggaccggcgaaacctgtagataaggaggaccatgcttctgatcccttgtaccttctagccctgaccatccctgatcttttcctcagacccttccaggtgccatgggaccctcagatgtttggggtatttaatgaaaacttccccttgtacatgaggcatgaggatatttcggagatcatccatggtggtcagtgtctcagcatctccgttttacagttgtggatgttgtaagtctcttgtaattgacaaattatttggtgaattgttttatattgtagcataacttactttattttcattgcataataggcatatgaatcatttaagtctgcaatccgataaccccgatgtctatggattcctcgagccacagtcgatacagagaactggccaatctcagtttttgatcgaggactatatgaagaaatggatgcagacttcacagaaaaaagtctaccttgcaccctatttgaatgggtaagcataaatgagaatcacaatttattaatgcagcatactaaacttgttcttgacaatgcagttcacattggcaactgatagttatatgtccgaaggccaatgtagtggtgtggttctgttcgttgcataacagacctgataactaccttaaaggaattgttaacaggtaggttctaatttctaacacatttacgttattttttatacttcaaacgtaagttgaacactatgcatacttgtttgtcttaagcagtgctttgaagggactgcatgactctccagcaaataaatcaaaggctacaactaaatggattgcgcttaaagtaagtcttttcattaatcatggtttaagtatcgaattattttttattcatgttcacggtatttgccatttaactttgactttgttttcaatttagtgtaataagcaaataggaagcactgagtgtggctattatgtcatgcattggatgcagacaatagtccaaggagccttcacagatagctgggacatggtaaatacttgtctaatttaaaacaaattgttttgctttacttgtttttgttttgtacttataacatgttttgttatctcatgcagtttttcaatgatcaaagaccattggaaccggacaccatgaaggcaatcagactccaatgggcgaaatattttcttaaatttagacaagatgtattagtagattagggggttcatttctagttttcaaaacaattgtatatatattaatgtttagcatattctttatgtacattaacactttacattggatttgttattggaattattaaattgtgcattgctggtgctgctactggatatttaaattgtgcactgctggttctggatatttaaatttgcaggttgaagaactgctaaaattgaaaaaatagataaaatatttaaaaaaaaaaataaaaaacaacatcggttccaaacaaaaccgatgttaacatatacaacaacatcggttttgaaggaaaaccgatgttgtatgaataaacaacatcggtttttgtaagtgaaccgatgttgtttcttcaaaacaacatcggtttttgttagtgaaccgatgttgtttcttgaaaaaaacatcggttttggagagaaaaccgatgttgatatcattaaaacaacatcggttttctcttagaaaccgatgttgttttcaagaaacaacatcggttcactaacaataaccgatgttgtttattcatacaacatcggttttcctttaaaaccgatgttgttgtattccttgaaactcttttcagcgctttcatgtatgacgactccacatcggttattggtgacaaaccgatgtgctttacatttggtaacatcggttttcaaaaccgatgttaaattctccactttcaacgtcgcctgattcaacatcgctcgagaaccgatgttaaaagtctaaaataaccgatgttgaaagctgcttttctagtagtgtatagtgcttgtatttaattaactatgtctgcaagtggttaatagtatcacgaagttatgaggttattgaaatgtttaacgttggttaactttacctcacaagtcggaaatgattaataggaagggaacttgtatatataattatcattatgtactattgacacaaataattaaatatgtctcacaagtgattaattttcttttgcacaggttcttggacaaagcagctatcataagtagatctaatgagcaacctgagaaccaagagactccaatgttggattaaactttaatgataataaattagaaatgtgaagagtcatatctctaagagaagaaattactcatgtgaaaaatcatgtctttacatgagtcatgtctttaggagaagaagttattcatgtgaagagtcatgtctttaagtttcttataaatagcatctcatgtaaaaggtcaaaagtgtggcttggcagacaattatcggcaaaaaaatttaaataatgctttttaaataacaaattaccaaaatatggcaattcaaaacctatttacaaatctactgttgtcatttgcgttttggtaaaacgtgttaaaacacgtccagcttagacgtgttaaaacacgtcctgggaggacgtacatggtgctcaaacacgtcctgtgtagacgtgaccttgcctcaaacacgtcctgcatggacgtgattaaacacgtcatgcagggacgtgattcaaccccccaacagcctataaatcagccccctcagcccacgtacaatttgccaagttgtggatgttgaattgttgattatagcaattgtaaagctctgaaccaagtaagtgatactatgctcaaatgtttattggttaattacgtggattatgaggtaaatttttgttaattagttaggtaatgtatgacctaggtttaagtgacatagttggtgacatagataattgatattgtagaaatagttattgtgttattgtcatagataattgatattgatgtacaaaattgttattgacttaggttagaaataattacttattataacaaaagttcgatgacctaggttttgattaattgtttatcatgatatggttatacatttttatgtgttacaggcgtgaccgtggtgttgtgttcatcatcattgtgatcttgtagtcgttggtcatatattaaaaatgtctggagatggtgattttgttcgtatcgttttatattataatggtagcaaaactgagagtcgacatggtattgtatttgaaggagagaaaaggggaacacgtatcaaccgcaactcaactattgaagaattgcatgaaaaaatcagaaaaaaattattgtgtacagaagccaatgtatctatcagtatggtcactgcaagaatatggtgtgatgataaatatatcagcatgaaagtaattgacgacgaagacttagaatttgtaataggagaattcttcaaccagtcaagaaaaaatttcttagagttgtacgtggattttggtggactagaggatgtggctttaccaacgaggtcagttgatttcaattattctcgtggagcatcagcatctgctgctccaattgcaaatatgtctatggaagacgaaaatgatcccacttgggttatggacaatgatattgacaatgatgatgatgaaaatatcgcaatggaagatcgtcttcttgctgagaatgctagtgcttcggacaatgatgaggatgatggtcgaagtgcaagacaaatacaagtacattacccagtcgtgagagagcattcaacccaagaacaagaggatgcaggggagtcgcatttaccacaacaatgtcaaggtgtgttaccgaacaagactcgcttacacatatgtttgtttattgtgtatgtattttattgtcatgaatttgagaatttgcatatgtaggtgagggtaatactactttttgggatggaatcccacattacacctacattgattgggattatccgagtgaacaagattctggcagtggttgtggttcaggttcagttgagggtccatgggtattagggaataagttgtttgtgaaacaggaatttgcatcaaaagaagacgtgcaaatggcaatcaagctgaacctcatgaaggagcatcaggaagctatcgtggttgaaagtacgccgagaaagttaatcatgagatgtcgtgcgcatgaccagaattgtccatgaagggttagggtaatcaaaccaacgtacggtgaaagatgggtggttaccaaatgggacggcgatcacaattgcttaaatgatcacatttctcaggaccacagacaacttgatgttaatgttattgtttcactcgtactaggtaagttattggatgagctgataatgataataagtaatgatattattcttattattagtgataacgtgattatttttttattattagggatgataaagcatgatccatcatgttcaattggactagtccaggaaaggataactcattcctatggatacaaagtttcatatagaaaggcatggtatgcaaagcagaaaacaatggcaattatctacgatgattgggaggaatcatatgcatttttgtcgaggtggtgtgaatacatgcttcacttttcaccaggttcgatttatcaaattcagacaaaaaattattatgtggctcatagaatcgttcgtggaaaacgcgtgttccagcgcattttttggaccttcagacaatgttgcgaggctttcaatttttgtaagccggttattcaaattgatggcactcatttatatggcaagtacaaaggaaaattgttgattgccacagctcaggatggaaacaatgagtgtttgccaattgcatttgccattgttgaaggtgagacgttggaagcttgggaattctttctggataacattcgctcgcatgttacaaagaagacaaatctttgtctgatttctgataggcatcaaagcatattgtctgcagttgagatgcaccccgggtggcaaccaccgcatgcttatcacgtcttttgcctccgtcatattgcgagcaattttaatcaaaagttcagagatgaaaaattgaagaaagcggtcatgactttaggtatggttaaaaactcatgtattgatttttcatgtataactaaattttaatgttatttaatttctgtgcagggtatacgccttctattgttgattttgacatagcctttgcaaattttcgtgatgtgagtcctgaggttgccaactggattgatagcatcccgaaggaaaagtggacacgtgcatatgatgtcgagggacgcaggtatggacatatgacaacaaatttggcggagtcagtaaacaggattttgaaaggtgcaagaaacatgccaataaccgcgttggttaagcacacttacagcagattggtggaatattttgtttgcagaggccgatcggctcttaatgaattgcaaggtccttatccacattgcaaaaatgtggttgctatgttgaaggccaatgagaccagtgctactggtcattatgttcgtgcatataacgttgaacgatctgtatttgaggttgacgatggttatgacaaatcgtactcggtaaacctccctgagcggttctgtcagtgtgggaaatttaaggcgttcaagtatccttgtagtcatgctgcagcagccgcgttacatgttcgtcagtcaccggcacaatatgtggatgacgtcttccttatatcaaacttggtacaagcttattcattttcgtggcagccaattggtaatgagcaggcaattccacctagtgatgatccagtggtcataccagacagagaatatttgcgtgcaaagggtcgtccaaagtcaactagaatacgcaatgagatggacgaagttgaagctagtcaaagtcgtattaagtgtggtatatgcagattacctggtcataaccgtcgaaattgtcctagtcgtccatcatgaattggttatgttcttgtcaatgttttgctttatgttgttgtattttgtaatgaacatttgaaccgtaaaccaaacgtccattgaaatcactcatgtgaaattcatatatgctacgatgagtttcagacatcaaaacgcaattgacattaatggtaacatagtgatggaaacctaatacaataacagaccgtacaaacaattggaactagagagataaacccaaaaaagttgaacatcgaaaaagcaaaacaacgaaccctactaagaacaacaattcaaacatgaaaatgacgaaactaatcataatttggatggtcttgtgcagcggacatgtcatcttccagcagttcgattaccggtttattaaaggtagctaagatttctattggagagaaacgcttccagtaattagattctaccaacaccttcagtacatcttcatcatttttcagttttattatttcatattcgaccatgttttctgaatattttgcgtgacctggttgtctgaagaacaattgtctgacaacctgtgattcgtgaattccataagggggaactcctaccggcgcaacttgcttgattatatgcttcagtgtttccatattgcatcctgaaggaatttgaaatcttactggattttttccagtaaacgagtaacccaaaaaattgtctgttcgtggtatgttccacttgccgttgtaatacaacagtgcatcatgagtaggagtcatggtggctcgaagtaggttgaggacaccatcaggtgttctggttatcatacataacaattcgataggaccaacagatgggagtttttcatggcacaccaacatagtgcaaacatcatcatcatttttcaattgcagtgaatggaaaaaaagattgttacctgtattaatggatgtttgtcgatagtaaatttcatccacagactggtcatttgttagcagaagggtgttgtgcattctactcttgagtgactgaaaggaacactcatcgggaattcgcattggtatcggagtatgacatacgaaagaaacaccagtttcattctgtaagattgatccattcggaaaaataaacgctaatttggaattaccaatattttgagagcaggtttcacctaagaaggccatcgtattgaggttgagtttcggttgtggaggtatgttgtgtggatgattaaacaccactgtgatgtatatataaccgtgttaagccctgactgtgtggggggtcaccacttgcgcctggatggggcgtgagtaaacagctgtcgtggttgtgttgtcaatgtcacatgacagaccagtgaaatttaatgtctacagtaaaaaggaccacaacgtgttgtcaatcgtccccggtgttgtcaatgtcattttacaaatcagacgtacttattggctacagtatagaggaccacaaagtgttgtcctgcattgatcaaagcggtagggctctttcacgtgggccaaaggaccacaaagtgttgtcctgcattgatcaaagcggtacgtgttttagacgtacttattaggcgataaataaatgtccataatgaaaacatgtttaacaattacatagtcaaatacaaaaaaaaaggaaactaaagtaaataacaaaatataatgtctacgaaggaggaggccactgataatgacgggcctgacgatctgacaatctgcgtctaccacgtccatgcgaatgctgaccagcaacataatatggcggtggagtgtcctcgactggcatatctggacgataatatgtctggcctgcatcaaaattaatttcaccatacaggtcatccgaagctctaccaccccagtcatgataccctgaagcactcgtccctgcctcatccccgaatgccgtactcgtccctgcctgatccccgaatgccaccgacactggactcactgcgtacgcaggctggctctctgtgaacatcggtgcgggctccggccgatagcatgtatcagcctctgcctgggtagggtcgtaatatgtctgatgaaccccgtactgatgaccgatgttgggaggcctgatccatccaggcatgcatggcgtgggggcatgaataggctcgggaacaggtgtaataggacgtcgacggcgtcctaaccctcgaccctctctcgcacgacgccaaacgtcgagcgataactggggctcatccggaagctgggactgcggtgcctctagacctggctcagtcacccgagctgactcactgaaaacatcaatcagacgacctacttcgtcatgcacatactccagaccgtagtttccaaattgttcaggcgtcgtcacaaaatacaaactctccagaccatcagcctgtaagccacaacatagttactaaaacaactatatcaaataatgaaataataaatattgtgttctagtaacttaccgagcgtcctaatctggccccctgcttcgtcacatatcgcttcccagaaagtctataccaaaccatgtactcatggttcggtgacatcagaccatatattggaggaggcacgtcaacgtgttcacccctcctatcccatctctgtataaactttctgagcttacgagcccaattttcttgggctttaccccgaagggtataatcatgaacccccttcagtttcccagccctacgaggaattggttgatcccgtccgaattgcctcatgcatcgatcgggctgtgaatactcagcaatgtgaaaacaaattataggtgtcctagccatccacagacgtcgtgtctcagcagatgcacccataaaatcgtaatcaccgtaaggttgccaaaccacctacataattaaaacatctgtatcaggcagttgcatattcacatccatttaaaactgaacattatttatttaaaaagacatacctcatgtctacgtaggctgtctagcctctcccgaaaaaatgtcaatgagttcgggctgaagcgacgtaagaaattaaatctaatacacagattaaacattcaagcgttaattgtagcacgcataaatacacagccattctagtaatacacaataaacatacctgtgtccgaagtggcggtctggctcgaacacagctggcaatgggggagcaatcggtggaaatctgagccatgcccaaatctgaagcaaaacagtacacccaccgatgtcttttctatcggggtctgtgcattcgcacaactgtctaaacaagtttgccagaaccgcaaacccccaactatatgaaccaatgtcagcaaagtcaccagcaagtaaggatatgtaccgacatcctacaaagctcccccctgatttgtcgcataggagccaggctcctaacatccgagcaatgtgagccttcgtgaagtatatctcattctgagggttcccggcaacaaattgccatgcacgatacactctgtcgaagtatgataatctcaaactgccggtgcataactcgacgtccggatcagggccgttaccaaaaacctggttacacaattcggaacaatctgtgtaggtccgtccagtaacggctcgcccatcagtaggcaatcctagaatacctgcaacatcttccagggtgatcgtcatctcaccctggggcatatggaaagtgtgtgtctctggcctccaacgctcaaccagagcactgataagagcaggatcaatctgcaaaatcgaagtaacttatcgatttatgcgtttcaaatacattatgtttgaaaccatcgatttcacaattacaatttcatcagattaagttaacaacattcgttaatcgatacctgcataaacctcatacgagccacatgtatgaagtcagcctcagtcaaatactgggctactgtgtccgggatatcgtcgtgttggggtccaccaatgagtctacctgcgcgacgtatcttcagctctctctgtgtgtcctcattccacactgcctgtgaaatatgagtgcgttgcctccgccttcgaagtacatcccatctatatggaccgggaagaacatgcgttgtgggatcggtaggctcatgctcccggtcagagccagaacgaggtgactcagatgacgacgactcagccataataatatgctacacattttataattatattataatattttacctaatttcaaatacaaattatttaattcgctaactacaaattatttttacacttcaatacatgtatctaggtcactatctgataatctacttcgtaatctaggtcactatctaataatctaactcaccaacgataaaaaggtctatttttgttctggtcacaagtgtttcaatatgctatataccttaatgtcatcacaattagtcatctcatcaatattaactgtgtatgtcaacaattttcattaaaaaaatatataaaatacaagctcattttaacaaaagaattgtatttaatttcttttctaaaatttaattgaattaataataattaacctaggtcctaatctaagtcactatctaataatactctaagtcactaaataacaatttaagtaacaaactaacaactaacaactaacaattaacctaggtcactaactaactaactaactatttaacaatctaagtcactaattaaaccctaacaactaactaacctagtaacaatttaagtcactaactaataatcaacctaggtcctaaacacattttggcttttgatatctcatcttgtaatatttattatgttttacaaatacattttggtattcaatatgataaatatatcattattaatggaatttaaaatttaagaatgccaaataaacctaaacctaggtcctaaccctaaacctatgtcatcaaccctaaacccactatttgtttcttaaaccctaaatatatgttataacctacgtaccctaaactaagtaactaactaacctactaatataatatatatcatgcaatttcaaaaattaactaaccttacctcacctcacccacctacttcatagtctaagacactaactaataatctaataacactaacaatttaagtcactaactagtaacattgtaacatcaataaaataaagaatatttcaacatgacttacttgatttatacagcttctttgcaccttcttccttgcaccaacccaaagcctttccttgcaccaagccttttgcagagagaatgcagagaaaaaaaatttttgagggagagagagtagcaagtgcagtgtgggatggctgggggggtatttgtacaggtagctgaatcacgtccctgtgtggcgtgaatggtgcttggtcacgtccacacaggacgtgaatggtcctctaacacgtctctgcacgacgtgaataaagccaggacgcgtccctgcaggacgtgaatggagccaagacacgccgctcctagacgtgatgcaggctctgttacgtctgccatggacgtgaatcaacacgccttccacacccgtgaccatgttccagtcgcgcccatgtgtgacgtgaataaacacgttccctcacagcgcaaatgacagcattagatccgtatatacttttcaaattgccatattttggtaatttgttatttaaataacattattttaattttttgccgacaattatctaaatacatcagaagtattctaccaaagagattgttgtgtgtttgtgcgagtgcaccagtgtgtgtgaggacctgtgataccacaaattggtatcagagcattgagaaactggagagtgggccaagtagtagtctgccattaccccgccttacaaaggctaattacgaaaattggagtatccaaatgaaagcccttttgggagcccatgatagttgggaggttgtccatggtggtttcgaggaaccaacatccacagcaggatatacggcagcgcagaacaagacattgaaggagacgaggttgaaagacaaaggggcattgtacatgttattccgggctgttgatgattccgggtttgagaagattgctggtgcaacgacttcaaaggaggtgtgggacatacttgcaaatgtctacaagggtgccgatcgagtcagacaggttcgacttcaaactctccgtggagagttggaaggaatgaaaatgaaggaaggagaaggggtatccggtttcatcacccgggtccagaccgtggtaaatcaactaaacagaaatggagaggtgttgtccgattccagagtggtggagaaaattctgaggtctctcactgacgacttcgagaatgttgtatgtgcgattgaggagtcaaaggacctagcaacgctcaccgttgacgaacttgctggttccttggaggcgtatgaacaaagaaagaaaaagaagaaagaagagtcactagagcaagcactccagacaaaagcttcaatcaaggacgaaaaggtactctattctcaaaacttccgaggaagaggacgtggctatggaggtcgaggagatggtctaggtagtaaaggccgcggtcaagaaggaaggaataaggagtatgctgaatcaagtcggcagaattggcgaggccgaggtcgtggaagaggccgacattcaaatcaatcaaatgtagaatgttttaaatgcggaaagtatggacattactcgagagattgcaactcggacagatgttacaattgtggtcgagtcggacattttgcgaaggattgtcgagatgaaagaagaaatgaaacttcaaaccttgttacagaaggagaagtaagagatggaggaattctgatgatgactagaagtgaagtcaaccagggatccgagatggaatggtatctagacactggtgcaagcaatcatatgtgtgggcataaacatttgttcagtaatctgagacaaatagatgctggacatgtttcgtttggagatgcttcaaaggttgatgcaaaggccgaggtacgatttgtttcttatagaaagatggacgaattgtgcgcatccgagatgtctattacgtgcccgatctaaaaagtaatattcttagggtggaagagaggattcaaaattctagaaaagggtggagaggattcttgtttgtgtctccagcattaggctgttgagagagcgtctccgagaggttgagagcaagttgagagcgtttccaccattgttgttggtgaggttgagtgtctccggctgaaggccgttgagagtgattgtaaccattattattgagaatagtggattgttctagactaggtcccgtgggttttccttttgaaggttttctcccacataaagctattgttggttgagtctggtgactccccagtgtttgtggttggttgaggtgttgctcccaacagagaaggagattgtgtgtttaatcccatcaaagtaagacagtccaaccgagatccgtgtagataataagtcagcaatcgagttagctaagaacctggtcaatcacgaaaggagcaagcatattgacgtcagatttcacttcatccgagatcaagtaaaaggaaagaaggtggaattacttcatgtggcaagccgagatcaagtcggagatgttttcacgaagccattaccgacattactgctggaaaattgtaagatgttggggatgaaagacggaagaaatatttaaagtttatagggggattttgttggattaaactttaataatagtaaattagaaatgtgaagagtcatatccctaggagaagaagttactcatgtgaaaagtcatgtctgtaggagaagaaattactcatgtgaagagtcatgtctttaggagaagaagttactcatgtgaagagtcatgtctttaagtttcttataaatagcatctcatgtaaaatgccaaaagtgtggcttggcagacaattatctaaatacatcagaagtattctaccaaagagattgttgtgtgtttgtgcgagtgcaccagtgtgtgtgtgaggacctgtgataccacatccaaacccgtggaaactatgcagagttacccaagtagaaaatgccaaaatcattctaagcatgctcccaatattatgctgctcaatcataatgaccctttgcttagcacaactccaaaccttctctattcaacaaggctcaaccatgaacaccaggatcgccaagcattttaacatcccacctgcatctataccaatcatcccagttgccttcttaattgttttcgtccctttctatgatcgcgtttgtgttccttttctacgtaaattcaccggtactcccaccggcattacacacttgcaacgcataggagtaggcctaatactctcttccatctccatggaagttgcagcaatcatagaggtcaaaagaaaaggagttgctagagacaacaacatgcttgattccttgccagtattacagccattgccaattagtatatcctggatttcttttcagtattttgtatttggcatagctgacatgtttacctacgtggggcttcttgagtttttctattcagaggcaccaaaaagccttaaatccacagcaacatgctttctctggtgtgctatggcccttggctattttctaagttccataatggtgacaattgtgaatagtgcaaccaagaatattactgcaagtggaggttggttagaagggaacaatatcaacagaaaccatctgaacttgttctacttactcctttccatattgagcttgatcaacttctttgtctatttgttcgtttcaaagaggtacaactacaggcctcaacaccctacagttactggtggcaattcagatcgaggaagtgaatattgggagataaaggtttagcttaatatgattaatatggaacagtgaagatttagtgggtacgttgtacttttcttcgtttgtcaaaaatgtatgtgagtaaatagatagaggactgcacctttaattattttccttgtaatgtcttgagttaattagagctatagtttccaagaaatccatgtgaagtttttattttacctctgcctttggttacatttgatttctattttcacttttgctagaaatttttaaaattcattaaaagttgtattttaaaaccaataataattgtacaattaaatataaaatagttattttgaaaatcaatacattagaatttaataagattaacttatcctaaatagaaaaggactcatatatctaattaatgtcttaaagatttttttggattaatatgtagtgtaaagttcatttgtataggttatgtgtgatttattaatgaagatctccctaatgttttatccattgttttcctaaaatcttttttttttttttgacaaaacctaacatctatttgatcataattttgatccatgattaattgattaaagcttattaacctatttttaaggtttaaatatagttattaattcctcaattttttttgaaaagttactttttattcaattgattcacggtttcataatttataatgatttttaatcaccaaaatttatttttaaaattttttaaaaataattttgacaattttaaaccgacaaaatatttaactctatgatttgatggtcattgtttacacattgtgttagttttgaagaaaaagatagatataaaattgtcataatttttaacaaattaagagtgttttaaactatcataaatcattttaaaaaattatgacagtgacaaattgtgaggtattcaaatagaacttcagttttgcaatattagagtattataattatgacagcgacaagttccggagggagaacggaaagagactttttggaatgaccgaagcaaaaacagaagcggctatatatgcagaatcccttcatcgtgcaagcaaaagatattgcttcgtctgagccaagtaaaccagtactgttacacaagaaatgatagttgaaacttgaaagtactgaaaaacctaaatgtgtatcaataatatgatgccaaaataaaaacatcatctaaataccaaggatcagacaaaagggcaaataacatgttgcaccccaatggtcagctttgttcataataataaataaataaataacaacttttcaagtcagtaagtagaacatctaatttaaaagctaaaacacgtaaaaaaattctataggcgttagggttcacaactgtacagaaaatcatacaaagtgtcgtgagagcagcaaaggaaccaaaagcttagaagattttatttccgtgttttttgaccgaattgaccttagaagtagagacgggatattttcagtcgctgatgaacaaatatttgtcaattgcaatttgagtagttctttcattaaatagttctaacagattttattttatttaaaattttgtttgattgtgaggtattaaaatagaacttcagttttgcaatattatagtattgtaattctgcatatgaataagttttggccataacatatttatttttcattattgtatcccctgtatcattcttacttgcaattagcacatttaagggttcaactcttattataactcaccaattttgaatgttcaacataatttgtccgactaattaaaaaagatataatttatccgtacattacacggaaaatcgtattaatttatcttaaatttatattttttttccaaattatcatgataattaatgttcctttttcttttttaattgcttgacaacacattctctcttattttaattagcaatattctattataaaaataattaatataagaaatattataaattaaatcttataaaaataaacattattttaaatttagatcttctaaataaaaatataagtatttaaaaatattgtgtataaataaagtatacaagttgttatttgattatctttaattgatggtcaagaggattctcttggttaaaaaagacacatatttgatggtaaattttaaattgggatcttagaccactttttgatggatcagtgagaagctttttgttcgagttgactgtgtgattgtggttttatttatgacaacaggaaattttttcctattagatcactttttgatggaccccatagcgccacttagtattgaaaatcttttaagataatgagatcttaaataattttaatgagtctcacatggactccactttaaatatttaaaaatttattaaattaattaaataattaattttaattaataaaatatgaaaaaaaatataaatattaataaaatatgtaattaattttaacttttaattttattttatttatttttttcttcttttggtcctatcatataaaaaaatcatttttttttaatttcatgcatatcttcaatgtttttgtgaagatctggatctatggatctatacgtgaagatcttattttcttctttagggtaatctcccaaagttgctcttattgtaaactctctcccattatcgtcagttctgatgaattaaaaaatctttaattgatcatggtatattgacgtcttaagtgaggagtgggagagaatagagtatatacccggaatatgccttatgccacatcacatggttcgatccaagcataactaaccaacacagtcgattccaaatcctaatcctaatcctaatcaatctggttccagtttgagttgcgattatggcaagccaggcggtgtattcggtgtgggcgattccaccggaagacgtgggcgccagatgcgccaacctcatgaccgccctccgatccgagttcggtgggccccacttccacccccatatcaccgtcgtcggagccatcaaactcaccccggaagacgccgtgaccaagctccgatcggcgtgccaagccctgaggcccttccacgtcaccgtggaccgcgtggccgccggcagcttcttctaccagtgcgtgtatctcctactccgccccgagcctcacctcctcgaaaccagcgcacattgctgcacccacttcggttacaccaattccactcgttagtgactttctctttctttaattaattattcttcgttttcgaaagaaactttagttcgcgaatgttgatgattgattcctttgcagcttacatgccacacttgagtcttctatacggagatttgagcgatgaagagaagcggaaggcgcaagagagggctaatgctatcgatgacacgctcgctggcttgacctttcagattacgcgccttgccttatacaaaacggacactgaggacaaaacgctcaaatcttgggagaaaattgctgaatgcactctcactccaaattagtagcttcttaacttcaatattagcaaaatccacaactctgataaagtttttggttttctacactctctagctgtcttcttagtctttctgagtgctactgctatgtgcttactgcttaccaatttccaaactcatatacataatgatgtcaaataataaggcactagtacttcttgttgtttctactttttttaggcccataattatgaaggcattattaatctgcataagttttgctgtgggtaaaagattgttagacacccttggaatgtagacatcaacatagcgattggaagagagaagagatgagtaattgttatgattagtgatgtgatttgataagaagtattaaagggtagtgccaatcagtggcgaatccagaaaaaattatttatgtcggcacgcacacttagtggcaagagtttgaggtgtctctgaaattttttttttaaataaaatttaattaggtccagaatgggtagtaaatgatccgcattatggtaaaacacaaaacgaaaagaacaaatgcaatgctagctattgtttccaggatccatgaattttgcaatttcattaacaaggttacggaaaagattcaaaggaatgtggtcacggcctcagaggaccaaggtcatggttcatgcattttggaatttaaaaaagtacccaatatgtataaaaatctcataatagaatttgcaaattgagtatttgcaaattttcagcgtccaaatgactattttgttgtaacaacactattgacaattagaattatggcagttacatacatacagtaagttttgttgtggcaagagaaatgcttgcaacaaaatctcttgtactctagtttcaacctagtattttctaatggctcaaattcatgtaagtctcattaaatatatacatctcatttctcatttggtaggtctcatcctcaagctaatcacactaagttataacaatatacgtgcatactgcagctctgtacagttgtgtaatcaaatattgttatactagtttgattatatatatgccaagagccttaatacaagtagcaacactaggtctctttaggtattgcttcatgcaccaaagccgcttttgcttcactagagctttctttatccttaaaataccccaaggagggcagggctaatagaagagtaaaaggtttccatgagatatatttgtttgaaaaaaaaataaacaaaactattagacctgtattataccagaagtctccgttgtggaaggtggtagtatggattagataaagatgttgtcacagcggaacaacagagcagttgcaatgatgttggatggggcaaagctccatgtggttcaatcaggtttatggttcctaaaataacctcaccagtccattaaaaccaggatgccatgaataagaactgtacactgtttcttatgcacgagccgaagcaaaaaagaaaaaagaaaaaaaaaaactgttaatctcaaagaacagaatatatattctttttaagtacttaatcaacacttaccatgttttttcatctcttttctcttatcacatcatataacctataatacttatatatattttttttctcttttttttttctctctctccctaggtgtcatataacatattgaatgtttatagattattttccaatctcagaatatcccatttggcatatggcgacaattcttgtttctgttttgtttatatatctgtcgagttctaaatataaccaatcttctataaagtttaaactaatttgacataaaacattttttagatatttcttccttttttttctttgaccaattaatttaaatatcaacagaatcttcaaaattcaattcgtcaatcacgtggggtgtagcagtgtggcacgttacttgaactgtcattattgtgatgattaacacaatcgataatttcgttatccccacatctttcatatacaaaaaaaatgacaacatgatgattaataactgcggctaccgtaatttaaactctttattagttaactgctaaaccaagcccaaatgcccaatcactgaaatcaacattgatgacttatgtagacctaaaacagcatagttagcaaacggacagtaagaagggaataaatggttaaacagatcaaacttatattagtagtacaattttccatatcaccaaaagaaaaagtagtaaaattttccaattaaaatcaatattacatctggtttcacgcttccatttttggttactagatgaaattagcaattactaagatgacataataattttgattggagaaccactataataatacttaatgggtactattactacatttaaaatttgtactaattaatcaattctaccgtatgaactataattgcggagtgttggggtgttggtggtgctttctcggcttttttacacaaatgagtaaatttaaaataaaaaaaacactgtagattttgaaaatattacgggtatgagcaagtcgtgttttaaaacactatttcatctagagaaagacgtattttaaaataagactttaaaaactcactttttttaaaataaaaaaataatgaaatcacgttaacaactttagtattttttttcttttttaaatattgaagttgtttattaaatcacaaatttaatctttttttttcttttttctttcttttaaaaaatattgaagtcgattgttaaatcatgactttagttttttttttctttttttttttttaatttgaaatatgtaagtggtgtttattttttatgccataggtattggtgttgtgtatggaatatattatgcgtataattgtatattatttttattatttataagtgtgataattatttaatgagtatatttaatttgttgaaatattaattattttttaaaatagtagtaatataaaaatagaaaattagtcatagaaatgtaataaaaattaacatgaaatatattataaatacatggaaaataaaataattattgggaggatgtcccatatgttagtcttttcatcaattgttgttgacttaatatttcaaatataaaaaaaataaaaagaaagactaaagtcatgataacaaataatttcaatattataaacttttttttactaaagtcatgatttaacaaacgactttaatattttttttaaaaaaaaagactaaattcatgattataatcacgacttttatattttttaaaaataaaataatacttgaaatcatcttttaaaatacgattttagtatttttttaattcaattttctaagattgtattttaaaacatgactttctttatataaaatcatattttaaaatacgacttataatattttcaaaatttatcattcctgtaattttttaaaaataaattaccgatttatgtaaaaaaaagcctgctttctcggtgtccatggaccatggctaatatataaggggtggaacttaatacaccagcaaaaaggctaatacacccagactttttttaaaatggcaattctacccttcgttggttataacaaaagctgaggaccttctcttgctgccattaacgagttgaagcttccgttgagtgcattgtgagtgggaggtgttggttgtggtcgtttaagctggtggtggttgcctttgacgctgttgggttggtcggagtgacagacggtggtggagcaactgtcggtgaaggtaagttgcgtttttttgcatttacggattagctaatccgtataagatctacggattagtaaatccgcacatattgtaggctttgtgtgatccgtatggaccatacggattgtatgatccgtatggaccatacggattgattaatccgtacgattaatacggattgatcaatccgtatggtccatacggatcatacaatccgtatggtatgtacggattgatcaatccgtattattaatacggattgatcaatccgtatatgccatacggattgtatgatccgtatgttgaaaaaaatggaaattaattattaaaatgtgattttaattattaaaaattgtgttcttaatctacgatatctgttcgtgttgtgatttatgtcagtttgttgtcatttgtgaagatgaacgacgatgagtggatgtatgatgctataatgtccgaagaaattgacatgaatgaagatatcggagataaaccgagtgcatttgaaaaagctgattgttcagtcgattgctctgcagcattcaatacttgtgaggtatgtctattatttataaatttgttactgtttattaacaagtgatttatggaacttaatcgtcattattattgatttgtgtaggtgtttacttctcgtgatgaactattaaaatgggctagaagggttgcgtatgagaatggttttgtagccgtgataatgaggtcggacatacatactggaaagaagggaagaacttcatttgttttgattggttgtgagagaagtggaaagtatagagcgttcaataaaaacatggtgcccacagtgactagcacgagaaaatgcaattgtccgtttagattgaaagcgaaaccagtaccggaaggtgaagggtggatggtgaaattattatgtggcactcataatcatggtttggcaaactcattatgtggacatccgtatgctggtcgactgacagaggaagagaaggttgtagtgcatgatatgacacgatcgatggtgaagcctaagaatattctccttactttgaaagagcataatccgaataattgtacatccttgaagcaagtaatgaatgcacgatatacatatcgtacccgtatcagagaaggtaatagtgaattgcaacacttgatgaagcttctaggacgagatatgtacattcattggcatagagtgaaggatgaaaatgtcattcgtgacctgttttggacccatccagatgcagtgaagttgacaaatgcatataatgttgttttcctggtagacagcacatacaaaacaaacaggtacagacttccgttattggacattgttggtgtcatcctactggcatcacgttctcagctgcgtttgctttattagaagctgaacgtgtagacaatgttgtttgggccctagaacgttttagaggcatgtttattaaaactgaatttttcccaaaagtcattgtcactgatagagatttagcattgatgagtgcaattacaactgtgttccctatgtctaccaatttactttgtcggttccacattggaaaaaatgtgaaggcaaaatgtaaaacttttatccgacagagtaacgcatgggactatgtgatggaagcctgggaaagtcttgtggactgtggtaatgagaatgaatttggtgattgtatggcaaagtttgacattgcgtgttctccatggcctgcgtttgttgattacgtgaaaaccacatggctcaatccacacaaagaaaaatttgttacagcgtggaccaaacaatttatgcatttgggtaacacaacaactaacaggttagcaaatctttaagttttgtaaagttattgcttttatattgtggttgtaggggatagtttgtgactgttaccattggattgcagggtcgagtcagcacattcgacattaaagaggctattgcagaatagcctaggcgacctctgtagtgtatgggatgcaatgcacaacatgctgaccttgcaacatactgagattagggcatcattggagagaagcacacatgtggtgggtcatgtgtttaaagtaacactgtataaacgactgattggaatggtgtccaggtatgctttaaaccaattagctgctgagtatgagcgagtaccttacgcaggcaaaagcaaaaaacgttgtggatgtgttatgagaactacgcatggactgccttgtgcatgtgagctagctaagtatgttcttgggtccatacctattgatgctgttgatttgttttggcggaggttaagttttgaagatcaaggtgtggatgagggccaggtggacataagtggagagatggaagccatatctatgcgttttaataaccttgatttttgtgggaaggtcactttaaagtcaaaacttagagaaattgcatatcctgacaaaaactcaatgcgtcctccgcctgaaaaagtgaaaacaaaaggtgcgcaaaagagacaagtttcgcaacacgcgaggtcaaccaagcgggatccatcttactgggagcatgtggacgaattacattctgttcagaatagttgttcgacaccaaaacatcctgcaacatcttcggctgatgacagccatacaaagacgaggcctccgatgctggatcagtttcatacattcatgcatgatttcattgtggacattattgatgttaaagctgatggtaactgtggatttcgtgttattgcggctttactaggttacggtgaagagtcatggtctctggttcgcaatcatttgcttaaagaactttcacaatggtctggtgaatacatagcattgtttggtggctttgacagatttgagcaattgaaacggtccctacttgttgatgggttgtcaaaggtaactactatgttactatgtttgtacgtatacgttaacctaacttattatatttacagttaagtggttttcatgtcaggttacaattgataagtggatggatatcaccgatctggggtacgtcattgcatcacggtataaccttgttcttgtttctctgtctctcaaacaaagcatgacgttctttcctttaagaagccaaccacctgcagatgtcaatgttcatcgggtaatttgtattggacatgtgtttggaaatcattttgttcaggtataagttgttgaacgtagtttatcgccaaaagactcttaacaaatataataataaataagtttatgatggttattgtttcaggttgcattgaaagctggatgtcctattccgccacctgcgttgttatggtcaaggaattgttacaatgttgcaaatcaatggatagttccttaccaatatagaatagaagcttatagacaacttcagcatatccgtacggattatgttgacttacgactttagttaatattgtaatattgaagttgatattgttgacaaattatgaatcttgtttaatgatgtacttggatggtattgttgacaaattataagcgtgttttcatgacaagcgataactcaaaagaaacataatattataatgttaagtgaacaacaatgtcgaagtacatgaagtacaatgtccaactaaaataaagttcacatatggtgaagtacaataacaagtacgataaatataataataaataaaatgcatccaaaagcatctctactgctgcctctgcctggtccgtctctgtcgctgatagacacatcgttcatcggtcacggaacgagatatacgtagtaggcgctcagtagcggcataggcatcagtcccacgtgtaaccatgcgtaggtctatcatctcctgtaagccgcgcgctatcctatcgaatgtagcctgaacaaatgtcaaaataataacggttaccattctaacagtacatatatttcaaaacaaacatttcaacaatgctgcacataccaatgcatggcgaggtacgtcggatataggtggatctgcctctgggtcatcagtagcagcatgcggagggtcctcaacaatgtgtgactctggtgccgggtgcctaacaggatcaccaacctcaacgggtctcatatatggatgcgatacgcggaaaaaccagtccatgtaacccaccactgtctgactagcatgacaggcaacctcagtggtggatgctaagtgatccccaaactgtatccatgcctcgtcaatctcatctgtggatggcacgtctactaagtgcatgtctggaatatcctgaacatacccgtactgcctcaggaccctgcccggaagatgtctgacaatgaccggtccgcagcgaatatgaccagagaagagggaaatgatgtcgaagtctctatgtggacgatgatcgacataaggagtccaacaaacatcctccatgaccaacctatctagtcgtctacgataggtggtcataggtaatgcctgggcaggcttccaccgacaggctcgtggttgggactcctgataatcctgaacagcagtgacatttcccacagtggggaaatgttcatagatccaacactagaagccaacataccaacattagtttgttatcagcagaagcagaaaacataactacatatattaaacacaatgacaacagtcaaaccattacctgaagtaaggtgatataaccagcaagatgcttgccgtggtgctgacatgcataactgaggttagcatacatgtgaacaagtgctgccacaccccaagcatatcctcctgcgtcctctaaatcacgaaaggcctccaagaacaccacactgatatgtgtagcgctcttgttggcaaacagcgtgcacccaacaagatgaagtaagtaggctctggctgctacaatccagctcctctcctcgcacttcactgcatagatgtctcgcagccaagacaaacgcacatatgccccatggcattgctgcatctcagctccagcatcttcaggggtgacgttcaacaagtcaacaagcaagtgaacgccctgtccaacgtcgatcgtgtcgtacgacaacaaatgtccctcaatggggatatgcaacagcgacgccacgtcatccaaggtgatactcagctcccccacaggtagatgaaagctgctcgtctcagggtgccacctctccacaaaagccgacagcaaacccctgtcacctgtctcgactgagcatgcaatcaacggggctaagccggtaccagccaccagtccttctatctcgagtgcaggccgcccaaatttatgaacctttcttccgtgggatgccaatttcaactcaggacgttcctacaatcattttacatcactgtcagtcttgtacttcaaaaatcaaaccaaatacaataataaaataagtacctgtccttcccacactcgcagagcgacgtgatcagcatactgtgtcaaaactgacgtgtcctgtggaccacctggataaccttcgaattcatcacctcccccctctgtggaagggatatcaggctccacatgttggtcctcaagaccaccaccgtcatccaaaccagcccccaaatgcaagtctcgagccggagggtcaacaacagctgccggagggtcaacaacagctgcccctggcctttgtcttctgacagatgccgtgggcctacgacgctgaggggctgcatcttcattcccactgttctctctaccagatcctctgtctacaccacgacctaaggcccgatgtcctcctcgtgttctagccataatctggtatacaacaataacaatatggaattcagctctcagtcaaatacaaagatatcaaatataatgggtgataacaatatcatcaccattaagctgtaaaaacacaatcaacaaaacaacgacaaagccaaccatcatcacaaccacttcattgatgaaatcatctatataattaccaaagccaaccatataaggcacagctaataacaatattatcacacataggttggtcaaacgataatgaacacacaaaccaatcacagacctaaccatcatcaccactaccaaaggcaacacaaccatcatgaccattaaccaaaatacgatcattcatgcaccatttactctcctatctaactcccttcccatgatatacttgtgatcatcactaccaaaggcaactaaagtgatatactagcataacaccaataaggcacaactaataattcatgcaaccatgttgaccactaccaaaacatattgcctttatatatgctacacatacaataagaatgtgccttttgtgcagtccatgttttcatattgaatataatgtatgggccacaattcaaatttctatcaatcccacaatgactattaacatcaatactacaacgtgtaatcatctaatctaagtcaaataagtttcctagcaactcaaatatgtacaataaccaataaaagacacttcacttaatcataaaatcacagataatacaattctaacactgcacggatcagttaatccgtatcaggaatacggattagccaatccgtgaaattcatacggatcagttaatccgtaaacacttcacggattggctaatccgtatgcctgatacggattaactaatccgtacagtgtttacggattagacaatccgtgaagttcatacggattaactgatccttatgaacttcacggattgcctaatccgtaaacactgtacggattagttaatccgtatcaggcaaacggattagccaatccgtgcgatacccaacagtccccgatagttgctacatacctcgcgcggcggccggaacagataaccacctccctcagtcgacgaacaaccaccaatgtaggcttacacgcgtcggaactgatgaaaccaatgacgagcacagccaacctcaacgaaatcgcaacagagcagggtgtatgcgcagaatccgtaaagccttcaatggtaacagtggtaatgaagggtttaacactagggacatttaaggaaattcactgtgcattttaaaaaaagtctgggtgtattagcctttttgctggtgtattaagttccacccatatataagtaacatgtgcttgatatgtaacggcctttcaatgctatgtttaacatgttttgtgccacaatgagtgatgaggtacaatccatgaatagaccaaactgtacccactaggcaatttcacttgctatgtccaatcaagtgaaatatgtgggagctgcatgcctagttggggcgtggatggatggtaaactcaggttgggataagctaccttctgtaacaatgcacaaaaaaggaattaaatcaaatagccaagatcaaatcaactattgttagaaatgactccatttgtcgtatcactcgattttagcacacaaaattattcttccattgaataaaattaggatgaaacaatccatcctaatcaacgttcaggaattaacgctgtgttcgatttgcaagacagaaataagagacaaacaacggtaatggggactgagtttggttggcatgattttggagagagagtaaagttataatttgtggggtttatagcttaaaatttccgtctttggaataggggtagcactaagtgggagtttaaaattttcggtaaaaagataatagtaacctttaaaaatcaattgtttatgcaaaaaaaaataaatagattttcttttttggctatcatacccatatgtgataaaatgggatatccgacccaattccggtctaatgtgagatatgggctataatgggtcgaacaaaaaaaatttgaatttaatttaagcttaaataacgaaacttaagttttgtgaaaggctgatttttgtggactcagcctgcattaaactatgattgatttgatataaaatttacatttaatttgaactaaaaaaattaaactcaaattctagattttagaagatggatttggacggctagcccaatccatttttgtcacctttactcatccctactcatataaacacaataatatttttgtctctatttaattctttctttcccatatatatcaaactcctttacaatattatttttactctatttctcacatatttttcttaaaccagactaccaaacatatatcttcatttctctttttttttttttaaattatctattttctattttcatcaattatatttctctcttctaaatcaaatacaacctaagagatgaaattgtattgtaaaccattacagtactgtttcgcacatagataatcaaattgaaattatctactaacatttatgtctagcataaaaaacattcatatttgtttatatgagacgaatatacattcttgaaaataaggtttgatttattttagattttaacaacaaacgatgttgttgctcataaagaagaagaaaattgttaattttacgagactttttaaaaattctttgagattttaaatatggatagtaattgtcattctgcataagcttatcaaggtatgttaaaatacaaaactaaaattggagcatgcatataaaataaagtatgaaacaaaaaaatgaaaatgaaaattttaattttaattaaataaattgaaagtgtaatatctaatcataaattatgctataattaagaattattaattttataataactactataaaagtcttatttaaaaatgagtttttattagttaacggtgtattataactaaattatttaaaattttaaatatgtataataattgtcgttgtgtaaaaacttgtcaaaatatgtttattttatacaataacaagaatatgaggattaaatcctcagctatttatcctaaccctcgtcactaacccagtggattactttacttatcaaagtatgttaaggataaaaaaaaaatgattttacttagatcatgcaaataatatcagtataatgaataagggtgacctacattacttgtcagcaaacaagaagcagcagaagaaggaggtgagtagatgaattaaatcaggttgtcacattcacatggcagttgcattgccttcaacttttgggtcaccgcatagaggtacaatgtgctgtcaatgacaatgaggacgaaagatgtccaacagtataactaatacaaattccaagattaaacatacatatttaaagagaggtttaatatggtagtcattgtaaatattagtagaagatagaaccttcaaaaaggactaaaagaatgaaaccgcgttgttcatgattgtcagtttgttagaaaagttaatacgatacttggaattaagaatgagaattgtttgaagcccttgtatgtagaatacccaaaatggaaaatttggaacatgatgcattaaatatgtgtagaagttaaaggaaatttatacttggaagaacacgcctattttcattttctatctttttttcccactctaatttgtaattataaaaaacgccttatttttcttttgttccctatttttaaaaccttatataattgtttctcataatttattttaaaaacaaaaaattaatatttttgtaactaattacattaatggtataaatcgcaactatgtatccagaattcaaactctagagttttgattatgttgaataatttcaggttaattaataattgttcaaaaggtttatttcacaattgtaaataatgttaaataaaacaaaagtaaaaaaaaaaatttagagaataataattgtgtatatttttttcaataggaatagtttatttataggtataaaatataattaagaaaattacaaaagataaatatatataaataaattaaagaaaaattataaaataatgaaatatatggacaatcacaaataaattattcataacactaatcaatataaatataacaataaatatcataaataattatctttgtttcctattttaaaattattaattaatatgtatataattatttagattgcatatactcaaaaatcatttgtaatattctaataatatttaacaaatggaattacctgaacatatattaacaaataaaatattaacaataacatattacattatcttaccagaattagatacacatataaaaataatataggcaagaataatcatgttaggatatcacataaaaattgagataaactaatatacacaaattgagattttaataaatagtaaaatgtcgcattcttcaagaatgaaaatttccttttttttcttgcactatttttccatttctagtgagaaagaatcaatcttttctattctcattcttcaagaattaattttttttccttttttattttttgtattgtttttccacttctagtggagagaaaaaaatcttcaatttttattttattttataaggtcttcaagactttttacaaaaatatttttagaatttctttatttaatagtgctttcaagacacattatgtctgaataaatttcatatttatgtaaataatataactatacacattatagttataaataatatgagttgggagatgagaatagtgttaccttgaaatgtgaattaaaaagaatatgacattctctaggataagatcaaattataataaaattcataggcctcaaccattgcaacattatttttctcacatggagtgagatcattattttttattttcacttttacattattttctcatttcggatgagaataatatcctaaaaaattccttcttgatagtatctttaagactctcaaatgatcaaattcacaattgcttaaatagaacccaaatattataccaaactcatagtatgaataacaaaattagagagagaaaaaatctagccttgaaatatgagtctaaaagaacaattttctccaatttttacatgattttttcttataagttacaataccaattgtcaataacccatggaagaaagacaatcatgtaaataaggtgttaaataaaatataattcaaataagagaaaaataaagaagaagcgaacacaagagtttaaagataatgatatatatatatatatatattctttctaataggagtaacatatttataagtacaaaaataattgaaaaattacataagataaatataaataaggaaagattataaaagacaatgaaagatatgaagaatcacaaatagattattcataacaaataatttattaaactttttttataaaaaaattcatttgacattgtgaaaaaaaacttttatacttacgtagtaaattaagacactagatatcaattaacaacatactatattattctttactttagatttttttttttaaaattaaactgaattttaagaggaaaaacaatgtttacacaacatactcattagttatggacaaggttaaattttttaaaaaactgtctgcaacaacaattacaatggccacatcaaaaattgagtcatatttgttcacaattttcacaatatcaagaaataatggccacaaaaccaccaccacaatttaaaacctcacacaagatacacgagagaaaagaggttccactgactgaatcatttcatggaatatctcttgttctaagtttccaacttcgctccacgtgtctttcaccccattaataattgtttccagatctctctctcatgccctacttccctcactagctagtgcatgaatttcttaaaagtaaaaaaaaaaaaatgttaacaaaattaaattaatttgattcacctcaagtgattcaataaataaaaacaaaagaaacaaagaaaagtgaataaaatatacacagatgcagatgagtgtgtgtatacatacacaatttgtttcatatatgcataaaccattatggaagaaagactgtttttcactttataaatacccatttttggtcactttgcttgcattttctgatatcttctgcctgatctgctaagtggacaaaagtgagaaaaatatatgcacactattcttctaagggctggaacttgctctcctgtcctgaatataacttctccattttgtttgctcaacaggttggtggagcaaaatactgaagcatcatctaaaatgccttctgaatggttcacctctttttggggtaaatttttcccttgaatccaagattttgcaacacatgaactagattgcaatttgcaaactagccattacaagcaaatgaaactttttgaagctaaatatatataaatagctaatgatttaaatgttggactaagttcttgaggggtgaagaggttgttccaagctttcattttcttctacatttcttttcagattcttccccaacctgacaaaaatagctgaaagatcaaaatttacttatgtgttttgtcaagaaatactttttgtgtgtgtgtgtgtgtgtgtgtgtgtgtgtgtgtttatacgaggacaataaaatgataagatcttctacttgattcagcttgattaagtccttgagggatattccaagcttccatttcctcttctttccttttcagattcttcacctgacaaaaatagctgaaagatcaaaatttacttatgtgttttgtcaagatatactttgtgtgtgtgtttatatgaggacaataaaatgatgtgatctttttacttgattcagcttaaaaacatggctcttccaaaccaatccatgtcatcagagtctccccagagaaagatgggaaggggtaagattgagatcaagaggattgagaacaccaccagtcgacaagttaccttctgcaagcgcagaaatggcttgctcaagaaggcatatgagttatctgtgctttgtgatgcagaggttgctctaattgtcttttcaaaccgtggccgcctctatgaatatgctaataacaggtacctgcttttcttcaatctcttcataaatattttgggaacattgaatttatataattttgctcatgcaaaaaaatcttctgaaggagttaagcacaaagagcctaattacttttgtgatgcagttagaatatggagttaatttttcctctttgttttctgtaatcacggttcccttgtctttttttttttttttttttttttgtctttaacactcatcaagaattgtttcttctattttggcctttttccttctatgagcttttaagctcattctcctcttttttcttcttctgtttatgaaaattattttcttagttcttgatttggtgggcacatagatctggtgtaccatatagacatagaagcactatggttgttaactagtagcaagaggaaaggatttggggatgttatgaaggtctgtgagatcagccaatccctagaactcataaactttctgtttcctttttcctctttcccttctctctctttctttactcatctaaaagctaaagctgtcatctttccattagcccaatttccttagtaacaaagccagttgattagacaaaaaagaaaaagaatgacagtacactttcaacaaattgtcaatgactgaatgagttaaactggaataaagaaacgagtaaaaaaaaataaaaatggatttttgtaacccatcacaacaagatcttctcagaaacattgacatttaaaaaaatcaaagtacactttcaacaaattgtcaatgactcaatgtgttaaactggcataaagaaacgagttaaaaaaaaataaaaatggctttttgtaacctatcacaataaattcttctcagaaacattgacatttgacacccacttgcaagatctcgcactgggttaaaaataaccttagaaattagggttttattagggactaatacatgagctgagcatagctaattagcaaagggagaagaaaaaagaaagaaaccgttttctcttctcagcatgaccagaaaatagtcaaagttaatctcttaatatttattgctcgttgattttccccattttaggaaatggagtttggcaactatggttagggctttaaggaaaataaagggtggctctagactaggattttcttttttgtcttggttggaagaatctttgaacacgtcacacgtgatttttcagttcttgacttttgaaaaaagagtttaaccaagtcatactcggaagatggaattggtatctctttaactcttgcatctgaaccctaaagttggatcttctacaacacccctcctatgggaaactctctcttcagcatagagtaaaaaaattcttttacatagtttggaaaacagcaaaagacaatgaaagagagtcatgaaacaatgagggtccaaaacgctgcatcatcataatttcactggtagcttttggagcctctgcatttgctcaagatcttgaactttacatatttgtgaaagttgtagtctgagaaagaaaaataagggttttttaagctgaatgagagagagagagagagagaggtaaatggggggcagggagccaatgagagagttctgagcattttggcttcttccatgcaaaggaaagtgtacaactactgcttttgcttgctgaaaatttgcagtagctgaaatgaacggctgtgatgtacacatactttaacacagaaaagactatttttttaaacaatatatggtatcagattcagtaaatgtgacttaaaaatcttgcacgaaatttagatggttagaaatcgaggtgagcaatgaggtgtggttgagagcattatccactgtgagatgcgtttccttgaagtggcagagaaaaaaataggtctagaaatggttgaaccaatcatattgtgggaacctgtgccaccgtggcagcagcagccaatcagtggctcgaggatattaaggtatcagttcattgcaatactgaaaaggttttcttcttttcttttcctttttcatccctaattttctattattattattatggaaactaaatcattttgttattttaagattttatttttatcacatctaatcagactttgactccagtcgaggtttctgaataatgagatcatgtgatgtttattacttttgtgaatttagttgcgtttgaggttcggttaactgaaccagttggatgatttgacattaatttcaaccttggacaagctctatggttaacctcaaattaatatggaacacagttgttcctttttaatttcttttatttttgtttctttttatttacgcacaaagtaagaaaccgagttaacttgaaagattcggatgaagacgttctagagactgaaatcaaatgtatcccttagagttagtgataaaatgataatactgattttaaaattagttgtttgcatttatagaatttaaagttattaatcagttgtgaatttctagaatttactaactacatttttattactagttatttacactttattattctattgcactataaactgtagaagatatgaatcctattaataaagctgacagcttcacgaaagagataaaataaacgaataaaggaatataaattcaaaagatgtgatatatataataattcattaataaagtttagcttatattataactttcattaataatgttatcctagtaatttatacactcaaaccaagagataaatgtagtttatgtgacaatattcctctttctcttcaaccgtgcaaggaaaattttcagatttccaattactaattaccctcaacagggttaaggatacaagattaaaaaaaaaaaaactggattgggtttatgcactttagaaggtaaagtgcacaaatcctaatcattcatattagtaaatgatttagataaacacaccttaattaaaattgccacatcaaatttttctttaacgaaataaaacttattaaattaaaatagaaaataaaaaaattattttggcttgcttcacctaatcatcttcattggttacacagaagaaaagcctccgatacaattgttacaaattgttcttcttaatctgcagctttatcttaaaatttcttactactcttaattggaattttttcttccaaccacttatccagcaatgtagaagccaataacggaagaaggaaaaaataaatcatttgcctaagagccaagtagcaaccagaaattagtagctatcaagaaaagaattagtacgagcctaaatagtggcccctctgtccagaagatgtccagcatgacctcattggtcgatgcaactagttttttttttttttttttttttcattttgtgataagcacatatggaatcaattgagagagagagaaatcacgttgaagacatggaggaaaaaaaattcagataaagcaagatttagaataacaatgccgcaacaattgtttttagggtttttgttcttttgtatatcatgaagatgatcaagtgaagcacacgagaatattttctatttttgtttaatgataaaaaatctatacggcaattttaagcaattttaattgaggtgtatcaatctaaatcatttattaatatgaatggttaggatttgtgcattttatcctctaaagtgcaacatgcactttagaggagtccaaccggggctagtcataactaaagctagtgcactgtttgatttagctaagattctcaaaaaatccttttataatcaattaagttgcaggggttaataataatcacaaggaacctaaagcctttaacataactatcctagttaggatgattacaaattttgtaagactaaggcagcctacaagttattaagattaaatatttgtttatcattcagaacttttttattttccaaaaaaatttgttactggagaaggagattgaatgctataccggaaatttggtcgtcaatcatgttctttgacttttgggttatgcttatataatcttgtaacaggacaacttgtgaatctatataaggtttttttataataagggtcatactcttgcagattattagataaaaaaataagtaattttctgtgcttatataatgttctttcacaataatcagaaaaagtcctttatcacttagatgatgccactgtcatatcacttagcacaatgaatataatttgtaaataatcttactgttattatagcgtcaaagcttcaattgagaggtacaagaaagcaagttcagattcatctactggtggacgatcagcttctgaggctaatgctcaggtattaattcattattccttctctacattttttcaagagaaactttatttgaaactaattaaacaatgatagatacattaagttaatatcatgcagaaaaggaatttgaatgtaattgcaatgaattataaactaacatttttaaccatgatttcaaatctcagttttacgagcaagaagctgccaaactgcgtgtgcaaataagcaatctgcagaatcacaataggcaagttgcattagtaaaaatttcactacaatatcgaagggaaaaaaaaaacatatgaagagatctcaagtattatttcaatatttagtaaaaatgttttgaatcgcagtcaaatgatgggtgagggtttgagcaacatgaatggcaaggatctcaaaaacctagagactaaattagaaaaaggaatcagcaaaattcgttccaagaaggtatttgtatttctagtaacaagaagtttctttctatgattttgaaagaataaagtatgcagatttactatgttgatctaattttatcctttcttcctttgtttgcatgtgctacttcccaaacacctacatcagaatgagctgctatttgcagaaattgagcacatgaagaagagggtaaatgttttccttgtattcttattttaatttctaaggtcatttttttttttttgcatttattatctaagtggcttccattacaatttaatcaagtttcttaagtttagcccaatggtctctagttaagatttcacaaatatctgtattagggctctacaattgtttttcatattctgtttaagtttcctcttggtcaaatttggagatttccaaagatggtagtgaggatatatagatcattccattgcatgagtactattcatgatagcttgagtagctcctagagcctaaagatgaatcatcttaaaaagatgccactcaataaggtctaaggcccccactcaataagatctagaaagaaaaatgaaaatttgtaaggattcaatcttgtgtataaaatataaatgtgaattgtagctgcaaatgttgtcacaaataaataaaacagaattagatcatataattattaatttgagtttggaattttttatttatacactttataatattatagactatagatatatttagtttaatttattttatactatttctacgcaaacatttttcaatattttcaagtagtttttcgagagaaaaaataaatttaatctgaatgttattaaacccctttaaataaataaaaacacaattgcgcaataaaatatcaattttaaagcaaatatgtgagacactgataactaaccatatcacaatattgtagacggtgcatgtaaagtttgacattttgtatatgatgaaactttggcttagactatatgttcatccttatccctaaataaatctatatataggtgcctataattttaatctgtgttttttttttggggagacggggtatacaaaatttcttctacagtgactttcaaagtatacatagtaactaatatgtacatttcacaggagatacacttgcacaatgacaaccagcttcttagagcaaaggtttgtcattctatcatcaatctacactctttataaatatatgacgtttgtattgtagtttcattatcaattttcttttttttgagtgtgtagatagcaggtgagaggagtcaccataatgttaacgggttgtctggaagcataagctatgaatcgatgcaatctcagtttgactctcgcggcttcttccaagtgactggattacaacctaataatcactatgtcggacaagacaacatgtcccttcaatatgtgtaagtttctcccttgctaggtttcacattcattctataacttgatatgtatttgtttttaattccttaatgttcaaatcactagttactacctattaacaaatctcataagagtcatcatagctttatatggtcatatcatagttccattgggaaagcagatatagaataaatgaagcaaatagttttatggatagatattaacttgtcctatgcataatatggtggaaaaaagggtaaaaaatgtgaagcacaagcccaaccaaggggtttagttgagtagtgttcgtctgagttcaatttctataaataaataaaaacacaaaaaaaaaaaattataacaaatgaatctttcaagatacaaagggacatgcttgtggacatagttgttcttcacacaaaagagtcaactacaattatgatttcagaaaatcccaatagtcatagcatgtcaattaaaaaaggtaataataggagaattgaacctctagtaaagatgattcgagaaagaaattgggatttgtataaatgaaggaaaaaaaacatatggctaaagaattgctttagttggctataaataaatgttttctcaacataaattgaaatttagtttcaataatagcttgagttagcacatatatacccgtaccatgacttgatttcgtaaaacaaagagaagagataatggggagtgaatgagtaaacaagtcctaatataaaatacaaaatatatacagaaccgaactaatttgcattgcaaaagttatgttttaatattcaagttattttgtccgttgacaggcatatttgtgtgtcccatggagacttgacttattgtatatttttaattaatgaacaaacataaatctaatgcttgttcttttatcttgtactctatcttgtgcagttgaagagtttaagcttaagaaggagaaagacttagatttcctattgtttgtatttgacgtctagtatgatatatagaaatgctaaagcctaggaagtatgcagaactcaatggagggaattcatttaagtattcccctcagtactatgttatgggctatttagtatgtatacatgtactctgagtacagagatttgcaccatgtcatattttgtcaacgtttgtatacttttcatatttctcctgtaataggcttctatatatgtctatttcatatttcacttactatgaattcaagatcttactcatacatgcacctgttcttgagtatgatttttttaggaagatcattgttatctgtgcaaagtatccaccacattttgaatatgattaatttaagatttaaatacattttagtctttgtcatttatcatttttttatttttttccttacaatttttttacttgttttgttttttagataattaacgcattaaacagtaaaaaaaatattatctaaaatgttataaaaacaaaaaataaaacaaacatttttgtagagactaaaaaaaattataagaacaaaatgcaaaaaaaataaattataagaactaaaaatatatttaagtacccaggctaatttccagcattgttaagcatatgcaagtgcatatcggcatccactgtaaattgcaatcttcgttgcttcaacatctacatactcagctctatgagaaagcttgaaaggaatgttgtgatcgacaaccataatgtttctttcctgttagtaaaaattgttccaagggcaaaagcattaacaaagtgagaaaataaaactggaaaaaaaaataaaagcactcaagtatctgcaatatcagtataatatgtattatgtgtatttgaatgctaattaatcaagtttgttagattaaaagttgatatatatatatatatatatatatatatatatatatatatgcgcaagggtaagtggttatggattcgagtccggaaacagtctttttgcatatggaagggtaaggttgcgtataatatccctcccccttatttgcgcataacatggatcctccggacaatagagtagtaatttttttatatatgcaaggataagactactacttataatatttctcctttttatctacgcgtaacgtggaacatacggataatgaagtatgtaatttatatatatatatatatatatattgtgggagagagagacgatctttgaactttttaaaatatataaaaacaatgacacgagctgatcaaaagggtcgtactgatatgcaagatggaaaggtggaatgttagacaagataaaagctcaaaatagacaagcagggtaagaagaatgattaaactcagtgagaagtgtcacatgaaaataagcgaattgagaaaggctactgtgagtgtgaccatcctacttagcttcactgcctgacaaagtcactttcctgatacagtagtaagcacttctctaacagcttgtttgagtattagagcctcacagaagtgttctaagcttcatgtggttatattcaaagcttataaataggattacaatcaattaaaacactgttgggcaagttgagaagccatagaacagttataaactgttttctgccactctgctcaaacaaactgagtagcatgaaacttttttcttgtgtagtgtatccctgctctgcagtaacttttgaccctttcctagagtgttttccagtgtagatatgatacacattcaacaacttatacaacaattcatgcaacattatttttttgcgtctatctctctccatcatcctatcatttatcatttattatatttcaaattcaatttttcctctctttttctctattggttgtacattttgttgtacaagtatcatttctcattgttttaattcagtctgtttgttgagctctatctttttttcactcttccattatttatttatacctttgacattgtgaccgttagggcaattgaatttcttaaaactcgttttcagactcagcttgatgattaaccaaatcatcactttagttaaattttttagaaggatactattttgcaggtgtttatttcaggtataattaggtttcaagtattgggttgctgtagcgaatacatctcattcttataggtctacaacctttatttatatcttaatcttggtgataaccggttataaccataaatccaaaaaactaacaattaacatttaccaaaaaaaaaacaataaatccaaaataaattaaacataattaatgcctatgcatgaataccactatatacaacaacagcacaaaaactaagaaagatactggatagttttcactttccttgagggtaagtggcccttggcaactctgatttctgtagattcttttttttttaaacttcaatttctgtgattagttagaaaagatctggaacaaattaactactattcaaactatcataaagaagttcttgatctgcaggaacaaaagtacaccaatacataatgacatgaaatagctatatataacaccacaatattgcaaatgaaattccaataattgattgcaattaatctccttcggctacaatatgattattataagttctagcaaaaatcaggtacatccttaaataaatatggttgtaagagtttccatcttcattttaacttaacaagatgacagatatccattgggtgcgccatggttggaatgggagcattataagcacttcttgcactgagttggttggccatctcagtaggatgaaatgcatcaaaaaatacgtgtaggtttctgttcttgcatggctcctcattagggatacactgcccattcggccccactttgcagcacataacagtttctgaaatccctacatggggccaccaacgaaagttaatatatttaataaacaacatatctatttgcttcaattttttaaaacgatatgatcataattgcattaacataatagtaaaaattgaagacatgcatgtgcatccttttggtcatagtttcaattatacaaattcaatttagccaatcttttgtggaaagtacaaagatacattatatatgcattttacaagctttctgctacgaggaaataacaaatacgttaaaaccattttagatgaataagtgtttgaatatatacaggcacagtaaattatacaaaatccatacttgctggtatatcatatacatcaattgaatcttagtactactataattttggctatgaaaagaagaagaaaaaaaaaattgttaccttgtaactttgaggcgtgtaatgagaccacagcactattaatgaagataaatttggcatcaggtaattctttattgaaacgatcaactactggtttaagcttatcattaaaaatgagtgctgctgtattttcctcgtcaacacatattgacccatttttcccatgaatagagatttcatgcggaatgcagcctataagccccaggcctatcaaaacaaacttccttgccccaagtgcgtgcaaatcctgcacatagaaacaacaaaagtagataacaaaccattaatttggtgcatcatgtatattataaatgttacttatattacgtctgatcctttttttaagaaacaagttttagtgtattttatactaaaacttgtttctgataatacctttttctagaatttgaagtaaaataatacctttaaattccttgcatattcttggacaagggccacagcatactgttcaggagaatacgttcgacttgatgggtaatgctccggtaagaagtagttgtttaagtagtcattgctgcctatattcacataatataagcacttatttaggtggtggtgtgcttggtcagggcctccaagtttctgagtgatttgggaaactatgactttatgattttgcaactgcaatcccaagctaatatcctcacccttcaattacaaattaagtaaagtaaggtttttgctccattagcatgaggataaattaaactccgcctatgtgtgtatgcatgcatggcctgtcccaagccaggataaaggaggagggttggcgtcaggagttgcgaaccggccataaaaaattagctattcttatgtgatgaacctttatgatatttcgttggggcgttcccttcatagcgacgcgttacatcggaccccggatgtatcgaaaaaagagctagggtcctcgccacaaggcaaggcgctacatcgaccccgggatgtagtgaaaaagatgctagggtccatgccgaaaggcaaggcgccaggtcttcacccggatttggtgacaagaaggcaagggtcccaacacgcagatgggcgagcgtggcgggcaaacacagcccaggggtttagaatgaaattgggaagctggaacataggaacattaacgggtaaactgagggagttagcagatgtttttgccagaaggaaagtgaatattgcttgcttgcaagaaactaagtgggttggagaaaaggccaaggaagtggagggcacaggttttaagttgtggtacacaggtaatatcaagagccgcaatggagttggaattatgatcgatagaagttacagagataaagtcgttgatgtaaaaaggaaaggcgataggattatgatggttaagcttgtagtcggggatcttatcgtaaatatcatcagtgtgtatgcacctcaagtgggattattatcagatgaaaagacccatttttgggaagacttggaagaggttctaagagggataccacgagaagagaagattttcctaggaggcgatctaaatgggcatgttggtaaaaacaatggaggttttgatagaattcatggtgggtttgggtatgggactagaaatgagactggagaagatgtcttgaacattgcactagcctatgatttgatgctagcgaacactttttttcggaaaagggagtctcatcttatcacgtatcatagtggccaaaatcgcagtcaaattgatttctttatggctagacgggaagatagatattcatgtattgactgtaaggtctatcctggagaatgtgtggcgacacaacataagttggttgttctagatgttaggttcaacaaagttcttaatttgaggaagaaggatcaaaatccaaggataagatggtggaagctaaaggaggagaaacaattagaatttatggaaaatatgttgcgtgaaggaccgtgggagtgtatcggagaaactaatgaaatttggaataagatggctgtatgtgttcataatgtgggaaggagggtgttaggtgaaagcaagggaaacagagtttttacaaaggaaacatggtggtggaatggagaggtgcaaaaggctattaaacagaagaaggaatgctttagatctttgcataaatgtcctaatgaggagaatttgcaaaaatttagagtagcgagaaaagatgcaaagaaagcagtgcgagaagctagaggaaaagtttttgatgatttgtataaaaatcttgggagcaaagatggggaaaaaggtatttataaacttgcaaagatgagagataagaagagtaaagatctcacccaagttagatgtatcaaggatgaaaatcaaaaacttttggtaagggatgaagatgtaagtgaaagatggttacactactttaacaatctttttaatggaaatggtgacaagagtgaggtggaattggaggacgtttctgatgatctgaatagaagatttgtgcgcagaattaatacatatgaggttaaagaggctttaaagaggatgaagaataataaagcgttaggacctgatgatgtccctattgaggtgtggaggggattgggagatgtggcaataaaatggttaaccaatctttttaataggattcttcaaacaaacaagatgcctgatgcttggaggaaaagtatgcttgtgcctatttacaaaaacaagggagatattcaaaattgttcaaactatagaggcatcaaacttatgagccatactatgaagttgtgggagagagttattgaacatcgtctaaggagggagaccaagatttcagtaaatcaatttggatttatgccaggaagatgtaccatggaagctattttcctgatgagacaattgatggaaaggtatagagaaaggaaaaaagacttacatatggtgttcatagatctcgagaaagcatatgatagagtcccacggaaagtcttatggtggactcttgagaagaaaaaggtagcattaaagtatattaatgcaatcaaagatatgtatgatggggctaccacatgtgtgaaagcttgtaatggaacatcaaggtatttccctatcacggtcggtgtccaccaaggttcagctcttagtccttatctctttgccttagtgatggatgaactaacgaaagatattcaagaagaagtgccgtggtgcatgctctttgcagatgatgtagtacttattgatgagaccaaagatggcgttaatagaaaattggaattgtggagaagcactttggagtctaaaggattcaaggtaagtaggagcaagacggagtatatgaagtgtgagttttcgaggattaaagacggtgagcaagacacagtgcatctgcttgggcaagaggtacccaagaaagacgtttttagatatttgggatcaatgttgcaaaaaggtggggagatcgatgaggatgtaagtcatagaattaaagcagggtggatgaaatggcggagtgcatcggggtttttgtgtgaccgcaagattcctattaagctaaaaggaaaattctatagaacagctgttagaccggcaatgctttatggagcggaatgctggccagcacataggcaacatgagcataaaatagaggtagcagaaatgaggatgttaaggtggatgtgcggatacacgaagatggataagataagaaatgaggatattcgacgaaaggtatcagtggtaccagtatgtgaaaagatgagagagcatagattgagatggtttgggcatgttatgagacgaccattagatgctcctgttagaacaagagtatgttaccaagagctagatacaaagagaggtagaggtcgaccaaaacttacctggggaaaggtagttaaacaagacctaatggagtgggatttagattggcggacggtatgtcttaggacggagtggagaaaagctataagtctgatggagggttaaaccctttagtagttctatgttccagttgtttcctgttttaattcttttcttcctcttttctcttctcctctcaccattcttttatatttaactctgtttctctcttttgctttattttcgatttatcattgggttcatctaccaccgaccccaattaatttgggttaaaggtgctgttgatgttgatgttaatgttgagcatgaggataaattaagtaatacatccatgatatattgtgtatatgaacctaatatcaatagctgattttctaataaaaaattgaaattactttacctttaaagtgagttttagcttgtgagttgttcaatttaaagaaatcagatccaattaagtaagtgaacatgtgatttgatttaatgcatgaaacaaatgacacatcacacaaatcatgacaaaatcacaaaggcatatatctcaaaaccaaattataggtaagatgtatatatataaattagatatatatagtaaaagagtttgaaatataccaaatgtaacccggtctcgttgcgaatccccgctgaaccggatgcataattcacgcctttgagtatgtctgaaccaccggtatttgcaaagggtgggataagattttccaatcccaaaagctcagctgcaataacataattttatattgaataaaatgaaattttaattaactgaaaactcatatatacatcaaaataacatgaaaacaaatcatattaatctatggaatttattctattcaagttatcaaacttaacgggacaaaatcattgtttgtcttattagaattgagtttggattcgttaacaaggattcaaattctagtgtttttatggaaaaaagaagagatctcttactaaaaataatttctgaagagatcaattatggataaaaccggtaaaacatcttttgcacctataatccaaaaaacttgatgtgacaaaattaaagatcacatgtctactttcattaaccgtgtctcaactctcaagctcttcaaatataactccagacaaaatagtcttgtccatgcccaattgcaaccatgtgaaagaaagatatacatgttgagaattgaattattactgattatatcaactgaagtacggccgttggtaaatcttccagtggggccaagtggaaaatcaatcccataaggcaagttattaactttggcatctgtatttagattgttgttgtttccactatcagataaagagtctccaaaaatgaaaagacaaggcacttggggcttcccaacaacacaataatgttgcatgtatgttgcactgaagaaaaaaatcaccactaaccataacttggtttcataatccatatcaaagaaaaatattaagagggcgaagttcagatccaaaatattaggggtccaaacacaagggtgactagataacatatatatatatatatatatatatatatataaatggagagagacgtgagagaaaggaaggtatgacccagtttaatttgtggagaaattcgttgaaataatttatctatgtgacacattgtaaggccatatgttgattttagtaagtgaatttcatgcacacactattagaaaatgactggagcctacatacggcagaaactagaatttcgccaagccatgagattgtaactatctcaagttttcaatttggacaaaatttaaatgaagttccttatgagtgatttttatttattttttttacttgtttaagaaatttggaggtaaaaggaggggaaaatgagggagggttaaaatcactaccttttaatttctatctccctctcaatgttggtagagtaggaaaatgatttataattttaagactgtgacttaaattattttaatattttattgtatccctttttttctctattatcatttattagatataactgcatatattatcggcttaaaaaaattgcatatattctctagattttttcttttcctatacgaactaaagaaagtgatctttcatgatcactaaatcaaattaaaaatgacctcttttttttcctcctcttttctctgttaaaatttctctcctccacctttactcccttgaactaaatacactatacatctttgtattaaattatgcagtttaataattcacacaaatatttatataaaattccatgatacatatatttattatttataaaaacatctacatgtcatcatttaaataataaaaaatacagtaataaagaatttaatttaaatcctggtttgtttgaaagaagtcaaatgaaagcaactataaataaacataaaacaaatttattcataaaaattaaaaataaatattagaagatttacgacactaacttttcttactcaaataaggaaatttgatcacttattagaataatatttcctacagttataattttttacaaaattttcacaaactgctcgaggtaaagtttgaatttaatagataccaaaaattgaatttaattacatgagttgtttcattaattaatttagattcaaccacttggcaaaacaagatacaaccactttttgaagttttagatttttgcccatttgttttgaagcatttgcttttctctgatacttctgctgctacttttgttatagattgcagctagttttctgttttgcttttattttttactagctcaattgattaaataagatatatgaattattataaatctttcattaattcttacgaataaaaaaatatacaacacttaactgtttgtattttctaatacaaaattacatataccgccggcagctcaatggtaattgtgtaaggcagtaatgctcaaagccacatagcatgccacgttaattctaggtcaataccatcgagctactacacctcttacaaaatttgagctactgtgttactcataaatataaatattgtaaatcttcacaggatcctaacacttggcattggaaaatggttttgggagcttccacaacagtcgacgttattgtgttaaaggcaattcggcgtcaattaatcgagccaccaatgaacatcctcatctccaacggctagtattttcaaagaaagaccaaatcagacttcataacgtccagcaaaatccaagctaaagagtatatttggtatgagaaaataaataatataaatgaaaataaaaagtggcaataagtgagaaataaaatgataataatttgagttgtttagttaaagaaaaatagaaaaaaaaaaattagtataaataaataaaaaataattcaaatgaatcgcaccattttaaaacttatcagtaagccgaatccaaactctgattgtatatctctagcaaaaataacgaaactctttgtatatataatttgtccattctccataaaaaaaatagttacttaaaaatagtaaaatacgtacgaactctgtttttttagtgatttactttgcatttttatttttaaagttcttattttaaattttaataaaagttgggtcaaatataggcacacgttttttataacgtgacatgtcgtttatattttaatttctttttaatttaaatttatttttcttaaattaaatataaatactctttataattttagttttcttatttgtatttttaaaattttatatacaatataaaacacacacacacacgtattacaatttatatgtttaaaaactatttttcttttcttgatgccgtgaattccatttttttaattaaagtaaaccttttaattttctactaagttaatttatactggaaatatatatatatatatataattataaattttacatgcattaacgatagccgtaaaatatataaaacccttgccaatttgacttctaagtttattttatcatcaattatttgtattaattttttaccagaaatgttaaagcaaagagtctgttgtgaaagttatcttaatcattttggaagaaacattcacaaggagaatcgatcagccaacaacatgctattattcactataattaaataagcaatcttccaaaactttaaaacaaattacacctgtacttgtgaacccatgaacatttagcatatatgaatatgtaagagaaagagagaaaacttaagactcttatgccttaaaaggagtaacacattcgaagaacattaaatatggtcgtggcacagcttaatagccactaccctctggaccatgttcattgttcagagatcatatctgagctaagctttggatatcaacagggtaagcatctgatgcagattgaacactgtaagctctctgagccacaacaacattgccagcttcagtaggatgaaaagcatcccaaaacaagtactctctcctgttttggcatggtgtttgcattggaagacatgtaatttgaccattgttccttcctaccccacagcacccagcatttgtaacactgaaacctgaagattgattcatgtcaacagaactttgtgagttcatattatttgatgctaaaaaaaagtgacaaaaatcatgactacaaaataaaatgcattggtttgaaaataattaccataggctgaggggttgcttataatatcttgaaagatgccataagagttaatgtagatgactcttgcatcaggcagctggttgttgaattggtcagtgagacctttcagtttgttgttgaatatttgatttgcagaattgatcttttccacacatgttttaccatctgggctgttttgggccaattcatttgggctgcaacctatttggcctattccaaacaacaccattttccttgctccataattgtacaaagactgaatgacaaacacaaacagtcaatatttcaatttgtggagctagctagcttttcaattttcaatttcattcctgactttattgtaattgaaaattaaatggctattttgaacactgcatgtttctactatattataatagaaaaattgaagatggtgaatatcaaatggtaaaagacagagagctaaagactaacttttagttgttcagtatatgcttgaataagaacatcagcatactcatctggtgagtactgcctgctgctggaatagaattgaggcatgaaatagttgttgaggtaatcattgctgcccaacccaattgagtatatgcacttgctcaagtaatttgcagctgagtcctcacttcccagtaaatttaccacttgagacaccgtgttttggtaattttgcacctgcccactaaaactaatacgccctccctacaaaacatatgaacaacttaagaacataaataccttaacaaatgaagattaaaaacagtgatgttgcatgaagcaaaaggaaactataaatgggtaccagttgctgcccagtttcctctctaattccagcagcagcagatgcataattgactcctttgagtatagcatcgccactagcatcagcatatggaggtatgtaatcatcgaatcccaaaagttcagctgttaaatttcaacagaaagttaaaacactagtgaaacatttctatgggtatatacttacaagaatcaattttatgttccagatctacttttctcttgttcttgtttgtttttaccaaatcagttcttctggtaagtaaccatctggcagtaattttttcctgtttctttctttatctgtaattctacaattctacctctttgtcaatgaaataaactacacaacactctagtcttaaattgcatattgaatgcggcaaacagatccatgtgaatggaatttaaggatcagtcacaagcctttatgaggggtatctaactcagagtagtgccaactctagtgtcaaaagtcttgctttttttcgatgacatctgcatgttactccttttttaattttttttatttcaccggtaaaaatattaatgcatcttaattataccctttccttctaggtggtgaacatttattgtctgattatagcataatacagcttgtcatccgatagaaaattatgcatgcatatattaagatgcttttagttgcagttaattgataggttcaaaaatagggaagaagaagaacggatcttagaaccattttgatgccattgactcactataactatgacttttacaatgatgaattgatgattattataagtgcatgcatgtgaatctagttttaagaccatgcaaagatgcaaacgagtatatatttcaactaaaatgccgacatgcaaagtttataagccaattaagcatgtgcaagctcaccaattgcatcaacagtggttttcccattggaaaaccttccagaaggtccatcagggaagtcaatcccataaggcaagtaatcagccctagccaaagattggagctggttgttgttcccattatcaaccaaagaatcaccaaaaatgaagtagcatggcacttgtggtgcaccttgaacaccactccacaaaccaagagaaacaacaacaatgagtgccaacatgcttattgtgagattcaaagctgccattggagcaagaaacggtgttgcttgtgaggaattgaagtgaataatctaggtagctaaggaagataggggcatgtgtgagtgattgaatgtggaaggtttgacacgagtataagtatatatagtagtagagagataaggctctatactagtagtagtctatagtgtagcttttacggttgggagtgttagttaggtgcattaaatggacgcggatataacgtgagattgaatgaaatggcttcattaccaattccactgtaccacccccaccatcaccggccgatctatgttggggtgagggtgggccactgcaccccctcatttcaataaaatcgttaatatctgtccaaaaatattatattttgcacttcttaattttatattttgtattctctaattttatttatttgaattttcttaccaattcacatgtaagattaagtaaatatattatcttattttaataaagtgcatatatttatcttaaaattttatattttgtaccttttatcttcgtgtttgaactcaacaatctcatatgataattattaattttttatttttttaaataaattgtcctcactgattcagagtcctagtttcgcccgtcctagtttcgccagtgagcccacctcattgattaaatctgatcactgatgttatccaactttaatgtagagttgcatcttgctgggatggaaatttggacattacaacgactggttaaaacacttaggtatgatacgacactttttatacttttgttttgagtttttccggaatgttaaagtttcgtttagtatgggaatttcaaaaattattttcaggaatttaacaagtctggaaattggttttcaactaagtttcttactggtttcaaaaattaagtttcttactgaaatttttctatgagaaagggtggaatcgaaattcaagacttatgcaaaacagaaaaggttttttttttccataattatgtctttcatttctgaaaatattttagacatactaaatatatacttataaattataacagtcttttagaattttcttactaaatattataattttcaagaaacatgattttttttagtttattacgtagtacataatattttagaaatactacatacatatataatattttggacatctatatacttgattttgccgtgttcaacagaacgagctccaccgcacgacgacctctatagatctagatgccacatcgtctccctatatgtatccatagcaaactcgccacaactgtccaaccatttgaagttcatgcccaagaaagaagagaaatataatagtattaacaagttaaaatatatatatatatatatatatatgtatgtataatcactactataaaactgtattttacgagtcaaatcatttcaaaaacctcttaaaataaaatgcagtgaaaattttgtaaataggagcgcacaaacgatgacggttttacgaaaaccgtcgtgatatgcgcgctcaatttactccttcgtcttcaacctaacacgcattcactcactcgccctcatcgtggttgccctcactcagctcgtgctcgtgctcatgccttccctcattgttgccgccgtcgaaggtgtcgccattgtccccaaagcgcttcctctatcttatcccttccttctctctctccctctccccaaatacctcctctctctatctccacgcgccgccgcaccttcgccatctgcgccgtatcccaaaacggcgccgaaaccgtccccgtacactacgacttcgacctcttcaccatcggcgccggcagtgacgacgtcctagccgctagcttcgctgccaactacggcgcttccatctacgagcttcctttctccattatctcctctaaaataaccgaaggcgtcggcgaaacgtgagtttctgattttcaatgtttttcaatttcgctttttattgaactagggtttataattgtgaaggctagtgaagcagagtttcgtgtttctgaagattggttaggtagggttcaggctaaccaagctttttcaacaagctcatttgtttgatatattctaacggatagcattctatcattggttttgcttattcttaatagttttcaatttaatagttccccacttcccctacatctcttttgctatgctaatagtcaattgttcaggaacctcattgaattgtaaatttatatatccatattaaagtaaagagctattatggtgaaagcacgttgttcccaacttctattttatttattttaacatgtcctgcatatcagaattggtttctgatataacgtaataacattattttatccatttagtttatctattgggaagggcttttggggtggtagtttgtatattatgtatatccctctaatcccatatatattttccaacttttctgcacttgataactcttgaaacaatgcttcgggtgtatgaaacacatgcccgactggcactggaatttggggacctgtttgagtataatcaggtttgttctgtatattttttgaagaaaagagacttttatgttttagttcattttagtctttgattacttttttgtacttgtttttgcttgttatgcttctgtttcttctttttttttcctgagatcaaggattaatatacttcattaaaggcagtcaatgctatgaagtagtgaattataattttaatcaacgagtaaactttggtcccatctttgcttgttttggaaataggaatcatagaagttgaggatgttattaaccttgtaattggactttagatattgaagctatttgtgtgaatgtagtgtcaatctcagttacaaactgtttatgccgaaggcattgaggggtccggtatggattttgctgcttacaacttgctttgtgtcataatgcattcaaataataataaagatcttgtagcaaggttagccttacatgcttgcttgattctttttttcaaaaaaactgttagaactgaattatgtcatgtgattcatctatctgaatttcgtgattattattgttaaaatcttcattgttgaaagttactagattgagtcattttggagttatattcccagaaacatgctttgataattatattatgtttcacctatcagaatattgtgctaatattattataatctgcactgttggaattttctagtttgggtcctttgggagttctgttccctgaaaaatacgttgataatttggaacatgttaataagaatttagaaaatggtttgtgagggaaaggctcaaattgttggctgtttgggacctttgggtccttgggtggaaatcagtgattctcaggtcctgataaacaaaacacagaattggatcaatatatatcaagtctttcaatggctatacgtaaatatatttccttgaattattgtaataatagtttaatgatgtagtctcaaatattttgtcatgttatcatagaatgtcacgaatttgaatgtttagtgtttgtcaataccaggttatctcacgaagcaaagaaggatgaagctgtaaaacatgcccttgccattcgtgctgctgtaacttcagcaaattttattgcattctttagactgtacaaaacagctcctaacttaaacacctgccttatgggtgagtatttttaattaactggtttttgtagcttgttggtaacacgtaacatatatgttaagggggataaaatgaaatgaattttttaatatccacagatctctatgttgaaaagatgcgttataaggctgtgaactgcatgtgccggtcatatcacccagctctacatgtttcatacatttctcaggttcttgggttttcaactggcctggccacaaatggagcaagtgatgagagagatacagatgcattggaagagtgttcagaatggttgaaagcacatgggaccaacataattactgataacaatggagatatgttgctagatacaaaagtatgtttgatctctatcctttgtattcattgtcctgtaggtgctaatctagtcaagaatttttgttctcaagcattgagcattttgatttgttgaatcatcactcattttgaggagcatttacgattgtgctgcctcaaatcactgtatttccttctgccatattttgagagttggtttggttttctctatgaattagttaaccgttagttaacccatacaaatctagaattccctagttactagtcaactttaacaagtgttttcttaacctggttaatggttgtggattggtgatttaatgagaaatgtttaattttgcaggtttcatcatctactctgtttgtgccagagccagaggatgttggtggtgttgctacctgtcagaatatatcacttataaaacatgtatgcaaccatggatgatacagatattgaattgttacagcttaataaaccttcttcacattcgaattgtgaactatgtctgcagattagagattttgtttcagaacaaatgtctgtaagaggtattgaattccataccgaggagtctccccaagctatcacaaagtcagctgatggcaaattctctttaaagaaaccagcgggtgcctcaaggtaaggatggagttttgtttcttaaaagagttaggcacatactgcatttaattttttaatagtgactaaggacttcgtttgagaagaaatgctgttttcatctctagttcgccacttgttattatgatctcatagtcgttgttaatggcagtgcattgtgtatagtaaacttggaaaccacttttgttttgagaactccatggtattcaaatcttcccacattaattgtcttctatatatttatatatctataacatgtatattgaagtccaagtaatgtaaaagatgtaaagaaaagtgaaagtgcgtgatatatactcgtaaaatatacgaagtatatcattatactaattcttcagtatcttaaatatttttagactctttggtaaaaataaaaaattaggtattaagattgtctgcataatatagaagattataaatttatactaacaatataatatattatattgataatataattaatgataacatatattaatatatgtttatctgatatatatgttattattattattattatttgtaatatttacactaggactatatataatttctgttacataaaaaatatagcaataaaaaacttaatgcgaaatcgttaatatatgatttcacaacaacaaaaaatcattaaatacatgatacttttataaaatcgtgatattaatttttcaatacaaaataatgtaatatacattttacataaatgcacttctaccacaaaaaaaaaaaaaaaaagctctttcatctaaaattttaaaaagttaacataaaatatattaaatattaaaaaaaagattaattcattttagctgatacaattaattaaatggactcataattattagtttactttaacaagtttcaattattattttactttgattttttaataattttatatgcatgttattaatttgtatttttatattttatagtggtttggtgatagaacaccattaggcatgaagaacataaaaaataaaaaaaaaattgaaagaaattggcaacctaccttttagaagttaaaaacaaattatttagatgatataagaggaatttatatattggataaatgtttattgtaaatattataatcacttaataatttattgacaattatttgagcataaatatatttatttattacaatttgtttagatctagttttttgaatttgcaagttagatttgttgtaaaataaaataaacattaaaaaaaataaacaacaaaaaatcatcttaaaatgtctattttctaataagatttttgaaaaatcatctttaaatcttcatgttttttaacattttttaaaaaataacacaaactattctaaaaaaaattaatgtaaaaatcaagattttaaaatgatttaaaaatttttatgaaaagtgttaattttttatgtggatccattattaaataaccgtttttgaaagactttttttttataataatgaataagggtgaaccagtattttaagtaataatatttttctttatttttattttttaaaaccttatcattttattatccctctatttctgtcatatttttcttcaatcaaatgatctctttaatttctcttcttttctcttctgatcttttttttttttttgtttcattctctccttttaatttcatcctcacaaccaaatgaccccttaatgaacacttaggagatcagcaactgaattatacgctggagcaaacaatgaattaatgaagtgagatgttggtatttgattttgacagaatagatgtattttattttagtgactgaaaatagatgtacgtgttaataatgtctacttggatgccttgcatatcatcgtagtcatctcgtattaattaaataattggtcatgcgaatggcaagtgagttacaaatgaaaattactgtcaagttaacgagagagtaattaaaacgtagaaaaatgctagaaatacttgtttttctgacagcattcaatatttgatctgagtttatgcaaagatatggatatgaatacgttgtaaaatgattagatcatctcaaaaccacagatataaactttttaacttataaattataatcgaaaattcataaaaaaaaaaaaaaaaaacttatatcccatatatcaatcaatagatggaagtgcatccttcatgcagttattttatggaatcctgaggatacgtttccggcattacgttggagatatctacatgaaagtaaatgtcaattaattattgtgaataaaagaaagatcgactgcctattattacctcaaacatgcactagaggatattgaaggacgtatttaaccccagatttaactagcaataactaaaattaaataaataaataaattttaggccaaaatataagaactgcttttaagaaatatttttttataacataatttatttctatattataaatttgattttttaatttcaaagaaaagtgttactgttttgtacagcttagcacatagatcaataaatatataattatttcaatttatccaattattttaaatttaagttttgaatacataacttaaatatttataaaatcagagttatctaaagaattataagattgatgagtggttgaggaaaaagaggagaaagaaattatgaacgtgaatttttcactaacaaaaattaacagaattaatatttatgtattaataatatataaaattattttatattgtcgttcccataccttttttttctcaaattaacagactaacaaacatccacagataaaaagaatcagaatcacccaccagattaattgacatgaactatggcatgcatgcatgcatgcagcagctagggtaggaacagcatctacaaattaactactatcaatccgatctttccaatcaatgaactggttactagtgattatggcctagcggcacatgctcagaataagcatgtctttttctccggacctaccccttttgggtttcatgcctgagatggtaatttggaaagctggaatgatcaaattataaatatgcccccttttatttgtctccttgattgtccctctacacataactttatgacacggaacgaaaaagacaacgatttgatatataagcatgtcttaataaattataaaatcacttaatttttttttatttaagactcacaatattaaaagattctatatattatgactcaactaatttaaacagcattaaggttaatcatatttttaaatagaataaaacctttttttggtgaattaaatataataaaacatatgacgactactgatcaaattaattgtgactaccttttcagtgctaatgtgatcgtctaataaaaagacaagcaaaatattagcgacaacttgttattaattagcattcgataacacttatttaaagttttttttattctaacagtttgatccatcatatcctatgaaatcatatcacccgtgaaggttgttaattaagattcttctatctagcaacaccttaattaatatggcataaccttgaaagtttgttaaggattagattcgaaggggaaaatggtttatgatgaataccttgacaatcaaagacaggaaacagaataataactgacatttttttattagccaaaagagatttatttataaggtaccggcaaacgcccaaaaaatgatgatgatttacaaggacctaccccctgcacatacattcactagcttagcaattcaactcgaccaattgtttgtattcccaagcccataaatatccaacccgagacatcaacatatcgcatattacatgttgatattcatccaacaccagtttagacccgatttaagccatctgatctcattttcctccccattacgataattcccatccatcataaatattgtatacaagacaaaggatttgaataccactcaaaataagagaaatgaaaagctttaagtttagcctccaaccatgaccaagacttatattttattacctccatgacagaaatccaagtcaagtaattgatagcggaagatgatgttgtttctatggcaccatagtaacggacataatgcaagggggaattgaaaataagctttaaaacttctttaaaaaaccagaattttttgagatcaataatcgaattcgttcatgaaattgtaagacgtggacaaatttgtttctaaaagataaaaaattcaaatttagtctctgaatatgcaaaaagtgtaacaaataaattagtccctaaattttataatttaatgtcaaattgattctaaaaaaatataatttattgttaaattgatctttaaatattataatttaatgataaaatagtttcacaaatttaacgtcatgattaataatttgacgcattttttacatatttagggattaaatttgtatttttcatttttcagatatcaatttattatctcattccatttttaaagacaaatttgatttttttttttttataatggtgaaagtgaattttaaactatagtacactagcttattaaatggacactttcaccccctaactttaggacgacaagtgctctcaagagtcaagatataaatttggtcttcggaagccatgcaataccgtgtagctaactattcctatatacagcatcataaatgctttgatattaaattaaagaatgtaatgagtttgtctaagtcatacttagtaacgtgctttgttttgagtacttcattattatgcatttatagcaaaaagtccacactccactctcttcaattcatgatgtttatccaacattgcaagttgtcgttgacgtttgcctagggctagaagttagctttttggatggcttttggcattcaaaccaaatctgcaacccgtgatcctttgtaatgatcaataatcgctcctacagttttaacaactagtactagtactagtagtaatatttttttttaagccaaacctcttactattataagaaagaaaaaaagtaactaactaactcaaaatgaaattatttttaagaactaatttatagtataaggatttgtttcgacatgaactctttttaaacatttggatatataattgttaatgtcttataaaaaaaatggatctaatatgtacatatagatgttcgtttcctggaaattctcaagcgcatcttagttttgaggtaaaatttgctatgataaaaaattatttaaaagttagtaattttcttctaatctaactttttcatattttttcttctccttttttagtttccatttccccttcgttttgctagatctaaagcagtgtaattatagggattgttgacttatttaattaatggtcggtaccaaaattttcaaatttaaatgtttaaaataaaataaaataaaataaattttatttaaaagaagttgtacaccatacaattagttaacagtaaattataaagtactagctagtaatataattttatatgaatatggatcgttgacttatttagttaacaatcggtaccaaaacttttcaaatttaaaaataaattaaattagaatttatttaagataagtttgtagcaaacaaagtttaagttaagagtaagagaatggttatacactaagttttagatagtcatctaatcacaattcaacatgtatattaattttgttgacttttaaaataattatgttaaagtaatttaaaggattatttatgattagatgataatataaaaattttataggacattgacattaaattctaagagtaaatcataaagtataaactaatataattttatttgaatagtttatctaattaatacttttaaaagatgtgaaactgctttggctagcgaactaacaatatatagtactatttcttaccgaatatctaatattcggcacggggataggagaattagtgttagatattttcctgtatttattgactgtatcatccccccaaaaaatactacaatagtactattatattgcaagaaaacgtatggtgcagtaagatgcttggaggttgtcactgaattgaaagcatcatgcatgttgaattacgtttgttatttcatgaatatgcacggaaaaacccacatggcggtgacaattaagcagaaattttctttatatagtacgggatacttttatcagaattaaaaattcccccctctttgagaattgttctacattaatttgatcacattcacttaaaagttttttaatattttttctgaaagaagtgtcccagctgtgaatcttgatgttgatcgaacatgagccatgacaacgaatagcactcattagcatgtgattacaggctgactcggttgtttcataaataatccatctgcctttatgtgtgtttcccttttttgcaaatcactaagactattcgaataagacatgcatggtctccccattttttgagatgtaaaccagacatgttcaaatatggaacactcaagtaaaaaaatgatagtttcttttttaacaagtgggaatggaagacattgtcataagatttgtaaacatcatgatcaatcaattgaattatattcttaactaaaaaaataattttttatttatcagaatcaaccacagtattatagaaaatttataataattcacaaatttttattcaatcagttaagttagatcttctttcaaaaaaaaaattaatgactaaggagacatgtattacctattttataagtttacattcaaaatttgagttaatatttacgttatacattactttactgatatttaaacacataacacagtttgacttataaaccccataggattagtattagagtggagtaagacaaaatcttcttgtaaatgaatatgataattaagaagtttcttgctaatagctatgtagtatatgaatgtttttttttgcatatatttcatgggtatgaaccaccacatgggcgtgataatgagccattgcccaggggaaatgtgctgtaacgttttcttcagcaatgctaggctgttatacgcgcgtggtccaacacaaactgttagagcctaaattaaatcctaatcgtctctagtctttaatgttcggtataatgtctcttgacttttgtttcccttggaagatttgaactacgcgttcaatcacggaatgtcgcatcctggtggcaatagacttattttattcatagccttttactattctttatgaatagtaatggcaaaagttacaataatactatcataactttaacctagatttcttctataaaaaaacactgacctagaattccgccgtaatattgggccaatgaggttctttgtttttacagagccgatgagtttcaagatcaataaattaggttattagttgactttagaaaaagtaaaaaattgatttcacagttattaagaaaattaattaattaattaatttcattaaattatattatttttaattaaaaaacaaatatttttttaaactactcccattgaaacttgatatatctcattaaactaaggaaaagtagtaaaagagaacaaaaaaaattgtgtttttgtttataaaagagaatggaagagacatataagagcatctttaatgctagatcttcagtaaggatcttgaatttaatatctgattttcactaaatcttctaataaaggagttgaagaaatctctaatatggatgaattattgtagaaaatctcttaaaatctgcatattattcaaaaaagaataaattttctttctttttctctcttactaaaatctcaaaataagaataccattaaagaaaaaaatggaagagatgttgaaatttttttaatcgtatgtgacattatgggatctatcaaaaatagtcaaagatcctaattggagatctactaataaaaatactctaatacttcttataaataaaatttcacctaaattatacaaatgtatattaaatttcagtttaaatcaaatttatatttctttaggttaaaaaacgggtacatgactccctctaactactttcagtactttgcggtgtctaaccacaattcttttttgtgggactctgatccctcttcttgctcccattaattactatgaccgcaatttcaatgggcttcttgaatacagattttgctgaccttccatgagtttcggcctgttccttctatgttctgttactgttctttctcttttttctataaatttgggttgggttttgatagagtatctttagactaaagggtatcaacatagtgaaatctgcttcctacaccattctttttctattacaccatttttgtaatggtggaatatccaaaatatttttcgcgttatgcttcatacatatccgcataataagtttttttttatgaaataatttaaaataatggcatagacatgtctcgaacatgcaaccttcgcattattaacacgatgctccaatcaaccgagttaataggccaattatgttgatacatataatactaaattttttaatgtatatttaatacacatataattttatataataaatttttaacaattaattttaatctaataattaatttatagtttaacttatctataaattttgttttgtaacatatattgttacgaaataatttatagtttaatcgcatgtttgataaattaattattagataaattaaactataaattaattattagattaaaattaattgttacaaagtctattatgtaaaattatatgtgtattaaatatacattaaaaaatttagtgttatatgtatcaacattaattattttttaatataattgacttattagctcagttggttggagtatcgtgttaataacactcgtaggttcgggacctgttttcgtaaaatatattttaacataaaaaaaaacttatggacttatggattcgccaatccgtatgaattatgcggatccgtatgaagcataacgcgaaaaatatcttaaacaacaacacaagtaatccaacaaaaaataaaagagagaacgtgtgtgtttgttttaagactcttgaaatcttcccctttttattttcaaaacttgttttcaacatatttttatattaaaaaaatatgtatagattttaaaaacaaaacaaaagaaaattttatttgttaatttcttttttagaaaacagattttaaaaagaattgtataaaataacaatatatgtcaattacatattcattattacatatgtgacatttaacaacattttttgtctaatatttattaaaaatgttactaaatttttttggcaacattcaaaaaatatcgtcaaattatcaatatatgttactaatatgtttttgcaacattttatcaaatgttgtatagctcatattgctaaaacctaaaaatttcacaaaaagactttagcaatatggactatacgcaacatctaataaaatgtcacaaaaacatattaataatattttttttcataatttgacaacattttttgaatgttgtcaaaggtttttaacaaaatttttattaagtgttagacaaaaaaatgttgctaaagatcacatatgtagtagtgattatacaagatcgaaagggttctttatttattacagtaaagcatcaaacttaaaactaaaactacaaaattaaattataactctaattggcatgcatgcaattgatctttttctaagagttcaagttcttttaaggccttatgttcaaagtagagaatgaactctttgtttaagtgagtaatgactccagtgtgtcttaatgctcaaacaatggcataaaactcattgtcatgcataaaatacttaaatttgtcatcattatataattaagtttctcataaaaaaagaaaaatataagattggtctagtagttgaaaaagaggtgaaagaagaaagaaagaagcaaagatcacgagtttgaatctcccaactaatatttctaaaactataaactaacatttgtcgataaaaaaaaaaaaagtttctcatgaaaaatatgccatgacataaaactcattgccatactaaaaaagaaaaatacttatagcttcatttccctcttatcttggtcaactttaccaagtagcaatggtgctaacttgattttcaactcatcttttataaagaagcaattgtttgcatagttgttatacaatgctcgatagtcttattgctcaagtctccgaagaagatgacatgcatcgaaggaaataacatcatatcctatatgattctatgatatttccaagcagatgaaaaatatacaatataacatttagaaacttttaccttactttctttgttatgtcattgaaacttgtatggaagtggatgtttttgtgttgataacttattcaccatgtagttttatactacattttcacaccctttgtttattataatactagtacggtaccaaattcaatctatagtagaatatttgcaaaaagataaaatttgaatttcaaattgcacccacaaatgatataaatactaccgttgcaatagctttacttacatcaattgcatatttctacatgaatctttcaaaaaaaggactagcttattttaataaatacatccaaccaaccccaatccttttaccgactaacatctcagaaaatgtcacaaaactcttatctcttagtttttgacattttggaaatatattagctgatgaattagtaattgttgttcttgtttctttagtacctttagtggttcctatacatgtcatgctccttggattattcacaagcggtattcaagctctaatttttactactttagttgcagcttatatagataaatccatggaagtagaaggcgctctggtgggatcctcacgtatagaaaaagattgcagtcaatttgataaggatcgagtgacattgtttctttgatccaaaccaaggaatcccttaaatattattcaaaataaatcttattctatcgttgatcaaaggtttctctatgaaaaatacgaatcggagtttgaagggaggagtcctcaacccacaacaaatagaggaggatttttcaatcacattgtttgggctcctagaatatggtgcccttaagacttcctatttgattgtattaaaaaggcccaatgaattgagatttttctattgggccaagtcattttgggagaagtggatcatttatgacaaagaggatgagttttaagaaaatgatttagagttcttgcaaggtagaaccatgtaataccagacacgagatagatctttcagagattaggattttttttcaaataagccaattcatttgggacccatagatccactctttttccaattaaaagataagccttttgtttatgtgtaaagttagtgaatataataatggtgtagtcttttggtaccaaagatgagtagtagcaggtctactgtataaagttgatgtgaagcaaaaacacttcaaaaccaaacatatcttgttgatcaagctagtacttgcctggacggtaaagaaattgcaagataaattgttttgtatataataatataatgttatataataaattgatctaataaaaacatgtgaattgatcaaaatatttttcttttaaaatttaaaaaataaaattaaaatataaacttaatgatatattttaattttattcaaatatataattatttaaaataaaaaatgtataagttattattatgaataagcatgacaaatgggtgggagaacaggtatatttcaagttagtttgctaagaagttagttagaaatgtttatcaaatcaatgatcattcaatcaatttatacaatgttcttatatgatagtcctctactatatttcaaactttatgggtatgatgacattatgtttgtgctagttgtattttttttcaaaccatttcatctcaaatttctaatactaatcaatattggttaacgcttcaaaaccaccactacactccggaggagtattttgtaagctacatcaccagtaatataccaaaaaagtgtgttcgtacccggaaaaaaaactaaaagtattaacggttcattgtttacaacaattcaattttttttaatatcattttttagatattttagtttacaaaagaagtagggatatgtcacttccccaaaaatatattcaagaaacccgaccccgtgcagatcgtctttttagccattttctgaagtagaggtgttgatatatcacaaaaaaaggtgttgataaaatttaaattagatgatcaaatgcattaatttaattttggagatgaacatcacaagggggaaagaagtcagttaaggacgcacgtcttaaaaactttaaaagaaaaaaaaatccatattccatacaagataatattggtgtacccaaaaaaaaagatgatattattaaaaaaaatcttattataattataattttaattaactagaagttataagagaatataaaccaaattaattaaaatattcaatgaattcctaattataataaatacatagtaatttttgtatttatgagaaaaaaattagtcaataatcaaccatttatttatgacaaataatatcgtattaaatatttttatgttgacaattgttatcttccgtgatagaaaattttaaattgaaattataattcttaattcaaaatagggtttgggttaagaattgattgcaaagatctgtgtcataaatacaatattgatttaaatggtcaaataatcattaattatattttcaatcaaatcattatgttcaaatttaagatagtagtatcggttttacgaaataatcattgctttagaaattgtcatgtgtggagttttcttcttctttttttaaacattttacttttttatagaacattttactttttttaatgcaataaaacattttactttgtatatagtaacattttctttaacagtgtatataataacatagatagaattcacaaaaaaaaagtaacatagatagatttgttatctttgacacgtatctttttttttagggattttacacgtatcttaaaacacacccccttcccaaaaaaaacctaaatcataatggacaataattataaaaataaaatacaaatcataagggacaattttttaatatcctacgttgatgttcactaattaaatcattctccaatttcaattcattgtattcgcatgcatggctagtctttgattggacgagaatgaatagattaatctaacgcattacactctttaagattaatctaacgcattatactctttaatgtatgctctttcaaatacatgatctcctttttccccttcaagccaattacctcgtctatgccttttatctcttcattgtatgggtaatcttccttgttctattatggccaccacccttttgatcacttgtacaaaaccacggtgtgaaaacaatgtggagttgtggtcagtaatgtgaagcgaaatcatctcacgaaatattctacattcttaaaattatcaggttacaccctacctgtaatgggcatattttggctttcaaaattttcaacaaaacaatgtctcaagtaggtatattttgttgtctgcgttataacttgcttgtgttgcctggtgtcattttatccattattgtaaatgatttatttatttaacacatgaaattttgcaaaatttgctataggcatgttaagggtattgttaaagatatgattagatttgctgattatagggatttatttccctctttcccttattatttttatcccttcagaacacacaattccagcaataatacttttttttttttttttgtgctgaccggcaatacttgtttaggtattttattccttgaaacagtattttgttttggtagtcattcaattgttatgaattttaagtacatttcaatattttgttcacgattcaatttcaggaattttctgatccttgtcttgttatttgtctaatgtgatgagaagcattgcgattatttttatgcctgatggttactttacgcatatatcatcagtatgatttttacttcattgacaatagagaagttgttttagcctattgagacatacaacattgactaatgacaatacaatacgtggatcaaagcatgcatgtgttagttctctagagtgcattttcccatttggtaagtaatagaaatgtgaatgaaactggaaaaaatatgtaacaaatgattggagtgtgcaactatttccgtgtttatttgagaatgtgattgagcattatccattgttgaatatttgaaggtaggaaaaataattttaccttttgagtaagaatgctgtctttgtaggaatcaaataagtgaaaagacttaacatgaaaatttcaggccaagcgtatgccagggaacaattataactgcgtccctttaacaccaaggtctagattggaaaggcttctgagggaaagagagctaaggaaatccttcaagcttattcaaccaaccgaggaagcaagagatggcagcaaagagggagaacaattttatggtgattcatgcataagtgagaatgaaatttcgggtattcataaagaggaggagatcacggaaacgaattttacagatagaagccaaaggcaagatgagaggccaagcaaacaacgtttgttggtggtagctaacaggttgcctgtgtctgctgttagggagggtgtggagtcatatcgccttgagatcagtgtaggcgggctagtcagtgcacttctaggcaagaaaattttgtcaccttgcattaattgtttctttggtgtgttttgttaatttatttattgtgaagtttgtaattgtaactcaaccttgctaattagttacctttcttgatgatctcatagaggtcacaacaatgatagttatcttcacaacattctaataataatctattacttataggaatagattgaatttttctatttttaaagtgaaggttgtatgaagcttgttgtttttgttgaaggtgttaaggaatttgataccagatggattgggtgggctggtgtgaatgtgccggatgatgttgggcagagagcattgacaaaagctttagctgaaatggtattgactcaaatttataattcacaagcatgtggccactgatcaatgtagtgaataatgataatctagcaactcttctctttgcaataccaaagacacacaaaccatcagtaattatgcgttgttaactgcagcgatgcataccagtatttcttgatgaggagatagttaatcagtactataatggctactgcaacaacatcttatggcctctatttcattaccttgggcttccacaagaagatcgacttgctacaactcgtactttccaatcccaatttgacgcatataagaaggcaaaccaaatgtttgctgatgtagtaaataagcattatgagaaaggagatgttgtttggtgtcatgattaccacctaatgttccttccaaaatgtttaaaagaatacaatgaaaaaatgaaagttggttggtttctccatacaccctttccttcctcagaaatacataggactctaccgtctagatcagagctgttgagatctgtacttgcagctgacctggtggggtaagttattctcatgcatctccaacttgatgttgattatagtagtacattcacaagctaaattcctttggtatataggcatcaagggcatgcatttagaacaagctagtcaatctttagtcaaaaaattatcttccaccttgagatttactgttcttgcttgttgattgcactatttagtcaatagtatcaagtggtatgttgctgcttgctaggatatttgagaactctagacattttgtttaatgttgtgattttaatattttcattggtctgcgtcccagattccatacctatgattatgcaaggcattttgttagtgcttgtactcgtattcttgggcttgagggcacacctgaaggagtagaagatcatgggaaactgacccgtgtggctgcggtatatctgcatatattattttccctttctaattctatacatctaactgtgaaactggaatttcatcttgtgttgtatgtttatcagcattgaatagctttacgaatcagtatgcagtatctgatttcattctcatgatgacaatgttttattttttgggagtgtgaaacttcagtttcctattgggattgactctgatagattcattcaagcccttgaactccctgaagtccaagaacacatgaaagaactgaaagaaagatttgcaggccggaaggtaggagccatatacgccaaagtttcttgttcaagaatttgagaagttgagattttcctcagtttcttgtttctgttctacatctgcctttctctgaaaatgtgaatcattagaatcactttatgtttcttatcaaatggacaggtaatgttgggtgtcgatcgtcttgatatgataaaaggaattccccaaaaaatcttggcatttgaaaagttccttgaggagaattcacactggcgtgataaagttgtcttgctgcaaattgctgtacctactaggaaagatgttccagaatgtatgttatttctctagaaaagttaattatcacttgaagcattcattttgttagttctctatagttattggcatttttcatgactgacactattgacttaatgctttggcagatcaaaagcttacaagccaagtgcatgagattgtaggacgcatcaatggaagatttggaacacttacagctgttccaatacatcatctggttggtgttttaaacatctacagcatatatgtcttgtttggtatttgacgatgcaaggatcatgagtgtggatgctatctattatttgggatctcattgaaaatattaaatttctcatgtcactactatatatgagttgatccccgttactacgagatttgaactattgatcatctatatattgtctgtgttctatgcattgcccatttgatcattatgttgccacccaaaagctgtaaattcaatgtctaggttgatctacttaattcaaatttgttattctcaatttgtgttgttagctacattctctgctagctgttctacaaaacatatcattatcacaaacatattcacgacgtctcatttcttcatctctcttatttgatcaagtgatataagacaaaagtgcaaaaggaataaaaaagggaataaccattctagcagatgaacaagaaacctactagacagattctcctgaaaattaccaggaaatgaggaaagtcctctgaatcataagtgataaataggagttgcatttaatcacatcttattttttacattgcaaccttttgataacaagacttgattgacaagtaaagaaaacatacctatacaaagtactctgatgggattttaattctatcaaaatttccgtaaagttacctccaataacccgataaaattataaaaattctttcaataaatcttcaatagttgatcttcttttgtcctgcatcaccaagtaactttcaacctattctttctagattaccttgatattgttcagaatgtggagcttttctattacacaatcacttatttgtgtaatgttgtcaaacgaaaaaattatttcccttccatcaaaaattaaagttatatttattttttacaaatattcaagtaactaccttgactgttctttgcacacactgaccatgcattttgtctcgttgattacacatccttctcttgaattgctaaaattttttgggcaaagtaaatacattgctaatcttcccagaagagtgacaaatgaagcgaagtcatatgtttatttatcatacagaaaatattgttattgttattctgttgaccttgtaatgatttctggaacatctctttctatgattacaggatcgatcacttgactttcatgaattatgtgcactctatgctgtaactggtactcattttctgctataacatacaagatttagtccatgttgtccttatttattcaaagtaataatattttttatataaaagtagtatcatatttcaccattggattggtgaaatactcaagctgtaggacattctttcttgttattggaaaagaaatttcattatctttgctgactctttctcttttctttaatatatgttccaagtgatttaagtcctctgcttgtaacatgtacctggctgtaagaataaattgaactgattgatatttatttaccaggaaatgaggaaagtcctcaagaatcatatttcttgatttttaattcattgagaaaagaataattgaagtacaatgacttacagttgtttcttatattcacatttgtaatatacttctgttttatgcttaagatttgacaactattcctgggaatcagaaaatggcaacaggctgcagcatatctttataatatattataaaatccatcttaagtagttttattgaactaagtattcagcacccatgatatgtatcataccagtctgactcacatcgtatttagatgtagcacttgttacatctttaagggatggaatgaatcttgtcagctatgaatttgttgcgtgtcaagcatccaagaaaggggttctcattttaagtgaggtaattcagttttttaatgttctcatcatttattttggctgcatctcttggatactctgaatgtatttgagcttcatatttgagaaagtgatttatgttttactaagatcaccaacatttcaaatgattctgccattaagcatagtaatgttgaggtatatgtatttagctattttcataaaacagcaaaacataaaacaaatttactgtcatttaatgaataagactttcctaaccttaactaggtcaagctagcaagtcctaagaattataaacaagtttgtttttcctttatcaccatatattaatctttagcaccgcacatagtctttttttattttatttattttgaagtgtttacacatcaatggtgttaaagtttttctagtctcaagctcacagtttggcttgttggaaaaagaaaaaaaaactagcctagctaagctgagaagctcagctttctttttattttgtaacctgaattgtgtatagtttgttaggctcaactatagagaaaaatcatcagtatgttgtatctgtttcatcaatcatccgcgtcattgttgagctctgtaatgacaaggtctacttttgatggtaacctggttatgctataatgtgttcataagtatacttattgtttcttgaatatcaagagccagaatttgtttttgtcaaaggttaacatttgttgaaagacatatgtcaagagaataagctagggtaacatgaaatgattgcttttgatgcatggaattgtggttgctgatagactgaaatttaaataattataatcatcttcccctatcattatcattctataatccacgatgcaatattgatgtatatttatttttcttttaaattaactatgatgtccgtgttcttcatcttatcaccatcattgtgaatgttaaatatacgaaatgatcaatctattcaaaccaatatattttctgttcttagttgttttctatgtacaacccatgagtgctttacaaaaactggaatatttgtgataaagtgacagatagaaaaggatagggttgatactaggcttctagttcaagacttcagtaggaatgtaagatcatattgtagatcatattctttataaagttattgtttgtctggaaatatcatcttgtttaaataaaaacaaattcttatatgtccaattattttattatcacataattaactcctaaaatcactaggctttcagtataattcaaataatttagaattctttatttggtatcagtttgcaggtgcagcacagtctcttggtgctggtgctatcttggtaaacccatggaacatcacagaggttgctgcttctattggttatgcgttggaaatgtcagctgatgaaagagaaaaacgacatcagtttaatttcaaacatgttgagactcacacatcacaggaatgggcagcaacttttgtgaggttttaatcctataacactgcttgcattttgtttttcttggatcaattttgttccatattttatttttcttgtaatatggaacagtcagtcttacacaagcatattagatcgaccactaaagctagtttgaaatagtgtcaatgggaaaatggagaaaaatggaaattctgtctttgaaatagctatattggtcggtctattgctctagattttgtcctgaccttctatggtggtctctgccacttatgcttttcatgattatttattctaaaaacaaggttttatttttacagtgaactgaatgataccattgttgaagctcagcttaggacaagacaagttcctccattacttcccaacaaagtggcagttgattgttactcaaaatccaataaccgactaattatactggtaagctgtttgttagatcatcaaacactgaataaagggctgtcgcaaattattcaccctattttgtgcaataagtattaggcttacatttataaatggaaaccaacatgaccttacttatacaagtgcaccgcacgtgtttaagagaaacgcacatgaggacttatttgtttccacttgttttttgtgaataagtgagaagggccttctcaccaacatatgtagctccttttcactaaaacaataccattttgcctcaactgcactgcagggtttcaatgccactttgaatgaaccagtggatgcccttggaagggctggtcaaattagagaattggaacttaaattacacccaaatatgaaggaacctttaaagaagttatccgatgatccaaagacaacaatagttgttctgagtgggagcgatcgagcagccctggacaaagtactatcaagaaaacttcatatgtttttggattttcagcaacatttgcttttggactaacaactactttatgcagaacttcagtgaatttaacatgtggttagcagcagaaaatgggatgtttttgcgacgtacttcaagtgagtggatgacaaccatgcctgaaaatttaaacatggattgggttgatagtgtgaaggtaaattagctgcatgcatacaagtgtttctcttattaagttcctttagtttcaagtgtgattttttttttttcatatttttttataaaatttcagcatgtttttgagtattttactgaaagaactccaaggtctcattttgagcttcgggagacgtcagtagtatggaattacaagtatgcaggcatgtgaaaattttctgttaccatcttcccttttaattttcaacctacttatttttttctaggactaacatatgtttttatccttaataaatatttaaattttgtttattttttgataaattttttctttatattaagtctttaataaaacaataattttattttttatcattgtcactttttttttgtctatgataaattagtaaattttggatttgtttcttgataaaagaaattattttttattagtcttttttcaaaggaactaatatcaaatgagaaaaaattatcagagaacaaaaacaaaatttactaatttgtcaatattaaaaaaatgtcaatgaccaaaaatcaaaattttattttatcatggaacaaaaataaagaaaaactttattaaaaacaaatataaaatttggatatttattgaaagatcacaaacatattttaacatttcttctgataagacaattgtgctgatgcacatcatctctttactcccttcccagcaaagtgggagccttctatggttaattactaacttattgtgactgcaattaacactagatgttgagtttggaaggattcaagcaagagatctgcttcaacatctgtggacagggccaatatcaaatgcatctcttgatgttgtccaaggtggtcgatctgttgaggttcgcacagttggcgtgtcaaaggtataagcaatttcagctggctagtagagtctctcacctatccttttctgttcagaagctttatttcctctacatgctagcacctgacactttttttggtatagggagcagctattgatcgtatccttggagagatagttcataacaaaggcatgaagacgccaattgactatgtcttgtgcattgggcactttctagccaaggttagtgcactttatttgattttctattcttagttcacttgagactttgttattgttagagtggcatagcactaagaatgactagatcgttgccttttggcagtttggtagcaatgatagaacatcaattgataaggtaataaaatataatattgaacactgaaatcacacacaatacagcagtacacttactttcccaaagacaaaagtctcctgcagagagtacccaaactgcaaataactacaccctccttatttacacaacttactaccaaatatatactcctaatagataactgtcagtagttagttattttatatgcatgcagattctaatatggaactacctccaattcattaagggtcctttcctaaccaacttggatctcagttcccatcacctaaggactcaactgtaaatattagaatgaaatttctaaaggagcattgattttagattgatctacatcagaaaaagttacatgtctaagccttctataatgattaaggcaaataatggttggaaatgaactgtttcaggatgaagatgtgtatacattttttgagccagagctcccttctgaatcacctccattaccaagagctatgctatccaaatctaattcttacaggccatcatctctgccaaaattaccagccaccaaaaccgggtcgaaggcagctcaatacaagaaacaacgttcgttgtcaaacatagaaaagagagaaattgatcaatggagaccaatgtatagtgataaaatagcattgcatgagggttcctcagtgcttgatctaaaaggtgataattacttctcttgtgttgttggacggaaaagatcaagtgcacgttaccttcttaaaacctcagatgatgttgtcaacctcttaagtgacttggcagaacattcttcatcaccaaattaactgattgtctttttgttagattgtttttttcttggtaaagtgtctattcatatcatttgattatgcaatgccctacatgtctcttgtgatttgaatgaatctcaaactggcaacgtgcttccagcatgtttggaactctcagcatgtttggaactctcgaaactgtttgaaattctaacttaattttgctatataaaaaaattagttgtttgggtgtttcttttcgaattgcttttacttttactcatagcacgtttaacagaaagcaacaaaaaaaatgtagcttttgccttagattgagattttacactaaagtccactgttaacttgcgtaaaatcaaaatatttttaagttggcaaatttttaccaaaacattacaggaattgaatgaaggagtcccactcaatcattttcaaagattggttttaattttaaaaccagatatgatccaaatttaaagtagtttaaattaaatcagtttttatttgttttaccccttacgtatttgttttaatgtgagaaatgaacaaattttaaatatatatatatatatatatatattaaaataataaagaataagatggcaaaaacaaatactataattttataacataatacggcgatatgctaattccataccaataaacacttctattcttcaattgatattaataaatgagaatacaaaacatgggggcatacacttattcagtgacatacaaaatttagaaaatggccgcataaccaaagctttcactgtttaacaatgctcttgaacttttgaactaagttttacactatatgtgtattaaatgaagaaaagatgactaatccctaaatgaatgggtggatacatcaagaatacaatttacagctaccaaagaaaaattaactcaatgcaggtcctggttggggcagaatggtgttcaaaatatgacacaaacctcaatcaagtttagttccccttaaacaactcgaattaattcccatgagctattcttctagtcttggtttgttttggcacatatgcatattggccaaagtccacagtttttattggcctgagttaagacaagcaggacacaaatcatggtgttgatacaaatgtataagagataatgaattccagtttggcagaaatacattacctattatcagaagtgttttgaacatctttcagaggagcacggagaccactgacacgagtgccagaagtgcatctaaaggatgatatcacggagacaaatctttccatagacttctcagctatttctgaatactggcccagatgggaaatgtttgtcccaaatttttcttcttcagcattattctctgtaaatggtccgtcaacattgtgatcacagcaacctataatcaagaaacatcagaattcagagaaacttcagcctcagcgagatatttcctttcatgattatttaaaaaacatgcatatattcagtaaagttcatggcagatatctctgctgagcctgaataaaacaaatggaatccgaaactgagaatttactcctttttatcctcattgaagagtactatgttattcatatactcaaagcacgattttccataaactgagcttttgctaaacatgattttacttttacttttgctaaagtttatggatgtttgaacctctctttgtgatttcctacttttccataagggttaatagttaatacttaatactgataaattgtctatcttacctctccaactcagacaactccacaagtctgtactctttaccttataatactataccaaaagtagtcaatattaaattattaattatgtttaaagataagttacaatttagaatcaataggagcttttcattatccacaaaagtcaaattgcactgaccaaaaatacaaaagtcaaatcgccatgaaaatgaaaccgaaaatgaaatttctaaatgaagaagtagtcaatcagtatgcatagaagcttctgtgggagttgtaaagccacattcttaaaagatgataatgcaataacaacatcagtggtagccaccactttggacagcaagcaaaagacaacaaaagcaaagaacataattagtggaatagtaagacaattttagcaaacaaataaaattcataccattattatgaggaggtgaagaacagtgcatttgcctgggctgcaaattttcctggagaaagtcatttccatcagtgcatgagtaaaaggagaaagtgttaaagaaaacataaggtccgaagtttaaaaaatcctacattttgaatattgtcattaggggagatcttccttttcaggtctttattcttcaaatggttgttacataaatcactgtcagatatggcctttcttctcttgtcaatgacaatgccagaggacaggtgatcttgtttctcatcacaaacattattttctacttgcttgtgctgaaaataagcactccttacaattacctttcttgttgcctccctgctctttccttcaactgagtcaaggactatctggtctttattcttcacatcgttgttacataaatcactgtcagataaggcattttttctctcatcaatggcaatgccagatgacaggcaatcttgtttctcgtcacaaacattcttttccacttgcttgtgctgaaaataagcactccttacaattacctttcttgttgcctcctcctggtttttccttcaactgtgtcttggacatttgtgtgcccatgcaaccccagacatggtttatgaattggctgcctgggctgtcgcagtactgtatgttcagggcttttcttctcttcacccaccatagacaattcatgcaaacaatgaaatgagtaattaacacatgtaaaggcataagggattttcccatccaaagcaaaccagcagatttatatcttaccatgacatggagactctgtaaattcagaaatgtttgtggcagaactatatcgaatctaaagaaagaaaggaagaatatgtttaaaaaaatatgtaagtctcactaccaacaatgagtagagttttcactgttatagttcaatattcaggcaacttacatggctattaggaggaggggcactgccccaattctcagagtcaataaccgatgcagtagagttctttgtttcattagcagcagtaggtgacacccgaggagctctgaatttccttttcgcttcaagagaagtaaaacctttcatggctaaggaaaagttactctaaagaagaatagaaaaaaaagctgctagctacaagtggtatgttgtaaagaaacattgagcttaaatgccactgaaattcattgcctcaacttgattgttttaaatgttatatatcttgaatctaaatttttagaaaactggtaactaaagcatcaatagcatcaggcagtatcccagtgaagcatagaattctgccctgcattcatcccctttaaacatgctaaacatattaaaatcaattcaagaagaatgctttgtaggatacaaaagtacttagttaagagattcttctgcacgggcaaatcaatctttttctttgcactttcagaatgagttttgaattgactagttcccgcaattgcaaatctggctgtaagattctctccctgccatttaaaataaatagatttttaaccaacagtaccctttaaacaagggtttaattgaaggaccatacacccatgtatacttcttaaatgcttttaacatttattaaaaagaaaggggtgacaatctattcatatttgctcagaacatgtttgtgaaggtgatactaactcccaagaaaaccttgtaccagtactataacataaggcaaacaaaatctactttatatgtagaatttacacaaactcatgcacatccatgcaaaccaaaggcaacggttatagaacactagcaacagtcttttcagttgttgtcaatcctattcctatcattttcaaaattcatttttttttcacaatcatgcaaattgtccttattccaaaaatgaacaaatgaaataagtcaatttattttgaccaacacatgcaagaaaaacagaggtatttcagtttactataaatttattctttcactttaactaacacacactttggtatggatgaagataaagaagaaattgatgatgtacctcaaatggcattttggtaattggatcaagatccccttttgctattctttgtgctatatcttttggcatgggtgtatcccaggttaaggtataacttcaagtaagatcttagatgattgaacaaaatggagcagagtgatattaatttaaaatggcaagagaacattaaaaatgaaggatatgggcctaaaaagtctaactcatcaccaatatcatcagatatattagacaaatgaacaatattttcattaattggatcataaacccgttgatattggaaagtaagtatagcttcttgaatgactcttcataaaagggaggcacagaaactccactatatctcaagtgcttaagaacctgatacattgcaatttgcattagaaatacaaaaattcatatagaaagattacatacaagatttataagatatatattgttataaaaaacacttttaagcatttctgttatgtgtatagatgtagacctggctgcttaagtgagtttaaacagggaaaatgaacattgattgtaaataaacatgcttgttagtttttatggttctgaacatcatgcttgctaagtgtatcagctgcactcaccttgtcataacttctaaattttttaatgcttgcatgggcccttttgagacccatacctggcaaggactgcagataatcacagccactcaaaatacacatttcaagaagcatttgtctgttgaacccttcaaaactaagctccttattcttttgtagcatggaatactgaaactgaacaccttgaccaaacttgtccattttaaagataatctaaattttcaaggaagaagcaggccagtcaaaaaccagtgagtactcaaagtaggaataaatatacactagtatagaaagataacaaaaaacatctatagctaagccagtggtaaacttactcttgggcaaccaaacggtataagatcagagtcttcagttataactgcatcaacttgtccacttattgccaagaatgtcatctgggcatctgcctcgtaaggagcaacaatatactgcaagttctcctgcttcaatacctttcaagaaaaaacaaggttaaatatttagttggggatttaatgtaattattgtattgaatatattcaaacgaaatacatatgtgatacacacacacacacacacacacttcacaacaaccagaccaacgctgatatattgaactcctttatacctgaattagttcaagtgcaatttgaggtgaaatatcaactgctttctggtagcactcataagcagcagctgaatttccatctgactcatgttcaactgcacgtgcaagattatcctttctagccctgcacttgtagcatagaaatatttgattcatttgcaaaagcgcaaatacaatcaatgagattttaaggttcttaaactgcccagaaatcaaagcactcctctttggtgatcttgtaataaagctcataacctctttatcccttaatatcctttagtacttaattcttttggtaaaaagagagaaaactacgaaactcaggccccataacaagatgttgttttcatgggtgctggagaagattggtttttcagtatcttagtttgaaagtattaaattattaatcaattctatccctaaatcattcagtattccatccatcctctgtatttcacattaaaccaagttcattttacctcaatttcagaaacagaaaagcaatcaaacaatgacaaacagcaaagaaaacaagtatgcatttagaacagaagcagaacattgagcaagtcaagatcataaacatggcattactgctattttcaacaaattgtgcttgtgaataagaacctcatgtaaacatgaagcatacatggagacagagctcaagaaagttttgttcaaaattgtcagcttatatcatttggagaattccctacatgcagacccactgtacactgaggaagtgaaatcccacaaagggagaaactaatgcaaatgcagacagctggtacaagcacagcatcaaatccttctttgaattttgaaattagataactcacagagaatcaaattaaaagaaaaatgaaaacggttatgacttgagcacattaagcttcttactctactcaatgtaagactcataacattgccacctcctttaaaaactgatgtttacggaggcttcacactatcaacagaaaccctgcctgataatagccccttttcctcacctatcagtattggtacattataccttaatctaacctataagtagcccttaccatagttcaacgctcaacaaaagcataattgttatgacttgagcaaaagtggagagtccaatccaaaagactagttcgttatgtaagagaacttcatagctagtaccacattactcaacataacatacatgaaagcatcccattaacaattaaggtgacactcaactcaacaaaagataggtttttctttttatgccaaaaaaacttaaaatacccaattaagaaaaaacaaagtacaatgtcgggaagacaaagagagtacctggcacgcttgttctcttgttcactcttcattggcagaagccctccatcaaacactagaataggcttaaccccaaaatggcgcagcaaatttactctgtgcatgcaatactcaatgtgcctaaaacacgccaatgcataaaccaatctcggttaagccattttggggtgccataaattcaactaaaccccctttaaaaataaaaatcgaacttttacgagcgggttactccaaacaaaaatcaaagaaaaacccaataaaataatggtaaagaaaagtgtgaaagggaggttacctggtagtgggcatccctttgcagagttcggtgctgcaagagagggcacctttgtggagccaagagtaggtgtctaccgctacagaacaacccttcagatccttatgtggattggaaccataatcgacttcaatagcggcaaaaaccctgattcccattcctctttctctttggagtgaaattacaatgactaacactacatttcatttcatatatgcactaaaattgggcgcaaagttatattttggcttgggtaatggcggagtttaatttaatatcttcgtttaacgttacttttgtttacatgttttaatttttatataaacattttttagagaatttatataaattttattgatactaaaaaaataaaaatttaaatatatgtatccctaatatatattaaatttggtatttgatttctaataaaaatttatttttaataacctctaatatttaaaattttatacgatatttttgttgaaagaatatgttattttttatgtattgttaatttataatagacaaaatattgtaatgtgattatatttgagttggaattattagaaataaaatttttattttaattataaaatattatttaaataaaaatttaattaaattaagagaaaggaagaagagattactattatatcattttaatatatatcaatttttattatctaaaatacttacataagactaaaatgacactttaattttttttatcaatttgatacatgttgatttattctatttatttatttttaaacaaacaggtattgtcatgtctcaaatactagaagttctaaaattaatttgatgattaaagagagaaaaagataaatttatgaatatgaattcctcaaaatagtattttaacaaaattaataataatatttattaataaaaaatatgtcttaaatataattgctagaaaagcatgtctcaaacattgtttatacatataatactaatgactccaatatataatatgataacatgaagtgataaatctaaaatatttttttattttatgctatgctatgcttgatgcacacaaaataataaatgatattattatgttattttgtttcacacttattagatataaaacaatgataaaataagatataaattttgttcaaaatataaattctctttcattaaaattgtatataattttgtaaaaagcaacttttaatttatttttaatttttattgatataaaattataattttattattttttaattcaatcacactatacaaaaataagataaacaataacacgaaaaattatattatttttgcactaaatattttattataaaggatatgataaatatcaccaaacaaatcctaataaaatataaaatttatattataataaataaatatttaaacttatagattatattttaaatttatgatagatatattattaaaaaataattacaaaaaatatttatgatagataatttaatttgattaagatttttttagttattgataattttttaaaataaaatttagtttaaaaataaagataaaataatatattaaaagagataagaggttaataccaatttctctaaaaattatctttactaaaaaaatccttctttttacgtaagaaaaaacatttcctaaaaattcttaaaaatactatttttaaaaaaatctctaacacacttaattagattaataattataatttaagtaaataaataatttcatttaaggtgttaattctgaataataaaaaatgaaatttaattatgattatataaaaatatgaaaaattagttttatagataattttataataaattaattataaattttataatttaatgttacattagatcacattttaagacgaatttgattaacaatatcaaatgaaactgaaaagggcaagaagaagctgagagagaggggatcatccatccatgtagggaagccaatcgattccttgcgcgtttgcttgcttcgatccacaccactgcactctttacttcaatcttctcaaccctacttattcattcattttccgttaagtaagggtttctcaatcgtactcctccatgctcgtagctcgagaatgctaggttaacgctggcttagcacgtagctctaacctatgaacctccggaacggttaactgtttgttccaaacccaccgttccgcgaagaactcgtacgaattgacgatgtgggcttagtttcgttctctgtttccattctgtttcacttctttttctaattgatctgctgtatcgtttccgtgctcagtgccaccatgcctcgtaaagtaaattacggactcgattacgacgacgattactatgatgatgattatgatgactatgcttatgatgatgccgatgcagaagacaatggttagttactttaatttgctttattttttttttctaatatgatgctttgtttcacttgtatttcctctggtttggtgtcagttacactttacacagcttgtttcacattggtatctgtttagctctgctacattttttccatgcagtttctctgatttggagctgtggttgttatttgttaggtttcttgttattgctactaatttttttactgactgactatttgaatttttacattgtttattgttgatttattttttttctgccgtagcaggaggacctgatacaaagcaagagaccattaagcctggggtttggcaatgctccatttgcacttacgacaacgatgagagtatgactttttgtgatatttgtggtgttgcacgccgtcccttggttaatactggaacttccaacagtaacaaaacaggtaatccagttaatgaagaataattttgtttgttggttgggttttttacatttgttttgtatgaaaagcatatctcttttacactgtctaaattctaaattacactgtctaaattccatttgtggcttagggtgtgggggagggaaaactccgttgatgtggtacatacaattcttttgtcattctgttttgatatgggaagatgggacttggaatgtaaagtttctaaattcttctagctttactaatatcaacacattagtttaaatccgtgagatattttatttctatactccatccctagaaagataagctgagataaaaacttatctgaaattctggtttgtttattacttctaaggctatggcacggttgtagatacaaaaaatagacttgttattctcacagggtaggattagatgtggggaggaagcaaatcaagaatgaagcaaggctttcccgtctctctgtttgttagaaatggcaactgccttaaaatggccatatgaaagagtctaaaagaatgaagctgcgctttcctgtctctctgtttgactatcatgatgctgtatatcttgttcatagagcacccttgagtggatttgagtgcagttcagtttagatggctattgtaggaagaaacaccatactgtgaggtgtgttaggaatatggacagaatactccttataagactttggcaatcctcctcccttgactagcttttggaagtgagttaggactaatccatttctaatatggtacaagagcctattcagtattaatgttgggtcactcaaatgtttagtcttgcaaaactcacattctaaatatcctgtactgggcgtgaggcgtgtctgttaagatgtcctacattgaataggaatatggctaaaatactccctataggacttgggcaatcctattcttctgagctagtttttgagagtgaactagaccctgtccatttttaattaattgtaccatagttttcttgacaatagcaaaataatgaccagcaaatttaaataattgagctaaattgataaacaatactgactctggtattagttatttttggttttaacaacttggagggaatgcaacgctgttcctaaaaactgatcattttgcatcatccagatacaaaaaacgaaaaatattaaactgttacaaacctagaattaggaatggggaagaaaagaaatattttattgaatagtatgaaaagaacaaggaatagccaaatagaaagagcaatctcacctccaagggtttccgcttcacaaagagttaatgctcaatttacaaatgatacccgatagaaatgaaagctttccccttacatcttatttatttaactcactaacccctaattatctaatcaatagggacaggatttctcagtgtttctggttgtttggcaattttccaatttatctttttatgtaaggttaaataataataatttgctaataaaaggcgtagcaggaggatgaggaatcatcaatgaaggaaaaagaataatttaatctttttgcaaatctgataaaaggagaaaatggggagggaggagagtcagagaatatgagaacatgtatctggctgcatagtgtcaggttttcaacaatggccatgatattcctataacctattgaacaatgtctttggtgcagttgaagacataagcaaaagtcctggagcatccaagttggccaggtctctttttcaatcattacaacaacagattcccaaagagattgtattatttccaaagccagatgatggttttctgacagatgacaataacttctacaagcttgaaaatgtccgaggagaatttcatgaaattcataaggcttttagtactcaaaggcatccacatttaaacataggtcttcacaagttttgattcaggatgtgcatgtgactagtttaaacagtttcttctaaatttgatatttgaaggttatgcaatgcaattataattagagataaaggtcttattagttgaagatcagagtttttttaatgagtaatgacatatcatgatttagtttctgcaagttgtaactccttgcacatgtgagcaaattacttatttattcttttttaaataatagttataaaaccatgccttttttttttttttttgtatacagatcctttcaagtttgatgttccatccccagatgatgtggtttatactggcctacgttcttccaaaacgggtttgaaaggtatccttccctcaacaaatctaatttgcctatagagctcaagttggacaaaatgtgtttaatagttgagagagctactaaccatcatttaacctgaaagctcaatcatttttttgtggttcacttcaatattttctaaaaactttcaatccctcccccccccccccccccccccccctcccaaaagagaattatcattatcagggaattgattaggctttagctgttcaatttcaatatgttccctattaaagttgtgtccttgaatcaccctcgaaaagatttctaattcctggaggttgttttaagtccaatggcaggaagctttcattgattatgatagtcaaagtaattggaaatatctcaaggccaaactgggatttctaacaaaatctttatcacagtagctttcacccaaaaatgaaaatatatttctaggaaaaactgtttactttttccatattttctgtcttcaaattcttattcgttgtacataaatattaatccatcttatttgtgtaatgctttcagacaaagctacaaacactaaaatttctcagctttcatcaagcatcagagagaagaatgaactttctgtacaatcaaatgctgaaagttctgacaacttatcatccttaacgcaaaagagcagacagggtagttcagctgagagcaaggtttccaaaaatgtagcaattgatctacaaacaagtggtaaaacttcaaacagcttgccagaatctttgtcaaaagacaaaggtaacaatattaataaaataaattctttgaaaaatggtacaattgatattcaatcaagcaaagaaaagtcaggtagtttgtctgcactgtcaaaagtcaaggaaagtgataacattagtttctcttctatcaaagatggaaaaccagaaagtatttccagcagtttcaacaatatggctctcaatgtaagatctggaaattctgataatactaatgctaagggaactcgctcacatgtttcttataagccagaaaaatggatgctccctcaacaagctgaagatacattgactcagctgaatcttgcaattgtatgcaaatggccaattcttttgtacattccaggaaaatatttctcggaatcaatgacactaaattttttggtttgtctattgtaggttggccatgttgattctggaaaatcaactctatctggtaggttactgcacctattgggacggatttcccagaaagaaatgcacaaatatgaaaaggaggccaagttacaggtaatttcactgtggtcatcttttttgtgcttttaaagcttgatgtttctgaactcatgccaatttctgatccttttttttttgttaatcagggcaagggatcctttgcttatgcttgggctcttgatgaaagttctgaagaaagagaaaggggaataactatgacagtggctgttgcttattttgacaccaagagatatcatgttgttgtgctcgactcccctggccataaagattttgtcccaaacatgatatctggggcaacacaagctgatgctgcaattcttgttatagatgcctcgcttggttcatttgaagctggtatggatggcagcaaagggcaaacaagggagcatgcacaacttatcagaagctttggtgttgaccgggttatagttgctgtaaataagatggatgctgttgcgtactccaaagatcgatttgattttataaggcagcagctgggagtttttctccactcttgtggtttcaaagattcttatctatcttggattcccatgagtgctatggaaaatcaaaatttggtggcatccccttctgatgctcgtttaaaaaactggtatatttttttattactctagatgtgattttgactttccatgatgggcaatgaagagggatatagaaggggtggtttttttaatgtaaatttctgttagaaaccatacttttcactctgtaaatttgatatatcattcatggtgtctggggctcaaaagtaccatttgaaacagcactagtaggtgatttctacctcccaactctttggtacagacatttctcaacttcttttctctgaaacaaacaaaaaaaatgtatttagagaggacatggtgtgcttacctgtgcaatgtatggtgatggcttttatactattaaaaaatgggaacctcttgttagaggagtattctgatcataaaccccccaattcccaggactgagtatttagagcataaggtttgcagatactttttggtaagaaagatggatactatttaaattggaaaccgtgcaattggatagaatccatactgttacaatggtactgccctagttaatataaaaacactgatagtttggcagcattcatgatatattataaatttataataggtgtttatatactggcaatctatgcttgcatttagtgtgataacattttagcaacaagtcactttcattttggttttgattgtatgcaatttgtactgctaaaagaatgatggttgtgttcattgtgaacaggtatggtggaccttatctattagatgcaattgactctctccaacctcctactagagaattctcaaaacctctactaatgccagtatgtgatgtcatcaaatcaactacacttggacaggtgtctgcctctggtaaactggaagcgggagctcttcggatggatcaaaggtataccaataaggcaatgttatggctgttatgaaaaatcaaatggtagattaaatttggaattctccaaattaagtgttatttaccgatatgaataactgtatttctgctagacattaataatttttagttaaatattttattctgtgtttttactgtattacatagagagaaataaaaatgttgaaaaaggactcaaaatataattaaggaccaaaaacttgtgagtttaatttatatacagttagtataattttttatacatactttcaataagatttgactattttattacatcatcctatttgttaatatgatgtggggatatggtagatttttattgaatgtatgtgtaaaaatatttcatgctgaaagtgtatataaattaaatcaaaacttattaagcattattattttataaaacaaatgtttacttgatgaactcattgaggaagcaagggatgttatctaaaattttattcaggaaaattgtctagcatgaaaattgagataataatgtctctcaaagggcacaaattttgattttctagctttctacttttgtatcatgcatgaaactatttgtccataactgtaatttttgtttgataaaaaaattgtaggtcttggttatgccttcagctgttgtgggaacagtacgttcattggagcgtgactctaatgcttgtactgttgcaagagctggagataatgtagctgtaacgttgcaaggtgtgatggaaatcatgtgatggcaggagatgtattatgccatccgactttcctgttgcagttgctaagcatttggagttgaaagtgctagtgttggatggtgcaagtcccatattggtgggcacacaggtgtgtactacagatgcgaatgacgttcttgcactttattttccagtttttttttttttattggaggaaaaattgtattttattttttccatctctgcagttagagtttcacatacaccatgcgaaggaacctggtagagtttcagaatattatcagtacttgatcccaagacgggtaaggtgaccaaaaagtcacctcgctgtctcactgcaaagcaaagtgcagtaattgaggtgaataaacaatgcaaaactcgttgtttcaatgatcttcacttttctgtcatctatgatgccgggattaataaaacttagaaggacttttattgtgtctgatttttaggtgattttgaatgagacagtctgtgtggtagagttctctagttgtaaagctcttggaagggtgtccctaagatcaatgggaagaacgattgctgttggagttgtgacaagaataatcgaagaacaaggttaatttatgctattcatcaaataagataaaatgatgataacaaggagcgattctcaactacataccatgcatctttgtttgccatcctagtctagattaagttgtgctcccagacaacaggcagctatacaagtctcgatgaggttatggtttaatatgtgaattatgaattatgtaagaatggtgaagattttttgtatgtttttcaccatatatgtatcataagagagcgtttcttttcaaaagatctagacttatgtaccatagcaactagtcgaccgcgtcggatgcaattgcgtttattctttaatgcccaatcttcagcatagattgatctacatctgcatatctataatcaaattttgggcttggaatggaaatttcgtggtattttccttgggaaaggcatttctttttctactacagtctcttggttaagtaatgtggttgggacagtctagtgaatccctgaatgaattggactaaatagtttttttttttctttttctttggaaggcttgcacaagtaaccttaatggagtcattaataggtatgtttggaaggaaagaaagggttaattttttatttaagagctatataatatttataaaataaataaaagcttaaggcagtaagtttatgtggggcaaagaaaaattaaggccactatgaggaaagtgggctgtccatgcacttggggccgaaatgacacctactttcagttgccttttcgagcaattgtgatgtttattttccatttttgtttttcatatgtatcattttatcaaattagttttgcttgtaatatggtttgatattaaatatagacatttcttaatgggatttgaactatagttagttatgtggttgcactgtttcctaggagtttgagaggattagtcttgtgactttcgcatgtgtgaatactttttttaaaaaaaaaaaaaaaaaaaaaaactatcgttggtaggaagatgctgatttaaatcatataggttgcttgacttctatcatgtacaaggaataataacatgctggtctgcacgtgtaaccttgtttttcgagttactttgccaggatctcaatccatctatagatattagttacctcctttatacctcgaagtctaaatttgctcttgaagaaatgacagcccatattaggaccaaaacaaagccagttaagcatatatctattgtgcattgcacccttcattccattgattatgtggatatcctcaaatcaggcaaaaatttggacattctctggtcagttctgtacaatccaagatatatacagttacatacagacatatcactaatcaatttgtaacaaatactcaaagttattgccccctttaattaaaattcgttaataagaggacatgaattgaactgagtatatgtgcagattccattctctacaatgttttgcctttttcattccctctcttgctcgtttttattctaagacctattatgagctttgccttagaaagaatagaaaagaaaaacttctctatatgaataaagataaagaagtaatttcagtcattgatgaaaatattttacaataatattctaacaagtctgcaattttattatcaactattgatattacttattttatcgaataaaatgagttgctgattttaaaaatgtcatatccattaaaactaataaaataagtaatgacttcaacaaggataactctttgtagcatccctattcataccataccaccatatgtgaccttcccgggaagccacttaattatttgctcaaatcatataattgccagcttatttccttctattgctttcatcagtgcatgaaacgtctagtgcaccaaaagatcatcatggtctctccatcacttatataaactccatataaagagacatcttctcacactttaaactataaaattttatagcaaatatggtaaaatatgaaacctatctgagagtctcagtctattgctggcctctctcttgatgttctcttggagtcactgctgagggaaatttctatgaagatattgagataacttggggtgaacatggtggtgtaaatatactaggaagcaactctctcgtgctttctcttgaccagtcctctggctctggctttcgatccaaggcagaatatctatatggaagaatagatatgcagattaagctgtctctggtaactcagctggcacagtcactgcatattatgtgagaaatcctctgattctgttctcatgttaaatttaactgttttacatttaatgccgttaatacatttcatgtgagaaattctcgtgtgcactaaaccaaccaacattaaataattatacaaatctcgcgccacaaaaatattctatatttaaaaagtgatcatgcatcaattgttaattggcttagacagaagaatccactgttttgtatgtaactttttagtttaataggtatgccctgttagtttagaagtctttacattgttaatcagttttttttatgacttttaatataataattataaaagtcaacaaatttatcatgacacatgacgatttagttaaatcttttattgttatcattagttttttatgattttatataattataaagtcaacaaatttatcataacatgacggtttaattataagtcggataacaatataaaaaatctttagattatctgtgtatctattattattcataacttttatgatgcttttgactgagcttatgtgacatggtgcagttatcttctgaagggccaaatcatgatgagatagattttgagttcttgggaaacctcagtggagagccctacatagtccacaccaatatctacacccaaggcatagggaatagagaacaacaattctatctttggtttgaccccactaaacatttccacacttacactattgtatggaaccctcaacgcatcatgtaaggaacataaagctttcattgtccatcaatcctataatttaattctctaaaattttactttggatatcttttttctctatgaaattatgtttggtaaaaaaatgaaaattttcatggaaccatctatgatccatatgtaatgtataactagaccattgatcctctatgtttcaacattttggctagtttcatggtagataatatccctattagagtcttcaacaactatgaagccaggggagttccatttgctagcagccagcccatgaggctatactccagtttatggtgtgcagatcaatgggcaacaaaaggagggcttgtgaaaaccaattggtcttatgctcctttcaaagcttactataggaactttgatgctaaagcttgtgtgtggtccaaaggatcatcttcctgtccttcaaactcagcttccatgctcataataatacttggcaagctcaagatttggatgcttatggtagaagaagtctgagatgggtgcaaaaatattacatgatttatagctactgcaaagattacaagcgattccctcagggtcgacctcgtgaatgcaggctttctagattctcttgagtgtgggataagtaaatttaaaattaatttgatgatttttttcatttatgtgtatttaaaattccactcaaatacggttgaatttgagtaagttcaatttgattttacttttgcttgcttgaactgataattatatctctgtttatttacttatttttcctattctttctaaacaatgtaaaattattaaaacgaagtgaactcttcattttaaaggtgttccaaacatacaattttatttacaaataagttcaatcccatatttacaatgaaaaatgctaatcaatactcttatgacacaagttaaagaataaaaaataaaaaaattattattagagtgcactgttttgtaatttccaatgtaacctcaacctattttcaataaacttttttatttattgattccttaactagtttttcaagtacacctcgttaacaaaatccttttacagtacgttgaaaaaatgataattgattttttcatcaaatcaaaccaattccattcaaaacgtgagttatattattatttatttagtgaaaacgttctagagtaatttaacagacaactgatataaactctcgataaaaacaacaaaaatgaaaaaaataaaaaaaaaaaaaaactaacaacatataaaaaaaaaaaaaaatgaacatgaacatgaaaaaatcataaaaacaaatctccaataaaatatttctactttaatttcttaattattatccttaggacactcgttagcattttttctataaataaacatgagacaaatgaaactgttcaaggcagtagaaaccacactgctgatcatgatataatgacttagcattagagtcaggttcaacaaattcaaagtgaataacactacttgtgcttgagaaagcttttatctgcattgtgtgttcatgcacaaaaaagaatttcttttgtagatattagagaggtcagaattggcttttgaggcagtatggaaacaactcatgggtcgtctgcatgatgttatgaggaaacaaatattaattagaagggggattaggtgcttctatttagcaaatcgtccataatgctacctttgtagttctggaagcattgaaacaaaaagtaaagttcaagcggtcatcactataatatatatagcaaatcgatgtacagcaaatgatttgatccagagtacatcaaataatgtacaaaaaattcaataatatattacatataaattaaactactaggaccaatggcttcattccctattccaaccataaggtatattaatccataactccaataccttcaagcgacaaaaaatctttcatgtgttacagaagagtatcgactccttgtaccaggcaccacaaatttccccaaacctacaattcatgagaagcagttgggacaaaattttagagacgcaagtatgaaacaaaatggtgagaacataaaaaaagtaatatcagagaaaagaaaatcaaggctacattgttggccactatgtttttttttttacagaaaaataaaaaaaatataaaaaaaggataagaaatagtcgaaagcaaagcacattaggaggaaaacaaaacaaaaagtaataaaatacagcagagcttcccaacctatgtactccaaaattttgccataaaagtttgacctttatctagtagtagaaactgctcgccaaccaaggatcctaaacaaattttcctataagatggtaactgtttcacaatgcaattgcaaagcaagggtccaattgtttctgaaagcagtcactacgtatagtgcctgcgtggaaaggcgagagaaaagctctaagaaaaaaacatttcacaccaaacatcctccaaaagtctgaagcggagaaaacctctaagaaaaaacatttcacacccaaacatcctcaaaaaatctgaagtgaggattacccaacaaaacaacaatagtagccttatcccactcatgaggtttactacatggatcaccatcactaatagacttggttaaaaaccaaattcttagggatattattcaagtgagaaacacccacatgtagaaaattattgctctataaacttttgattgataaacaaaggagtttatcaaatattcaatactttaggcataaaatgcatatctgcacatattggccagaacatataaatgtttgaggaggaggaggagcaaggtagagtagttatcaatagcaaccggaggcccaaaagcacagagaggggcactaaattggtatagatggttgaatgggttgaaaaatcctaaattggcctcactaaaatctcagtcagcagtatcaaaaaagggattctcaatctctgctaggatttatgaaacacctatttcatcccagtgtagtccccatcatcacctcatgcttgcagtctacttaggttttcaatcctatttcacatgaccatctctgttttaaccccacctagcctcacccagatccatcctccatttttacactatcgctttgtttcacactcgcacaaggtttcatgttcaattgtattacactattaccagtttgtgaagtttttatgttgtatcctctacctttgatgtgtgtttgccacaatcagaaaccattcaatcgtgcaagaagtcttgctcttagcagcatttcccttttccaaataacttccacctaaaaaggaccagaatgataaacaatttttgtaaacgaatactaactttcaatttcccccctaaaaaatactttcttgtatcactttggtacattgaaagtttatcaaaagtgtatccaaaatcacattcgttagaccttccatctcctagtatgctagatacactaatcccctagttaacttgtgatatgttattctgttatacacttgccaatagtattatttacataacgggtaagactttttgcacatgcatgtattgcacttttgaccaactgaaattattaacatagtttcaaattcaagggtagatatcagcgaaggattagtcaacttgtgtatttacccattagactattgattaacaaacttgtggtattattttagaagagaaacaaaatcattatacatgggtacaagcaatcttcacggaaacaaacaggcaaaaaataacaattgcaatccacctccaaacttcccaaccccaactacccaaattcagatatatcttggacttggccatatgcaattgaacaattgaagaaaaaaaatggaaaaaattaaattcgtgaagaaaggatttattttagtaggccctagaagtccttgcatcacccatccaccatgtatatgcttgcaacataaagtagcaattttacctctactccaataaactatctcatacttacaaagcaaatcttccagatccacaagcacatgaactctcgcgacacaaaggcaacataagaaataatcactacatacattaacccacagacagaggatgggtgctgcacacaacacaaccttaatcaaccacaacattatacaatcaacattttcttcaccaccttccatccattaagtagcaaagataaataatactcatcaatctatgcatatctcttacatcactttatcaatcaaagaaagaccccaggcataaactagatcaaatccttggacaataactgtatgctctagcaccaagaataactacataaaaataccccagaggagaactgctagcatattgaaaatgaaatggagacccacatcagaaatgctggtaataaacccaaagtggtagtgcttactcagagacataacaagttcagaaccaaagaagaggctttaaaaggaaaaaaaacaaaaaagacaagtactttaagcatcaaaactaaaaccctatgagaatagaaaatgagggagaaggaggaaggggataaaagttacctttagagcagaaagcatgtgctgaggatgtgggtatgaaaaatgccatgggactgggaagagtgagtgagtattcgctgaagaaagctgagcgaagaagagaatgcaggaagctgagaccttatattacagaagtgatgagaggctcttttctttttccgaattccgaggtaatgtatttggtttgaaaatgaaaagccccaccactggttgtgttgtgttgtgtgctgtgcacccattgttttttcttgggtgctgagaccaatggtttaagaacatgaaactttgttcaaacaaaaaaaaaaaatgaaaataaaatataagaagagggtgaaaaaaagagagtaaagtgccaattttttgcatggaattttcatccactgtagttttagtctttaaatttagggaaattaaaaaaatctctcaaattacatttcatttaatctaagtattaaatttaataattgttgtcattttattctataaacatgtattaatattattatttaagtgcatgttccaattgtgtttcattaatataatagaattaattgatgaaagatgaaaatgtcgataacgagttttgttgagcgattgtgaaatgaattaacatacaatttgtggacccagaggttaaaatatgcgatttaaataacggaaaatcaattattttaaaattatatttaaaatgattagaaaatggaaacaaaaccatatataatttgatcattttgagccaatacaaaatcttttgaataagggacgacactatgtatgagattataattttcgatatgaaagataattctaaacaaaaataatcaatttttttggttattaaacctactcacataaggtataatgatatttttgtgtctctatttaattttctcatacttatctagttcttttttatacaaaagtcatgtcaatctcatctttaccaaagaactttcaaatattattttattccaattctcacctatttctcttaaatcaaacaacaacaaaagcataaactcgatctactctaacataagtcacttcacaaaaaaaatgagtacttgtttccggacaaaacattttacttcatttctcttttttaaaattatctcttttctattttcatttattctatttctctcttctaaataaaaatatacataattttaaattaaagtaataaacatatcataattgcaggatttttttcataccttgttaattctagatacttaaatgacaacaagtcacaatttcatgaactaaactcatcattcactaaaaaaaaaaacaatacaaatcgggggcagttggtaataggcacattaatctctggtgtgtccagagaccaaacaagttttaactacagaaaaaatattttgataaaaaaacgactatggaaaaaaattgctttcattttgagatatatttttaaaatgtatatgcccaaaaaaaaaacacagagatgattatatatgagtgtgagtgtgaaatgcacatataaaatgatcgtaaaaaaaaaaggattaactacaataaaatataaaaaatgtaaaataatttgtatgtaagtatgtacatcaaaattaatccattatgtacaaaaaattaataatccatttattaaattacagtacttaattttagattgttgcattcttgcctctaaggacatatttttgtattcctccccgtccagggttatgtggtgagcgatcttaactccaaaaaaagtaatgatagataagaaaactatctaaaatcatttttaaacaaatgacaacataattgacaaaatctaaaaaagataagataaaaaaaaaaagaataagtaaaataaacaactttacctccttaaatgaatccgtgccactaactcgaattattcaaaatgcaatataatctcaaatactgaaggtttatggactattttttatatatagaatatcctaatacatatatagatgtactcctatttttatacccttaagaattattaaacgcaaccttgatattttaagagaaaaaaagcttagcaaaataaagcaaactagttattaatcataatcacccaaaaaaaaagctccatttaaaagtaaagtgtactctacaactaagtataaaacttgatcaaacagtccccaaaagaacatgatctcactttagggtaatacatggcccagtccattagttctgtcttgcggatcacgatcctcagttactagaaaatcagacatctctttccattggacctaatgacatatagatacggctaaattgggattgtataaatttaaatcttatcatacttcattcttccaatatgtactaccacaaacatgaaatgatcatcaacaaagacacatgtattccaatcaatcaattacaatacaaaatataaaagtaaacccgtgtctgtggccgcaaagtaaaataataataataataatggaaaaactgtccgcaaagctagtgtcaagagtcacccttgagcaaggacagaccacatgtatattaccccagagcttaacaccttgtttttcctttttcttcattttggggtaacacttccatcaattccactatccgctacacccctttttcttatcctctttgagcagtgcagtgcaaaaccaaatatgggaaacaaacaaagaatgaatagcacaagatgagtagaacctagtaaacttcaccagccatactgctagaggggattctttgtcgtttctccacatatgcagaaggaaaccatcctgctttgccattgcattcgccttctgaccatcctgatgggctcacctgggtaagcatttggaactttggtaaacatggaggctcaaaaagattgagagattaaaccaaattaatcaagcaaatttcacgatgacatgacagtgatagaagcaacaattgatgactttatacaaacctttcgcacaacaacaaaatcgcccttagaaaagctcagttccttttctgattcagcactgaagggatgcgttgcctgcaagagacgcacccaagatcagttgatgaagaaataatagtattagtaatagtgataaatgataatcatcacaataatcaactgaaagattaggtttaggaatttagcatacttcagccaagaagtacattgttttctctgtgccattctcagaaatacctactggaggggcagattctttcttctgtctatctgagaccatctgagaagaagttccaatgagatgaaaattattgaattacgaaaatgaacacaattcatagaaacaacaccacactcgaagaaaaataagcttaaaatttcaggacagttggttctcacctcagcttcaatttcaccaagaatagctgcaactcttaaatgaaaagtcttttctccttcaacctataaaattataagcacagactataaataaaattctactccctccattccaaaactattgatgtttaaggttagggttaaataagagtaaaatattaatttatttagtctataatacccttaattaatacaggatataaatgtggttcactgtttgttgaagtggtcattaaataggctgtaagtacaatattcctcttaaagatcaaatataattatttaaaatatgagtacattcaatagttttggaataaaaagaaaagactaaacaccaatagttttgggatggaaagagaaaaacaattacaatttggcataaaagtacataaaaaaaatcaagtgttatcataccatggcaacaagcctttgaaaagtaagtctctgctgttgtgcttcaacagcggccaatgccgctgcagcttctttacctagaactgccatgtttgccttcagctcctgcatccttgcttctgcagcatgcagtttggcaacctgttcagcagttggagcttcccgaacccgtgcttgtcttctagcaatctcctctccctgattgaattttaaaaccattccaagttatatgattaagaagaaacaagtatgaacaccaaactctgaagtgaatgtaaatatgtaatagataagaaccaaggattcaccaaaaataaaaagataagaaccatgttataaaatggtagtcttcaattcatcaggaaaaaaaaatgaaagagaaatgacaatctgtgacagcatggaaatcaaagcaaaatggaaaaggcaaagaaaagtatctctcagctaccaaagttgtgagcccaagcaaatggctgaaagattcccaaaatgcagtccaccacaacaacctctcataaaagctatttctaacacaactacatccactcaacaatcaacataacaacctcctctcatatttgaatcctatagtgtccactctttccttcttgaataaactcccatatttttggtccatggcctaattgacccagcacctgcccatatcttctttgggctcaacttctcaagctctatcaacattgttatcatgtaacagctatctggagtctttctttatcaataatttcaacatatattgtttctgcctttctggtttatcatgcatcaaacaaaacatgaatcataaacttcactattcattccattccatatatgagaatgagatacagagttcgaatcacaattaagttaaaggttgatccaagagcagagctactaatccattctaaactttgacttacttgtgcctctgcttcttgtctcatccgactatatcgttgagcaagatggcgagcatcctccaaaggaacaccattgatcatttgcctcaaaggatccaatacctggaaattgaaaccattggattcatgtttctttccttatacatttaaagataatgcaaataataaattacattgacctcccttgaggattccaaatgtcatatagacttcctctgtagtatcaaaacatacaaatgttccttagattttcaccttttctgaagggtttcaagagtggcacatgtttgatcaaaattaaaaattgcgctatgtatggcttgaaagtaggaggtcaatgcagtatttaataaccttaagagatatcagtataatttactttaacatataaaaaaaagtataagcaaattggctgtattctatcttccaaactatctcctatgttgaatgatcagtttgatactcataacctagagatccacatcagagtttttttaaacattagtgtcttgttcatctgaactaaaactaaatttcacactgaaaaggtcatgcaaagtaatattgaaatggtgacctggtcccccatgcatatcatacacaaacagtagcagaatatggctatttatgaattagaatatctaaatccagcctcatttatggtcaagaaacactatatactgaaaaatatagttaaaatagcaacatggagattttaaactcctctgtaggtcaatgaaaagattctattactgtttcatattttaagcaccaattctttatcaacttttttaaacaactacttactcagctaatcattcacttgacaattagaacacaaaatttggtcattttaggacttcatcttactttattttccagtagactcttcaatatgattaatgtacaatagaaaaaacatgacagtgattgcttacaaagaatgccctagaaattgtagtttagtacagtaaatatcaattgacaatcaacatcaacatcaacagcacctttaacccaaattaattggggtcggtggtagatgaacccaatgataaatcgaaaataaagcaaaagagagaaacagagttaaatataaaagaatggtgagaggagaagagaaaagaggaagaaaagaattaaaacagggaacaactggaacatagaactactaaagggtttaaccctccatcagacttatagcttttctccactccgtcctaagacataccgtccgccaatctaaatcccactccattaggtcttgtttaactacctttccccaggtaagttttggtcgacctctacctctctttgtatctagctcttggtaacatactcttgttctaacaggagcatctaatggtcgtctcataacatgcccaaaccatctcaatctatgctctctcatcttttcacatactggtaccactgatacctttcgtcgaatatcctcatttcttatcttatccatcttcgtgtatccgcacatccaccttaacatcctcatttctgctacctctattttatgctcatgttgcctatgtgctggccagcattccgctccataaagaattgccggtctaacagctgttctatagaattttccttttagcttaataggaatcttgcggtcacacaaaaaccccgatgcactccgccatttcatccaccctgctttaattctatgacttacatcctcatcgatctccccacctttttgcaacattgatcccaaatatctaaaaacgtctttcttgggtacctcttgcccaagcagatgcactgtgtcttgctcaccgtctttaatcctcgaaaactcacacttcatatactccgtcttgctcctacttaccttgaatcctttagactccaaagtgcttctccacaattccaattttctattaacgccatctttggtctcatcaataagtactacatcatctgcaaagagcatgcaccacggcacttcttcttgaatatctttcgttagttcatccatcactaaggcaaagagataaggactaagagctgaaccttggtagacaccgaccgtgatagggaaataccttgatgttccattacaagctttcacacatgtggtagccccatcatacatatctttgattgcattaatatactttaatgctacctttttcttctcaagagtccaccataagactttccgtgggactctatcatatgctttctcgagatctatgaacaccatatgtaagtcttttttcctttctctatacctttccatcaattgtctcatcaggaaaatagcttccatggtacatcttcctgacataaatccaaattgatttactgaaatcttggtctccctccttagacgatgttcgataactctctcccacaacttcatagtatggctcataagtttgatgcctctatagtttgaacaattttgaatatctcccttgtttttgtaaataggcacaagcatacttttcctccaagcatcaggcatcttgtttgtttgaaaaatcctattaaaaagattggttaaccattttattgccacatctcccaatcccctccacacctcaatagggacatcatcaggtcctaacgctttattattcttcatcctctttaaagtctctttaacctcatatgtattaattctgcgcacaaatcttctattcagatcattagaaacgtcctccaattccacctcactcttgtcaccatttccattaaaaagattgttaaagtagtgtaaccatctttcacttacatcttcatcccttaccaaaagtttttgattttcatccttgatacatctaacttgggtgagatctttactcttcttatctctcatctttgcaagtttataaatacctttttccccatctttgctcccaagatttttatacaaatcatcaaaaacttttcctctagcttctcgcactgctttctttgcatcttttctcgctactctaaatttttgcaaattctcctcattaggacatttatgcaagaagtatagaaaaaaaattcatatttcattaaaaatatcgtttagttaaaaatattgtatttttctttcaaatacatgcattgtttctaatattattaataaacctagtaattattattattattcttgaaagttgcttttcaaactaaaattactcaaatcttttttatgttacatactaaaatcttatttgatattaactatgttatgaaataatttgaatgattttgtcattttatatattgacagtaaaatgctagaaatactttagactttcttataaaactttgatcaataatttcgtaattgataataaaataaaatatgacaaatattaaattaaatgttaaagaaaaatatagaagagagcacaaaacagagagatgaaggatctgtattagagagatgaacaatgcaaggacagaacagtgaacagcacggcagcaaaggtcgcggttggccagaaacagtgacaggttcgccagaaaatggccataaaggtcaggaatgactggaaactatggagaatagaagctgcagaggttggggatggcaaaaaactcacataaggcccgaaaatgcagggaattgccaaaaatgttgccagaaaagggtgtcttggtggaaaaaggataacaatatgtcataacagtgtgtgtaagtaattgagaaagtagagtttcagttgtgattcaaagaagggggcaaaatcattgcccactaaaacaccctaaataaagttgtttaatggttaaattaaaataggtttttttgtgacccactccaataaagcctgctccaggagcaatttctgctattttgctagatatgacagctgtgatggtcgctactgatacacttttcaattttcatagcatgctctagccgctctgcaatgcaattctgcgctagcaccactatttgttgctattggcaactagtcatataaaaactgaaaataattctttacgtgaaatatgttaaatacattcagcacattgctgatactgaatgaataaagcagcaactacttccctatctgaataattaaatgacataatttcctttggtgtcaccatgtttagcatctaaatgttttaagttttcttaattaaatgagtttttcagcacttaaaattataatcttttcaagcaaaacacattcgacgtataattttacaggtttatcaaacatgcctttaatgtaagtaaaccaactcgtgcatataagaaaaccaaaagcaatcaatcacgaacggtgacaaggcatctcaaacctgctttattatcttttttgacgcatcttgtaatatttttggctcagtaacgactttccgcttttgggcttcactgtttgaactacccctacccacagatgaaactggggctaaaggtgacaaaacaggtatttccaaagatgactttgctatcgaatgtgtagaacttgaaattccctgaaaggaaaacattcaagtaatacagtacgaaaaatgaagctaagagggtatgatcatattagcaaaagcaattcatacagagatacaaaatagtaaaaataagaatcaactcattagtcattggaaaataccaacatgccaataacaccatgcaatttgaaaagaggataactaaaaattacctgatacgtcgtattgtgatgttcatttagtcgagtctcttgaagtgcagctagttggttcatcatgtcagcctcctcgttaattggtgaaaaaattcggtcaaaataattgggtcgaccagcatctccccactctgctacattccatttcaatgcttcccaccagatgctttctcctttgatgatcttcaaagatttgcttgacaactctgatttggaaagactttggagacttgggcaataataaaatatcatttcttctataaaaggtccaacatgtatgccattgaaaatgttgaccaattcaggaagatagagaagcgatatcattctcaacttggggaggaaaaacactggtttttgttctggtgtggcatgacttatcagggtggttacttttggacagtcttcaataataatctcctccaaaaaggaaagttttttaagagaatctaaggtgaagatggtggttaacatggggcaagtgtgtaatgctatagactttaagcagagaaagaagggactactcccttcgcagacgcttcttaaattcttcatatagaatacactcaaaaacttcaacattagagaagctggcctatcaggtgaattgcttccactgacaattgtttccatttcattacactctgccaatatgcatacttccaacccccataaagacaaccttctttgacaatattttaaaaaaatcatttgtatctggaaaatatagttttatgaaattacaacttaaaacttttcaagactggagttaaaaaactgacttaattgggaaaaagcacagagagtgatatgtaataccagtgcacagctaggaatactcatataaattaagatgtggctaagagataaaactaatataatcttgttttgaacttgtacacctgaacaacatatgaaaagtccacctgtgtagataaaagccgatttaattcttcgtgctccttttccacatgcttgcgggcatcaccatatactgatgcagccttagctaatatgttgtcactgttgttctctgctccatatttacagcaatcctcagaaagtttcgttcctgtctaccatgggtattgtttatgaggatttaatcaaatcataagtcgataaacaaaacttacaggtgcttctcattcctgaacacatgctatcaagacttgtcaaagtaaactgaatttgcaggaaaaaaagaaacaaaagctaattttcacctgtttcaatatgcttataacctatagctgtaaatgtttctgctgctttaacaatttctttctggaagtcctggatcagaggatagttttacgcacatcaatatacataaccaccacgaaaagacaaatcatttaagataattttttttatgaatgttgtatgacaactactacaactgtggttcagaaaggctgcacagccatgtttaagttaactccacccccaggttaatttatacattccccatctctctctacatcacttaaggtaaagctgattaatagaccttccataactaacatgtattccaagagatataaggttaaatgtaggatatcaatgtttggggtaatgacagcagctacaagaaaatcattcaggataactacccccaacccttcttttccaaaacctctttacaaactgccaaatccaagcttgacataaaaaatggatttaaaagttgttgcaaaaaaaggtttaaaaaaaatgtgagtccataaatctggcaagcacagtaatgtcactcaccatgcatgaacattgaatagacttccctaataagcatatataacattctattttgagttaatatgaaataggaaattccttgctgctcaagcatagcaaagctaacaatcaatctaaacacaaagagaaattgcataccttcccagcacgtgtggccctgtacagcttttccagctggtggtgtctctgcatttcgacctcatcgatgaccacaacatctgaactctcataaccactactgctgaactgctttattactgcctgaatcacaagtacactgacaaagattacaaactagcaattggaaaacattacttttccctgttactataaaagtgtgaatctaaactaataaaacactatggttggttgatccacaagaatgtgccaaacacaaccagggaaataataattcaacatcttgcttaagaaaatgagcgtctccacttaaaaaagccataacattagtcgaactaccccattttcaattgcatttcagaacaacgaaagaagaactaaaacgtcaaaagttatcgccaaatactgggaatttggggtacccagatgcgaatttgagaagagaaacacggtacttgaagtgacaacacagaaaaagacaaccttgaagggaagtgagagcaaacctgttgctgtttggcaacttgctccctgagcttgctggcttgtttcctcagagcgtccatggcagattctttcagctctctattcttaattctcagaatataaaagacagacaacaaagtatgaaatcagatccaacgaatgttatctgagaacccagccccagctcagctaaacgttgtcaacttgaattatgtcactcttttcccctcttttttcttcggtaaatcccaaaaccgtatgtgtaatatgtaataagaataaaccatatatgcaataaaccatcaatttggcaatgatatatcactctctcttttaaatatattcttaaggtattagaaattatgttatataattttttaagaattgaaaaaaatttcttcaaattaatctcctagtattagtaaaatacaccaatccaaacactaaaataaaattatagacatttaatactttccaaaagagagagagcatttgattttttattaatgaaaataatttagtttctcaactttgacgttaataataataataataataataataaatcaatagttacacaattcttttcctccacttattgataattatgttgtcttaattttgaatcttcccaaattacgacatcaagaatatgatctaatgtaaatagtagaaattaacgaatcgatatattttaataaaaataaatataaaatttaatataatataaataattttttaaattcaaacatataaagtttgtatctacagaaaccactttttacaataatttatagcatataaaatggccatttgaaattaagaagacgttgctctaaattttacattattaatagttagttacgcgttttagaagattattttcattaaaatggtttccgcttctgaaaggtgttgttcattaaaaaataaccaattaaattcagtaaaataaataaacacaatcaaaagaaaacctatgaaaatccaaaagcagatcccagaaaaggtaatttgtgattttaattaatgattaccataaaaacaaatttgaaagtttgaaacttttctcggtgggaagcttgaacatgacaatgatatgacacgcttttcacaagcctaataattctctttgctgtgtcactgcattgcaacaatatatattcagagcacaggagaaacattcgtacatacatagctactagcagttcactttcagtctctgtagatttggtttgtgttcatttccccactgaatagtgaggggtagcatcgcaacccaccatcttatttcactctccacatcatgccttcaggtgctaggaagagaaaagctgccaggaaaaagaaggcaaaggaacacaacatcaacccatcaaccaacaacccccaaggtaccatttttcactcaaatgcatgtgcatctggcaattaatcatagatgggtccttttcagttgtgcattatatcttttttttggtctttttgttctattagggtagatggagttctgttaattattcttgttttgtttactttgatttggaatatgcagcagtgattcattgtggttggggtagtcgagttgggtacactggtatttattaatttggttgttttaattgataatagcttgattgattgtgtaaataataggaaatgatggtttgaagtcacgagatgagaaaggaagtgatcgtggtgagggtaattctcctgcatttcatgaacatggtgaccatcgtaatccattcaatgatggaagtgaagatctggaagagagaggaccatcagctactcaaccgtgtgcttctgatgtcgagaccctggaagaagtccctagtgatacttcaaaggaatcgtgttatgagaatgggaatggtggcgatacttcaaagggtgaatccctcgctgagaagaactcagaggatgggaattgtaattcagttgaagaggcaattgcaagtcatgagttggttaagtccattgattcttcccctttaaaatgactttgattactgaaatggcaccagttgaggagactgttgattcagctgctaactcttctgttaatttagttactgacatggcttctgtgtctgaggtggaaaagagtgatactggaagtgtgttactagagaagtcagtagtccatccggtagaagtgaccaacgtcgcaatgaagataaacgaggataacacatattccttaaccaatgagaatgtgacaatgtcaagtgcgggggagcctaagccaaaggaatgtgatagtaaaatgttaacttcactgtctactagtcctttaactaaatttaccaatggtgcagaacatattaaggattgtaagactgcaaaacgttctgaaaatcaggttttacattttctcacatatacactacaagtttttcatctcaattatgatttgtaaatttttgtgaaaaactaattttaaatatatttttctttgctgaattaatttgcagcctcatgtagcattggctccaaatttggtgcaaaagacccctggttgagttgctgtggattgtttgaagttttgtcaagttcaaatagataatttcaggtttttcctttgaagttactttaccttgtaaaatcatgtttgtgtgggttctctttcaacttaaaaggttgtgtttacataaatttgctaccctcatgtatgcttgcttatggttgtttttagctttagttttgcaatttttctaattggtttggtaatttgcgctttgtgacttttaaactattagagggaagtttggtggtgttttctttcactttttattgtttgtttgtctttggtgaatgcaggtgtgtcatgggtctttggaccaatttgtagatactagctttaatggtttcagtacaaatgaggatgctaaattattgtgactatcaatccatgctattatatttggtcatttggtgcatttgggaagagcataatgctcatatttttacgagatatgcttggctgagcagctattttggaatgtgattaagcaattagcatcaatttggttttaaacacatggtctttaaggggatttctgtaacatacacggggttaggtaacttcgctccattagtgatttgtatttttctgttattcattttccaaattctttgttatggaggatctcttattctccaattgtcttgtaattttattttcttcatgctgacaccgtcttgttcatgagattcatgagcacaaagggagggtgtgattcttctatacctgtgtgtgtgcatatcattctgaaggtcatactctgttattattctagttcaacttagtctgagcgttatcaaatattcatgccttttggatatggatttaaataattaagatgtacttcttagttcttcatttggtatcaattggttttttaagttatattattcgttctaataatgctcattttggggattattgttgtagtatattgtgtatcagtatacaatcatacattttaaacttgcaaattacgttatgtttgacaacatcttccctctgtttttcttgcagaaatacaagatacaagcatcaagcgtgagtatctcaactgatgggtcaaacttgtgaagatttagaagaattttgtgatattttgatttagattctctcctttaagcttttcaaaaatatagcaggcaaccaggccaaagtgtataatccatacaacttttgtttacattacagtggggtttgtttgtagttattgtgctagcaacaattacagtcttttaaactgatttgttaattctgcgacatggaatttgtcacaatactgtttatttcgccctttctaattaatgtagagcagcagtgagacctagaaactccttaagaaaattcactttgatctttttcatctaatgcacgattctcatgcataaagcacttagaacagtgtttgcagtgcagcgcactttgggtgcaactttaaaagtttatctttaatcagattaactaccagaaccataacgaagcaggactcttcgtgttctaacttatggtgcaatcatacctcggatgtgtccctgttcaaatgtccttagctatcatcttgagaacttcattgtagactgatgaaactttgttcttgccctggtcatggaaatgtccttctttgatatttggtttttcttgtcaaggttacggttcaaagattactctttcatgtttttttgctctagaccatcctgtggataccaactgaagatttcgtaattattgtgtgtgaattgcttttctaggaaatatatcctttaaaaagatctaaaaacctgttgactttgcatacatggtctttgtgtaaaaatgtttgggttttattgtaccccatgttcgttaaagacttataaatgcttatcaaggttatgcagcctgatgtccctatcatgatcaatgctcacagcttactcctaagaaagttggaggaaaagaaatagaaaataaagatagtgttctcctttattgctcttgtaaatggcatattcttgattcatacaaatccaaattccaatcattcaaatcaaaccacaatgctaattctcctttaacttgtatgaattaaaagtcttgattggaccgacagaagagaaaagaaaaagcaagagggagagaaaaacacaagcacaccaatacaatccttcttggccaacaaaaaaagaaattccttcaaccttcaagtttatcttctatacgcagcagcactgtgaatagcaactatgtagaaaagctgtgtagctgaaagtataatgataaaagcctccattgttttctgtaaaattggacatttcagaggcctgacacttgaaaatatactacaagaaagttattaagaaagtaaatgaatcttcctgtcttaccaggcgtgcatttctgatacgaagctcaatctctttccaggcaaagcttcattaatttaattatagttagataattaaaataataccacaaaattatttttttggaggggataaatagaaaatagaaatcatagagaaaagattaccccatggccaggagtgtaagagtccaagccattgtagcaactgaagctgcagatggcaagctctcagcagtccatgactggatatgattgattcctgaaattgctgatgcagcaccaaccactccagcaagcaaagcaaatgtgacaaagaatccagtggatgcattgcccattgggaagaacaagggtgaaaagtgtgctggtagttttaattctggacctgcatagtgcatagtttctcaacataagcaagctgaagaaacacaaagaaaatgattggttacatgagactatgagaggacacataggtacatttggacattttaaattttcatacctataataaaaccatgatctattgctctgttcatggcccatccactaatgcccaaaactatggcatacatgcagaagttcagccccaaaagaagagtggctataggcttcatttgctcattagccatatgtgttgctgtttgttttttggataaggaaaaagctgttttgaactagaaaagtactaggggatttcaggaacctaaaaagcagtgaaggaaagtctataaatccaaggaccaggagctgcatatctttggtacaaatgagagttcttatatatatgagaaatggataaaactgaaggttgggttcttttcttgacaaggctgctagttagctaaaaagcttcatgcaggcctgtaaagatgatgcttcacaatcatacttagacattaaattaaaatatgtatgattcttacttgtctcttatttttaaggtttgtttaactgtaaataccttcccaacaggcaacttcttaggagttgtcaattgtttgttctctgaggcaagtcatattctttgccactcctgaactcttctcattcacaacactctggcccaatccctattaaaaaaaacccttacactgtttctaacaaatttaattatatcgcgcaagtatttattatttagttttatatactaaaaaactttttatttttattaaaacagttgttactatcccaaaaaagtcagatatagaaaaatatgaaaattctaagattagttaaaaaaaatattttgttatttgatatacaatgagacaattacataaatgtcttatattttataattttgttagtaataaaataaattatactatcagcgtttaacacacatttttgtttacaataagtgataaaaaaaatactcatctctgatatattaatatcaatatgattttttttccaaatatattgtaccccttcctttattatcttaaactttatacataatgcctaaatctataaatttatttaaatgttaattgactaaatctgactctgaaatgtatgtgaacaaaatccaagttaaaaaagaaaagaaaaaataaactttacttgagttttatagtaactaccttgaatactaatggtgattcttaattgattgacgtgtaaaagtgtttacactggtcacgtacgacaattaaactcaaaagaaaaatgaaaactctaacaacccttaacttctcttaattctgtaatttttattttatctttaatgtgcaaaaaaacataatgccgatcgacagtattacatgactatgagggtatattccattcttctttataaggtcacaaaaaaaaatgacgttcatcaatatttcttataagttggttaatactataattcgaaccatgcctgttgaaattaatttactttaagaacaaatatattttacagttttcataaagcaataaaaagggatatttctaaaaaaaagtaaatgctcaatcacaaaatcaaactcaaaatctatataaattaattgatataaaattattctaacttaattgagatctcaagttcaatctgagtaatacatcaaataatcgaggtagagtttatgctcatagtaatcccacaagacttgaacaaaattatctccgtgaaaaatacttgtaattcatataaaagtatctcatcgcatgagattgctttaatttaaccaaatgtctcattcaaattttgagtatgcaagtatgttctcatgtgaaggatataaattctacataaataaatttttctgcattatatataccacttttatactaaaaaaaatactttcaataaatttacttgagacccaagacttacattttctacaaagctaagtgctaaccaccaaaaattaattcggtaaagtaacaaaaggaattagctattttaaagcaaaaatatttttaataaacgttacaagagggggaaataacatattaaaataataaaataaaataaacttctcaaataaactaaaataatcttatatgccacaactttttaaaaaaaaaaagttaatagagcttaacattcttaccttaaaatagttttacatttaaaaaagtctcataggttagaagttttcaaattgggccgaatgtatcaatagacatttattaaatggaggagttggccaagctttccataaaatccaaaagacaacaacctaagccaagagaaactactatttgggattttttttttattaattattatttgaagttctttaattattattcaaaataaacaagcataaatctattataacttctgaacgaaaagtcataatcaatttactcttctacttttttaattgaattcgtaaaatattttatgattttaattaattttttttataaatttacaactttaaaatcataaattaattttttaatttttttataaaattcataaattaatttacgacttctcttttttaaaatatttttttaaaattgtaaatattttttatttaattattaataaacacatatattttttttttagttttatttaatatttttatatattttttatatgtttaatttaatatttttatttttttatattgttcattttatattttctatatttttatatggttttatttaatattttcctatttttggtatattatttatttaatatattttttatgtttaattttatatcatattatctaattttttgtataatttttatttaatatattatatatatattttatattttttttttactaatgtaagattattatttttttataaattaaaaataatataaaagattaattaaataaaatatcagaatatttgttactaatattaacttataatttatcgaataatattaaaaatttaattaatttttaaattatcattaagtaaattaataattttgtacaataatattaattaattttattttaaaattattttaatattaataacataaaataattcataataaaaatagttgttaaaaaaaaaaaaataataattaatataaaataaacaatacaaattaaacaaaacataaaaagtataaacaatattaatagtcaatttgcttatatgaaaaaattactataattatgttctttagttctaaataataaacatttcatttaaatttaatcttttacattattttttaatttacaaaataaataataatccttaacattagttaaaaaataaaaataaaatatagaaaatatattaaataaaataatatacaaaaaatatttaaaatattaaataaaaacatataaaaatatacaaaatattaaataaaacaaaaaaagtaaaaatacttttatttgttaaataattaatttaaaaaattatttacaatttttaaaaaattataaaaaaaaataacaactttaaagtcgtaaaaaaattaatcatatgattttaaagtcataaatttaaaaaaaaaaaactgaaaatttacgactttcaaaagtcgtaataaatattatgacttattcacttttgagtaataattcaaaacaaatatccaaagtaattaacaaaaataatcgaccccagttgtttgcctctaagccaacacctaaactgaattgcaaacatccgtagaggcaactcaaaatttgaaaccttgaaagacatgcacttaatttgaaagaaatatatctattacactcgtataatagattttgttattagaaagaaatgaactaatgagtgaatgatataatttattcatcagcactgaatcacattcctctttttcttcgttaagttttttggttctggataaaatgctatgaaaccatttttttttttcattcagaagacacagtcaccccaccaaaatctacagtgtagtacaaaggcatgttccatgcatgcaaaaattaacactaccaatcattatggctgataaacctcaggaagctgaagaccaacactagaagcagattttccaagagtcctttttacttcatctgacctatccacggcaatattgtatgaaaaaagtaaatcctgaaaaattgtcaacaacgatgcatgatcaaaaagccagatggacaaaacgtagtttttcttgaaaatatatttattcacaggcataaaatgagtaaaaataattatatcaatgataggatacaatctgcagaggatttctcccggctcggccacaccttggtgatgctgatcactagtcaaaaaccacatcctcttctgtgcttttaatttaactatatacataccttaactaaagctgttgagtgttgacaccttgtttttaactaaccgagtttgtgtaaatctcatttgaccaataataactgttcaatcaaacttcttacccacaggcacaaacaaatgactatttgaattttgaagcaaaaatgcatcagagagcaataccttgtgatggtgtacactgttaagaagataagtataatcacgagcaagctttattttctgttggatagacacattgtcagacaaattttggttgttacggaactctgaggttacaaattctataaaatgtttcttgttctcttccttcccaatatgtttcttgaccgccttgagaagaaggcgataaatgtgagctgtttggaaggcgtcggatctcatttgtttctatcaatatccactacctactttcctgcataggatgacaagttttaaatataaacatttataggaatcttgtttgcagaaaaaattaaaattagaaacctaaatgatgagagggagaaggtataaaagaaagaaatgctactatagagaataaagaaagattacaacagaaaaaggagtgcaaaatttcatcctaagaaggtgcaaagaaacgaagaaaagataaagaaagttgtatagaacgaggatcttcaattcctgtgtaaactaggatcaatcttgggtttggtagagttcctaattcaatattacgctacagcaattttcttcttagaaaatcccagaagacatgcagagaagaagtttatcctatgtttatgtataaccattccattacaacatgcacttaacacaatttgttgcatctcagaaaatattttacaaatgatgcaactagttcaaaacaacttgacttattgtactaaatggaagccatgataattcaaatttgaagtcaattccatcaacaactgaacagtggaaaatacttataatgatgccatgatcactctgcaagaaatcatcaactcttggcttgaatatgcagctacagctagcatatttttcagattccttgctctgtgaacactgtcacaatgcatatgcaagatgttgcaacaagaggcaactaaattcattaaacaaaaatccaggtgtgtatttgaatggtacatttgaaaatcctaggaaactcaattgcttcaattgaatttccttcatttgtaaaatttgttagtctgaatgagtaatcagattccctccattcataaaattcaatattaggataaagtaattaaatcccctcaataacaatgataattttgatatgttatgtataacttcatatggaatagacaacatagagcttagcctacgagaaactctaggcatatactgtgtgtcatatgatcatatatgtggtctaataaacaactgagaacgaaagcaaggggggtacgtcaaaagaatttgttgtgaacattttcattaataatattgatcatatatggggtctgataaacaactgagaacgaaagcaaggaggctgaaatcacaatttgtttgtggctcccaatgtttcagaacacacatcaaacagtttgtgagcaaaatcaaatatactgcaaaagtaaaacgcaacaatatgtggagcataatggaatgggcaaacaaagtaccatacaaggaaaaaataaataaaagtcagatccacaaacacaagtgggcagttagcaaaataaacagagagcaaataaaaatgaggaataacacagcataatatcatattaagaaacaactaaatatccatattttgcaactatgaaaatgcagaaagaaagttcattgacatttgtagaagaagcgattgaagtactgcaagcaaatcaacgaaaatcaaatcagcgttgcttacttcctttcttactcgctgtggacgaggctgaaatcaaagcgttgctagttgcgtttgcgttgcaaagaaaggtgtctctgcctctagttatctaaacgaacaaaaacttgtttaaaatgaaaagaagaaaaaaaaatgattaaacgaatttataactttcttcgaataattaaatttagcttttatatggaaacatataattttagctttgaaaaaaaaattgtgattgtgggttaaaaacatattgagtattgagtagtaattaataaaactgaacactaaactaattaatctaattgtttgtaaggtttttaatataagttattaaattagttaaaacatattatattttcgaaaactaatggtctaagggggaaaatattttattagaacagtctatccatttatgtgtgtatatttttttgagttaaatgttattaatgtaattgtgtaaaatatttattgatttcataatttctgtcgcaaaattgattaatcacttttaagttaatgcatgagtcgagctggttaatattgctttgtgcaaaactcgtggaaacccaagttggtgaacaccgctttgttcatttaaatatttttaagagtttaagggctttgttaaaaactgctaaacaataagaacctatttaagaatttagtaaaactataagggcctacaaagtaacttaaaaaaagttgatgataattagataaagttcagaaacaacaaagagaataattaaattagaagatgctaatatgccctatcattttagtatcaatagggatgggtagtgatgtccaacaccgagtacttcaacacccatgaaatgtcattgggccacatattaactacaacaatgatttctcttttttctttttgtggggtggtggatgagggtgtcaattgtcaaaacttaaaataactccagtttacaaatgagagaaagtttgagtaacatcaattcaggaaaaattgatagaattgtgtctaagatggtttggacatgtgagaagaagatcaatagagcctccaatatcaaatggaggatagcctactaattagaagtatagatagaccaagaaagactctgtgaaactattaaaaaggatctaaaattaaatggcttagctgaagaaataagaattgcttttggaagtacacaatgactgttcaatttatgcagctgactccacttagtgggaacaggctttcatttttgttgttgttatattaacttgcctttttgctggccgctcaagactttgtaaagcctcctggagaaatttggagtttacgccaacaatctgatcactaagcaagctccattgatctttctctccatattgaaatccatgaaatacatgtttttgctccatttcaatgagtttctttttggctgctatgagatgcttttgaaactttttcctttctttccattcctgacaccattaagaaattatccagaaccaattaaatatttgtatcaattatccacggcaaagagcacccagtcaaatattgatatcaccacaaagaaattattccgaaaaaggaaatttagaatccaaataatacaagtacaaatgttgaagtgtaaagcagaatgccaccttatgaaaatcaaattccacttgggttggtataatgtaagtctgccagcatgacttacatacaaatggaaaaaaaaggtacaaaaatcatatccaaatgatagataattgttccattttttgtgtgtgggagttacagcacaattcacctttgaatggtagatactgagatatgtaacatagcagcaggaataagaacaaaactaaaaaaacatattcagtgacaataaaaactcataaaagtaacaaattagtagtaatgcattagggaagtatggctcactagttggcgcctttcttttttggacctctcatcaaatcgtaaatttaattctaggagtcccttgggcggtgtaacatgcatttctcttcttttcatatcaacatctggaacaatggcttcaacgaaaggtaccaaaacaagctgatcagatgcatcttctgctgatcttgacttgccacttttgtcaagcatatcaaaagatgaatcgagtacaatttgtagtaggtcattggctccactattgaaaacattcacaacagttcccacaagtttttcattttccagatgggaacaagcatggtcaacaccttcaaaaattgcattgaggattacaaaatcacaataagatgacaaaaataccgaagtagaaaattcaaagctcatacaaaccaatataacaatatctttaagttatttataatagtccttttcatttttatcactatattagcacttggtatttcatttgctgaatccttggtacaaagggacagctagcggtcacatatgcatctagaaaagagcttaaaaaaaaggatagttcagttttatgaaagggaacaattatatggtaaacaattggcatttctgttacgatagcacacttgtgagaatcgccaagttaatactgaactccaaaatataacagaaaaacagctgatgaatataagatagagaatttcatttcattagtatttagtaggtgatactttagcaaaactttaaataatgaacaaggaaaggagaaagtggtttgtcttcatatatacacaagatatgtgactaagaacaaaccttcataaaaactctcatccctatcagatcatgtgtataaaattcaccctcctctaattgcggcctgtcttcgtccgtcacaagcaaggtagcaccaataagcatcttagcctgcatgacatattgattagccaaggccaaaatgcatgcatatcatatgatcacacgagccaggtctacataggaaacttgacgcttcccacttgcaaccacaagtgctacatccctttcaaggatcaataaataaaggcgagtagaaataattttgacagtgtaatatctatggttgttattgtggcatcaaactgactttaaaatatgattagtcaatagatgaattcactaaggtgcttccactttcttgaattaacatatacagatatacttaaatactgaaataagggacatttggaagagcttatttgggctaatgagaatagcttacgactcctatataggttcttttcagcttattttcaataagcatgacttatcaaaataagctctttctaacttcttccaataactttcatgatcaaatttattagttatgacaaaagctctcaagtgacaagaactcaatgaataagcactaaattaagtgttgtttaccaagtgcacccttgttactaatcaacactcacttcattcatccaagttcaagatgcacgaaacatggaagagaaagaaaatgaatcagttaaaaagatgagagaaaaaatatatgcacggatagtgtaaagtattttttacatcaccatccaatcataaattgtcacaggtttattgacttttataataagacaaatgctaactagtacccttagagcattaaggactaaaaggagaaagattttattgggatgcacaattcattacacttttttgggctctcccatgattcccacaataaatactttctttttttaattccttaaccaatatcctaaagaaactggttaacaagacccttatacttaaaagttaattgtttctaattggttgagtgtaaaattttctatactgcatagaaattaaactctattgttcgtacacaacaaagatgggctggtaaacaaaatttgtaaaattagacagggtacgaggtattgaaaaacctgctccacggtgtcaattcctctgaatttgagtatccaactcttgagtgcagggtgctctgtaccatcctccagctcaacttcttgaacgctttctccacccaaaaccttgctcttcaaccatcttctcccaggctactcaacaaacaaacttagccacttgaatttccacatttccacaaacacaagaaattaacaaaaatcattacagtggaaaagcgcagttgaggaaaatcggtggcgggcttgatttaataaaagttagtaaaagaaagattatattcattttatataatgaaaacaagtatagaaactaaagaagaaagattatattcattttatataagttagtaaaagacaatttttatttatttaataaaagacaagttagtaacaaaataaaacttaattctataattcaaatattagaattaaaattaactaaaatgatttttcaagttgtctcgtcccatttacaacaaaggactcaaggtactccctatctgtcaatcgcattaagaggtcataattactcaaaagtttatcgatttcacattaaaacttgaagagtgacgtcaattaaataaaagtaacaacttatagttaattatgagaaaattaaaaaatactaagtagccttcagccgttaaaattaatagtgggtagaaatagaatcagaggtaaaaattgcatttgtatgtatcatactatagtagctatagagagaggagaaagaagaaatgtcaacaatggcaatgcgtgtgtcttccacttcaacttcaactgcactctctctcttcaatttcatgcatccgtgtaccttctctctcttgctcttcgccaccatcgctctcctacaccttcaatcctcttaggtactttccattcattctcatctcactctatttcactctttctctttctctcactttgcttttccgctttaagaaggtccttcatcggtcacgacggaatcagaagcagaagcgcagggtttcgtctgcattgctacgctcctgctcctctcaatcctcccaatttgcaatggatctctaccatttcttcagtgtcagttcacttccttttctctatttcatccttttactttttcaattccgctatttatttatatattatatattctgaacatttgatttcatggagttatagactacgcacttttaatattgtatattaattattcggttattttattccactgtctgacgagtggaagaaacatatattattgaataattatttatttctgatcttcgattaatttgccaaaaaaacagaaatgtttgttcatgcatgtaacttaatcttataatgaaattctgcgatgatggatgttcggaaatcggaacattgtttgtagggttttgatactggcgagaggccccgcggtgccgaaatcgtatattgttccgttgtttgctttgcaagcatctgcaggtgtcgtttcctggatcaagtatgtcgttcattcattctgatgttttgttttcttgttcagtttatatgctaaaactgaattgtttatttaacaattcttatttgttcaacaatattttgtagagtattattattcttaatttttacaccaattggatgtacagaggtagatatggtgtatggacagcattcttggcacttctgattcgtctattcttctatattcctggtatgttctcttatccatcacgtgaaatttaggaaatattgaagaagaaacaatttgtactgtagatctaaaagtgtaaaatacaccttttatagccctcattgaagttggtgtaaattaaagcatttttctaggaacctcaggctgggctctatatcttctctttgtataaactgcgaaacatgagaaagaaaatcctggttgtggagtgtaataataagaaaaagttgtgtattttgttttttcatacttgttggataatgattgaacattgaatgaaggaatcattttcttctgggtctttttcatttctaggtgaacttgagttgccatttctggcattgctcttggtgatggtagctccatacaaggctatgtaattaaggtaagcaagtccatctttttgggactttgggctgtcgcctcttttacctttttcaaaaagtaaaataaaatgcttcaacatctttcttcatcagggatacaaaagaaggtgctgggatttcattgttgattgcagtgtatctggctttccagcatttcacaagaacaagcttacatcaatcatttgaccaaggttcagttgttgccaccttagctatcatttgtatcactgttgtatctttgttgcttcttatttgagttggctttgaaatgatgtacactgattgtaaataagaacaatacttgttggaatgacgatataaaaaatttatggattatgttggatactcaatcttgtacttttcacttgttaattcaaataatgaagttggaatccgtatttggtatttgtcatagaaattgtgtttagaacatgatgttctttataccatagttattaataccaaatcaaaccatccagttaaccataaaactgtttcaataaagaactgtttttgaaatattcaacaaaatgaatattgcatttgaactgtggcaagttaagcattcaccatgaacacatttaagtgtaaacatgttgaatttggtgtttaaaagctagcatccgatgtaataaagtttttttggtgcttctctatcaaaattgtttaatagaaatgacaactaacaccatcaagccatgtttatgttgtgtgaccacatcccatgtttatatgtcactgttgtgaataaggtagatttttccaaagtagccttctgagcgtcctggactcaacaataacatgttctagaccaaacatgatggttttaagttctttaatgtattttattctgtttagtaaataaaatggcatgctagctgatattaattacaaggattttctatggaagagaagctaatactgtagaaaaactgtctactacctataaatccttttggcttgatcaactaacagccatacatagatgaaaggtataagtaattttaattgcaagacttgttgactctgactcgttgaaattttgcaaaaactgctggaagactgattgaattccagcgcatcacataaagaatgactgaaccttgtttatcgtctagatgtaatttgatagttgaagggaagccaacaggccacatgtgaacagcagcagcagggaataaaatgcagatgtggctgtattggggcttcctgtaggttctgaaccaaagacagttgatccgccaccgggatttagcatgcctggtggagttggggtcatcactggagttggtggacttggtgggctgacaaatgttggtgctggtggtggttgattagtgctgcattggtgagataatatattaggatgtataggattgcatcttcattaatatagggtgaaaaagagatataggtgctgcaaattctcaccttgttgacttggacgatgcgtatttgcaattcccactacctgcgatggagttagatgttattttctacttttaaggtacagaagcacaagcaaaagacataaaacaaagtagaaattgtttacaggcgcagcctaatccccttaaaaaacaattaaataaatgaagcccacaatccttagagtcatgatgtaaggaaagtaagctaattgaggacattcatccgttgctgagaaaggcgttcaacagacagcagctggaccttcatcagttgcttaaagaaaaacattactatacttttttggtacaaaaacattactatagttggtttcgtggaaggggattcattcctgtttataaaataaaatatatattttttaaaatgacttcacttgatgccttgtcgcttgctccacaggtgaaagtatgagttcctggcctggtaagttatgggtaagtagagactgtacttcagaaaatcttagatataggtatgtaaagatatatggttaaattttttaaagctagaaacaagggaagtggggtgatccaactagaaattattgagttatatagtccctcaactgcctctcaagttatagaaagtttgcataagaatcttcattttatatgaaagaagaatagtgacttgagctatccaagctgtactctaaattcccaacaggtctgagatattggatgcatgatggtatgtataggatacttgctctgtgcctgacatgacgtgttacccttaagacatgtaaaacattttaaatatcatggtcacaaccaagaaaattatcacaagaagataatcatgctttgaagttcgatgaaattcttacttggatcattgcttgtaagagatgctgttcctccaaatacacagctggtaggtgctggattcttctggtagtagtcattgaatgcataggaagcatgatcacggacagtgttcggattataacagcttgctcctggttgtattgctgagcagtctgcacctccatacccacaagcatagtcaagagcaacctgtagagctgtgtctgaagctccctggttagcaacacaccattgaccacctgatgatgttggtgttgtagttggtgtggtgggtgttgtggttggtgtggtgggtgttgtggttggggttgttggatttgtgtttggggctgtggggttttgccctgatgtgtcaggtgtttgaggagtgttagggtttcccatatatggatttcctgtgccaggagttgtgggattgacgatagggacatcatctaattgagtacccaattccgatgatgagaagatttcctgttttttgtcatttaatattttggttgttcctagacctggaaaaagaaacggaaatttaacaccttagtaggacaaatgcgaataacttttgtgatgcacttgagctaaatattaccctttctaaatcaatttacgcaaattgcaccaaatcaagttcattacagttgtacaaagaagtgtgcatgcatgactacgatatcttagaactggaaactatcatcatttgtagacagaatttatctatcgaaaaatgattgaagtttaaagataaactttgatcatattttcaattgataaattgtgtacaaaattttatggctcttgatataatggcttgggttgcatatcttctcaatccaaagttggttttgttataaatgcatggaaaaaatggtacctgaaccaaagaaaagacataaggagaataacacgaggtgccagattctagcattcattgctccaggtcggcttgtgcttggactgcaggtgtttccttaagatttattaaacaagggcagctccctgctgttcctgtgaagaggaatttcattacttaaactttttatattttacatataataaaatcatgaagaatcatagctttcttggatcaaagagagaaggaagaatataggcaaacttgagaaaggaggcatgggataattgaaataagcaagcaagagaaggtgcaaactgaggggaaaaaaggtgcatgacaaaggaaaaaggtgaaaggtgaaagggcgatctgatgcttgagagctgcaatgtatatataattaatgtgacggtgatgtctctgcaacgtcctttctcttttgtgccactcttttctactgttttatgggactgaaccaaaaagtaaagcctgagcaagtggcttgccttttgggtttgtaacgaagaatgttgtctcccttctattgtttttatcctccacctcttaacacacaaccacaagtcattttctattccctgaataagtggttcctctggaatgttttcgaagtacgattcctttcctacgaaactcaagttatctactgctgccttgtatcttgtcatgcttaagcaaccttgtctcaaatctaagttgtctattgtaacaaaccaaaaaaagtgtctattgcaaaacttaagtaacttaaactataattttttttttttttttggggggggaataggaaattcagaatgcgattgaaaagattctcaataattgcagtaagggcatgtcaaagtccccacatataaacattattaataatttacttgcaacaatcatgatgagaatatcaaagagaagtcatagtactaattttattcatatatatcaatatattttcatatagaatgtaattatcaattttttagaatattacagtatactaacaattcgtctatacatatttttcatataactcattatatgtataaacattttatacttaatatatatttttcgtgatcaaactaatttatgtattaatatttgattgataattaatttattaacatgaatctgttatattattgttgattatatttgtttgaattaaaaataaaataatcttatttaatatttttgaaaaaataatataaaattgtaatgtgatctcatctcatacaacaaaatattctttatatatattagataataaaatggaaccaaacgattttccttaaatatcggacactgagtttatttcctaaactcctcctatttgcttaagctttaaaataaagtaatttttaaatataatttcttcaaaaagcattttttataagtaacttttttattataaagaaaacaaatagtacaaacgcagttaacgtaagttcttaaatatgtcttaaataaaataaagattttcttaaaaaaaagaaagaaattcaaacaaactagcataagtaaggaaaggaggaaaattactacaaaagcagaggaaggagacaccgaagttgattttcctgaagcttttaaccttgtgggtgttggtgtcttcagttcaggtaatttgtaccctttatttaaaatcaaattactttttcaaatcagatttcgaatgatttaataatcaattttccattgaataatcaatcgagacactaatttaggcatgcaaacttaaaatctctttttttttttttcatatagctgtggaacaaagatttgaatttttaatcgcatgcgaattcataaaatacctatttttttcacgattagaacacatctagtggagccatgcgcaaattaagttcaaataattcaaatatctaattattccgcgtgaaataggtttatggcttaattagttttttagcttttagattgcaagcaataaatatttattttatataaataaaatgtataataaataaaatatttttaaatatataaattactatatttgtttaattcataggaattaaaaataatatcaaagaatatacaacaacaagactatattcaaccaatttagttagatttaatcatgtgaattttttaaaaagagtcatgtgactttttaaatcttgatcgtccatgattaattatatgattcataataattatctcactcttacatagaatacatttttctcatatgatacatcatctatatgtgtaatccattaaatatataattattcttaccggattttttataaaatgataaattagattttcttataagtgttcttcttatcaaaaataattatatcataatatcacatttcgatcttttctaaatcctttataatataataaaatatttttctatattttatttattatactaaaataaatatgtcaaaagaaataattatcacattatatttcaatcttgaattttgaagaaagtaaaaaaaatcaacaaaaataaaaataaaaaataaaagatggggtatcaatgcttggacatagaattataagaccaaataaagttcgatccttttcggccctattcgttataacccatggcctccattgagtatgtttcggtaacctattttgttacctaatacaagtataaacaactagtttttcaaatgtgtgtattttatcccttttattaccttatcaatgtgtatattctaaacctatattataacagtttaatggtgatacactaacaatataaagtagtttttacactataactaattacaaattatcgttgatatgactttttaaataattttaaaaaaatcaacaaacttaccataaatgttaatttctaattggatgaccctataaaactcattacataactttttttttcttcatattatagtacccttttattagaacaaaataataattaacaagtagttagtttgagtataatttaatttagatattttaaataagatttcaaactcgagacttgttaatgaagatagctggggaaagatccaccagcatcaaagatgatcaatcaagttcttctaaagatattactcattgacaaaacttgtgatacttaacacaaataacatggtttaaaaaaaaaaaaaaaaaggaagacaagagtaagattgcgtacaatatccattcctcttattttcacatatagaggagtttatgggcaatgaggtatgtagttgtttttttaaagaaaggcaagaatgaatccatattgttacattgacatatgttataacccttttattatcttagagtatctttagcgtcagatcttgaacaaagatctgatattcattatatctctcaataaaggagatgaacaaatctccaatggcaaatggattattgtagaaaaatcctgaagatttgcataatattcaagaaaggataattttttcccctctctttccttaagatctgaaaatgagatctatcactaaagaaaaaaaataggacatatctttaatcctacgtgacactataaagtccatcaaaaagtggtttaagatctcaatttagaatctaccactaaaatgctcttatcaattctattaagtttattccatgtaccgcacgaccatattggagtgtataaagttacttcaatgtaaaaattaagcaaaatcaaacatgatacctgagaggaggaacacattccacataaaaatgaaattgtcgctacatttcaaccctataattcaaagaatagtgaaaatagaagcagtaatgattcccgatttcctttttcgtcattgtcaatatgtaatgaattctttaccaataaagtggcatttttccatgcacttgaacaatcaactaatacgtctggatacactgtaatattggggaggatgtggtgcgagctaaaaaaaggaacatagtatcaaaaggttcataaaaatgtacaacaaagcttctctatgttagtatgcattaaacccaggttacttcagttctgcactggctgcttgaatacaaactcttgcatgcgtcctagggtcatttcttctcatgtaatatcaactatacacttcatcttgaatggaacggttacaaatattccaagccaatcttgggtgttaggccaatgtatgttaaattaaatgccattgttgccaagaaggctaggcaggccattcaggcatatatctatattaacttgaaattcttgagatatacatagcagcttccagccagcagattcttcaaaagtttcaatttaaatgataaatccaaagcaatagattgcgttggaataccaaagaaactgctttatccctgttgtggcatactgcattttttaagatgtcggtgatatcatcccatgctgcaaaaatggggctcagatcatgcaccatattaccattttgactacggaggaaaaaaagaaaagaaaaaaaaaaaactaattgtacctggaagtttctggaagtcaggctctattccattgccgtttatgtccttgtgatttggtgttacatacttcccaacagtgataaccacaccagatccatcatcaagctcaaatacagattggattagaccctgatagaagcattgcacatcaaagtgtcatgaagaggttgttacaactacactgaatgcatcacgtaattatacatgtgtaagagctaaaccatgcaaatatttttatttttattttttaacaacaagtcactgaaagacatcaatatgattttctgctattatctccctttagtaagagaagcataatgagaaaagaaacccattttatagaagcaaagaaacgctgcacagtctttgcggtacactggtgtggtactccttcaaaagatatacaccagaaaataaagctaacgtgattaaagaaaaatgctttcagatggacatggggttctcataacaaagaatgcagatcaaagtctacattggttgaaccatacagcagtgatggaaaatattcataaaccttgccatatgtgcgttttccaacaagaacggctctacaattatcatgcagtgcagaagcaacctgaaataagtacaacagctatagtgacatcataaaaataagtggaaaatcaaacaaataatatattgagaaattgagctcctcactatttcacttgcactagcagttttgtcatttactaaaatctgcaaaggttcaaaccaaaaagaatcataatccttgtcatgaagtcctcaaaatgagaattccattgatcaatgatatataatgaacactcatacggagactattttaatattcgcttgcatgaccttgctcaatatgacgggaaaacactttatcacacatcaagaataaccttataaaatgatcaaacatatagatctcaacttaattcaaacttttagctagtcatgtgcaaggggtaatgaatttttccagaaaacttgagaatattctcagatgctctttaacttatttatttataatgaatttgtggaattttctaataataaagccttatctcggggagtcagctagattgaccaaatgatgtcattggagaattggacccatcaaaaaccaaattttcaataaatccatttttgaataatggtttcctaaatttttttcaatatatcccattggatccacttttagcatagggtcaccagttggatttctcctcagtcctcatattacccaactatccatcatttcctcaatgggcatgctccacttttgtctcaaatacacacttgttctttttttttttatttctctgtcactcgtccaccttgaccttatcacctctaggctagtcttattgatacccagtagaatttgcctttgaatttaaaaagcactttgtatacttaaccaaaaacacttggattcaaaagcttatctccacaacgcaaatttagacattcaacttatcaactagaaatatatcatctacaaaaaaaaaaaaaattgagcactggctcctgaatgtgcaatttgtatttactcaaatggtggcaataaatcattgacccataatccataacatatccatcatagttttcaatagtaggaaattctgttactgctccatgtgtttgcactcaaatcattacctatcatacataacatattcaccataccatagcttcacgcattgcacaaatctaaaatctttatctgctcctttatttaaagggaaaaaatccacaataaattcaatgtatcttaggttttttccctatcattgtattttggaatatctaatgcttatcttaccaaagtttatcaaatgggcatctagaatcactatttatcagtcaaacaatcaataatttcatcaaatcagatgtctttgaattattcctgccccaatgataaaccaaaaaagaaattcagaagtagaaatagttccaggaagttaattcaatgataaaaaatcagatgtagaaatttttttacaacaacaggagcttgaatcaatggtgaagtatctgtaacaatagctttctgtaactgaggatctcttccaacagtgtagatcacctgtcatggagacattagaaaaggacacgtctaagaaactaaaatgtattcgaaagaatagttgaataattatcacaaaatagcagactttttaaagatcagtgttcctacagtataataaaataaagcaacagatatatataacaatgtctaactctgaattcacatgatagataacagatattgaatatgaaatcataaaaccaaaaaaggatgccaaagcaattggcatgttactacttcaacatgtaagcaactatcaacttggaccattcggcccagaaaaggctgactgtagaagcactaacgcccttcaagctcaacaattgaggggtcgtggactgtcctgcctagaaaaagtcgaccattagaagcatccacaccctttaggctcagcactcaaggctgtgaacagtctggtcacagaggtcaaccgaatatagtgaatggatcgtccaatgtagaatgattgggtattctaacctttggcccaatcacattcaataaataggggtgacccccttagtcacctcaagtcacacaaaaagggcttactagggtttctttgaggactccttagtatgctggacataaagattgtttttgacataataaagacctcattcatttgtaatttcatcagtcattgttttggatgtcacatgataattctattagatatttagtgcttttcttaagggagagtgtttttcacacaaaacgtgagggcaaggagctcgtttgcaccatttcaaaccctaaggtattattgacatgtgatcataaattgaaggaggtaagcaaaacttatcctaaccattacaatcagcaatgagcataaaacgacataccgtgtctccttcatttaggaaaagctttgcaatttcaattccggcctgaacgagttaaacataataactacattagacagttttaaaaagcaaagaaaaactacattcaatagagaatgcagcatcatttatcttgtcatcttatatcaaccaaagcatatgtaagcacaccatgacagaagaatacaaatttacttaaatttctgaaaataagagaatataatttcttcataccatgatgcagttgcaataccttcctgcaaaggcaggttccacatatgcaacagccaatatgtacaatacaagttcttagaatgtgggtttggacctaactcaatcctacaaaatcagcttgtaaggtgaggttgcccctacttatatacactattttgaccatatcactaatcgatgtgggatctccaacacaagtgaatagatatatattcaatttgtcctcaaagctgcacaattagtgactcaaaagtaaagagctccaaagctgcaaatcagttcgcaggttcttttgtggtagacttaaaatatcaaattcaaatatatgattaatttttcttagagagctagtcatctgcaaaaaggtaattcttttaactatttgtgcaacctgaaaacagaagcgaaataggcagagtttacaaataggacagtcagcccatgtcaacctacaacaaattataggtctatatccattggcagatgcaccttatctgttacctacggtgggggcaatcagattttttttttatttgttaatgtatataaaaaaaaattgcccccataaaaaaatttaatctaccaacttggaccaacatcaacatcaacatcaacagcacctttaacccaaataattggtggtagatgaaccaatgataaatcgaaaataaagcaaaagagaaacagagttaaatataaaagaatggagaggagaagagaaaagaggaagaaaaataaaacagaaacaactgaacataaactactaaagggttaacctccatcagacttatagctttctccactccgtcctaaacatacgtcccaatctaaatccactccattagtcttgtttaactacctttcccaggtaagtttggtcgacctctacctcttttatctagctcttgtaacatactcttgttctaacaggagcatctaatgtcgtctcataacatcccaaccatctcaatctatgctctcatcttttcacatactgtaccactgatacctttcgaatatcctcattcttatcttatccatcttctgtatccgacatcacctaacatccataagacattcaatacaaaaactacatgataagcccaaaccatttagccaattctcattactgttacaataaaaaaaaaaaaaaaaaaaacaccacactgcatagggcacaaataaagattatctttatttagataacgattagctaaatatatcttttagtaaaagaaaagatagattaaattgttttcctttacatatctttttgaaaagatattagtattataatatattagattgaagataataaaaataagagataaagaaatattggttaaacaaatttcaaattatgtacaaatacaaggatagacaattcattttcctagaatcacacaaataaacagtctctcttgacattaatgggttactcaacgattgagaagaaggaagaaagtggaaaattttgttgaggcaaaaataacgaagaagtcaatttacttgcttcaagaggtgactacattttcaaaacttccatggtatacttcttttatgagcgtttttttttactgtgttcttaaagaaatcaagattaatgttttttagtgtgattattttaatgaaggatgttacatttcacactaaattagtaatgacaatgaaaaaacatagaacatttttaaagtatgaaaatgcgtaagaacaattgtaatttgtagaagcttaagtactttagatttttttatcatgatatatgtattttgtagtacttgtggtattttacttttgtgaaaatattagaaattatttcttgctcccactaagaaaaatttctggatccccactttctatatccataggcaaaataatgagaaaagttactatggtcaatgaagattataaagaggaccccatcagctcatgtcaaccataactaagtcaatgattttatgttcaagacatatgcagggccatgctaaaaaaacaaatcgaatccattcataaagaaatggtttaatgacaacttacttatacaccatttgtgctacttcaagattaggtacacgtaatatatttaattcataatttcatatacataagaaaatcactactgtagtcaatttcaaagaagtgaatcaaaatggtaaaggtagatagggttatatgcaaaagcaacctgtactagcccaccaagattgtctctgagatcaatatgaaatatgaggcacccatgtcttgaagtcgtttcattgctgcaaaatccattatttttctagtgtcacgtataaaaaagtggaaacaactaataaaagagtccagaagcaattataatacaaatcaatataaggatccaaaaaagcagcagccttactttactaacaatgtatggtattcattcttgcatgggttacatagcctagatgacaattttttatactaacaacataaggtaaataacaaacccctggcagatcaatgtcaagttattcagaggcgaaaggtgtacttaacatactaggggtttttaatgcttgaggcaagaagcacgaaaaagctcacatctgactaagaaagggattacaattgaaaaggaaaacaaaaaatattaaagtattttacattgattttccaatatatccattattcaatcaaaacatttgccgattgtgatcattaattgacttctaagatagacttgataaaagcatagaacagaaccccatagtatattgtatttcatctccatcctttacaagtctgacttagaagtcaattttctctcctcaaaacaatatgtatccgtaatcagttggtctcaaaattaatttagcatccactcagagtaagaattagtaaaagaagacttttaaaaaaaatgctcttattgagaaaacattattattttagttttaaaaaacacatatgaagctgagaaaagcttaccaatgactaagtcttttctggccaatgcattgaactctttgaggcgtatatacccaacaggagtaacaccattgtccaattgttccagccgataaaagactggggtacgagcaacaagttgccgctggacttctattgattcaacgggtccacagttgccatgcttgacctgacagtaatgatctaatattaaacttgaacataaaatttaaactaaataaaactataaacaaaggctagagcagtgccaaactaacttggaattagaatccaaaacctgaatagtcacagatgttccattagggccttgcaacagggatgatacttcaaatgctgattttccctttacctccatgttattgacagccaatatttcatcccccttccagagaaacagaaaaagtaaaggaaacatattatataattcaaaatagttctttgtgcctaccccatttgcttctaggagagaaactaaaggacagagtatattctgataaatggtaaagacagagaaagggaagttgttttgaatggttaaaagaagcaaaaaaaaaaaaaattgttcacctatttactgtaatggataccagagattgcttatgtagcaattataatgcaaagcatgattatttgacatatttatttcattgattaaaaacatagaagtgaaggcaagagagatgtatgtgtagattttgaaggtgaagaagatgatgatttgaagagctgcaaattattaagaatgttcatcatctttgtgtacctgtctaacaccagcagaatgagcaggaccatccaatataattcccagtacctccagtctgaggtctccattttcatcaggaacttccttaaggtttattccaacaccagtcatgtcatacctcgccatcttggagaacttttaacagtggaaaagtccatatgtcattcattaagtaagaaacatgagaagcacagcaatagaaatcaccacaatctatataatctcatacataagaaaaacaaataacagtgaagagaacaatgaaacaagaacgcatcacaagtttcttattgttaggaacctggttcagatttagagaagaaagattgaaaagaatggatcttttatgaaattggagaataatctcctgcagctacaattgtgataattcgaggaatcatagcctcctattacttccttgcttacaagctgccttatgctcagccacccccctcctatttataatttctgaccccttcccaactaactaactaacagcaacaaaatattactatcaatatcctatcaataacctccccttcaagatggaccttgtccccaaggtccaggtaatgaaaaacctgtatttttcagcaaggatctccttcatcttcttcttccattatcatcaacctcagctacttgttcttgcacacatgtgttggatgatatttctcttcacatgtaaaacactcacccttcctcattttctcattcactgttgctggtgacaatctatggatggttcttctaccttgccagccattttcctctgtactaatagtttggacagattcactgtccttactattaactggctgcccttccttcccatttcttgaacccaataaactgggtttcagaaaagtttgaagctctttcctcagttttggtagatttcccagcaccttatgtttttcctccacttgccttgctttcatcatggtatccagcaaagacttaggttcatgcaccctcacttcagtcactatttcttccttcaatcccttcaagaaaatttccttcagaaaactctcatccaaacctctcccagctccaacttgtctttcgaactgcccaatgtactcttgtacactatcatcctgtttcagagccaacaaagcctgaaaaggatttgcaacaccagctccttggaacctctgcaccacatccaatttaaatccttcccaagatcgagtcttgctccactcttcccaccattgaaaccaagataatgcttctccttccaaagccaccaaaacagcttctaatttttcttcttctcttacctcctggagccgaaaatacctttcaattcttgagacccaaccaactggatcatcacccgcgaacaagggcaactccatttgcctccagttgcgcgctactccttcgtctccatccttgtttcgtcccttcctttccttcacgcaaatcatttcctccttttccgaattatccagcgtcgcagccaatcgatgtagtagattctccatcgaacccagtctattctcaatcacgacctggttcaactggttggtttcactcaattcctccattgcgcgttccagtgcttcgattttggcctccatcttcttcgatcccattcacctcacaaagccccaagattggagctctgatactagtgttaggaacctggttcagatttagagaagaaagattgaaaagaatggatcttttattgaattggagaataatctcctgcagctacaattgtgataattcgagaaatcacagcctcctattacttccttgcttacaagcagccttatgctcagccacccccctcctatttataatttctgacccctttccaactaactaactaactaaaacagaatattactaacagcaacagaatattactatcaatatcctatcacttattcactgtaataaatgcaagggcagcaatatcttggaagattcatatgtaatgtgtgtgtgtgtaaatatttctgttaaactatatagacatattaactgttagatttcatcttaaaatcagttggcattaagtgaaattgtccaacatgtatataggctccaccccaagaattgaattgagacgggctatatgggactttccaacactccttgagattcacattgacaagtgactaatgatatgaccaaaatagtatccaagcgtatcctagtagttgttttgtagcttattgcgccacacataattgggtcattattgtgttatcagaccacctgataacgcaaatatacagtcatgcaaactagtatataagtggggcgcaacccttaaactatggagtagctttagtttaaaggattgagttaggctcaatcctaagtttagaccccttccatagatgtctgctagctaaaacaggtgatggcgatacacagagagaggctataacaagtaagcataaaagctgcaccccaggaattgaagcagacatgtgggtctttccaacactaatactattgattaacaaacacagtaaaaaggacccatgaaaaatgacctcatcaggcgagagaaagcgagtataaggatcggccaagctggagagcattcgtttgatgatttggtgcgcctttgatcttgtctgaatggaattgctcaaaatagcttccctcttcagctggaaacaagaagcgctatattagcatgagccatgaagcaaccaaccatgagacactatgagagtaagagtagttgatgttagttacctgccaagtgtcctgggaccatctgtggcgaccagtgtcgagaaaggtgtcgttgacaatctgccatgcttcctcaacgaggccttggttggtgacaacctctggagctgtttggagcgtctctagtaagggcaccacatcaggacaagtttgggaagcagagacagaggggaaggagaagacaagcccgaaggagagagcagcgccgaggagagtgttgcgaaccaagggaatgggaatgggaatgggaagatgaggagctttggagaggaaagttggaggtgctgagagtttcatacacacatagccactcatcttctgctgctgtcttttttctttgtcttgctctttaacattaacatcgtttcagcaatgtaggcgtcgccacttcactcgttccttatgtcatccgtaggtggatcccactcatcatccccaagacgataggaaaatgtatacttttaactcatcaaattttaaaattttaatatttttaaaaatttcaatactttttcattctgtcaaaaatgtttattttcgtctatgttttaaagtttaaaataatcaatttaatataataacgattatcactatctttattttattttaaaattataaaatttgaaaaaatattatcatccatcatcttcttcaaccttctaccatcacccaaaacctccaccccaaatagaaaaaatcataatccaattattgataattccaaattcaaatcaaaatcgtaaaatcatatttcagcttcaaatcaaaatcctaaaaagaatttgaaaaccaaagcttattctctttctctctcacacattatccatccttgttccagactttgtttttctgcgtgctttctccgttgtcactcatacaggtaactcagttgtgttgcttctacctctgcttccacttgaaccaaacaccgtcattggatattattatattgacggtatttgtatgtatgatgtagtcgaggacaatgtcaggtgttcctctcttcaacctcgctcctaatctcactgtctcaaggctctgcttaggttactctcagcctcattcccgaaccatgaaattctattcattcacttacacgacacttgtggttgtgggtggcaggaaccatgactttcggggagcagaacacgctggcggagtcctttcagcttctggaccaagccttccattccggcatcaacttcttcgactccgccgaaatgtatcccgtgcctcagcaccctcgcacgtgcggcatgagcgaagagtatctcggccgttggatttcacaacgaaaaatccccagggatagcctcgtcattgcatctaaggttctcttctctgtctccttcgttgctttgtctcttttctttagctcaacttgttcttattgcaagactaggttgctggaccttctgggcagatgacttggattagaggtggtcctaaatgtttggatgccgacaatatcactgaagccattgataataggttacttcctctcttaattctttctcaattcacaccctacatgcagactaatcttttatatcgtatatgtagagagatgctggacaaataatactagtggaaactgtttcaggtcttttttgctcgatctaaaatgaattgagcttctcctgtaagctaaaattaacttatgcacttaacttttatagaagctctctcgtttaacttctccaaaagtctttttttaacaacccctccaaaaaaaaaaaaaaactgtaaagagtttcatttcagctggactatagaataagaaaggaaaaaatgatcagaacaatagtgatggagttttagattgtgatggctcataatatacactcaagagaaacattaagatgggggtggaactggagaggaggggtgcttgtttggaagagatataagatattattaagtttgcatcttatgattctctttctagtaataaactctgaaagcttttgttattgaatttatgcagtttgtcgcggatgcaaatggattatattgatctttatcaaattcattggcctgatcggtttgtatgtttttgttagtttgaagatttggacatttgtttacattgtttttgaatattacatgttcgtcgacttcttatttttgtcccagtggacgtgcaatatggattttaactcttgaaatgttacaccttgtagttatgttccaatgtttggagaaactgagtatgacccggtccaacaatatgcttcaattagcatagatgaacaacttgaagctctcagtgcagctgtgaaagctgggaaggcaagtggtatttttaaatagtttcaaattgtcaacctgtcactcttgtaattcctgaatcatgattcatgagtatgaaaatgaatgcattttttgcagatcagatttgttggtcttagtaatgaaacaccttatggcttgatgaagtttattcaggttgctgaaaaatatgcttcacacctgaagatatatctttgcaggtttgatcacttaccatccaactccggcagtatttttgtttattttcatcatggaacctcaccctacaattccctctatgaaagtttatttcttacactaatttttttctgtttagtgacagaattcatatagcctgctctgtagaacttttgattctgcaatggccgaatgctgccatcatgagaggtatttaatattattgttagatatgaaatcatttatgtgccttcacccagcaacttccttttaggatggttcacaacatggtatgattggtatcaaagcctctttgactaagtggtctagagtttgatctttgttgaccctattcttctagataaaagttaaattttaggacaaggtagggggctagtgcattgtcccactttaagcccaaaggttgcagagggggcatgttagatacaaaatcatttatgtgtcttcacccaacaacttgagtttctaggatggttggttcacagcaattttaaatataagtttgatattacttgattttggtcttccaaaagaaggtatctaagatattctgagttgttattcggattgatatgaaatgttggggtttggggacataattgagagggcagaatggattaacattaacaagcagatttatattatataaatcagatttaatacaagcagagtcataaaattccatttaatttagatagatggaacattggaagcttaatgcatgaaaatttataagtttactacatttgttggcctaaatcattctcctgcattttctatgaaacctcattgtttataattatttatcttttcagaattagtttgttggcctacagtcccctggcaatgggtatactttcagggaaatatttttccccaggcggtggtccaacgatgctcgtttaaatctttttaaaggttaattgacatctttatagatatgttttgtcttaccagctttttcacctcttgccctccttcccaacaggaaggaagggaaaataaatgttcctggtaagtatgagtttgccaatgatactattgttattattcccagggaagtattcagaaggagaatctaggtacaacttgtccaataaaattataaaggcagctactgtggtagtggattcttgtcagcattgttgcagattgcaatgctaatactttgattagcttattggaatctgatatacatttccttagttttcaaacacattttttatttttgattagcatatataaagttttcttaatttaagagcatacgatgcgatgtgaatggggaaaattgttttaatctgaactgatagccttagaacttaaaaacatgtgcaatagctagatgctaatattcataggtgtggacatttaaaactgaacctcatggttaactgttgttaattagaactctgttcctattatttcttctgtttactgattttaatctccatattcatatatttccccttctgcagaaataccttaatattgcaaaaacacatggtcttcatcctgtatctctggctataggtttgataatcttttcctagatcttcatgtgcaaccccgcatccccacccccttttatattagtgatgtaatttgcatgactccaaacgcatcaaatattaaatcagatggctggtccaccatattggttgatagttgataccgttttacaaggaggagttgctaaattctaatacctaaagtagtttggtagctgcacttgtactgacattgcctttttttagtccccatgcatatgttttaagtaaattcataggtaatcaattacactgcgtatgtagaattcaataatggacagtctgtcaactgtcaacactgatagaagttggtaaattgggataagtcatgccttcaaagttggagtttttgcttcttagtgatattggatgccgtacattggcttcttctaaataaacaagaatgttctgtttttttccttccttttttgtcttactattttaaaaggatgccaaaaaatggtttaatttagtagtatcttatcattgctggagatagttattaatgcacacgcataatgcaattttatccatcatttgcaattaactcatgctttttcattttttaaaagcatccattgactatgttattgttgtggtccttgagcttatccattagaggttgtggacttgtggggcattagtttattttttaattttatcctaattttatttcctgttcatttttgttttgagcagcttttgttttgcgacacccccttgttgctagtgctgtttttggggctaccaaatcatggcagcttcgggaggttctaaatgcatgcaagattgagctcacatctgaagtaattgaagaaattaacaagattcattcaaggtttccaaatccatgtccctgaagaatacaaattattaattaataatatgacgaacatgtttgaaatttaggtaaaaaaatactttttaaaaggataaggattttttattttgctttcattttatttttatctattagatttatattaaaatgtgtggggcaataatttcaacaaatcaaacatttaccatctcattatcataaagaggcagaagatagcgtagtcataactcgtaatacattatacaataatcaattcgcgacccgaaaatcagaaggcgaatataaaaagagagcatgttgaatgatatattttcggcaaattgttaagtatacgcaataaatataatattagtagtatatcaattatcaatcatttgtattcttcgtggatcaatactcctgtgggtcccacttttactccatatttcaattgaaacccacatcgattattcaatgaacaaagaaccaaaactatcttcatttggtttaacaaccatattttcttagttttttaaaatctttttattattccagaatagtgcttagtttatttgcatctatacgctactatgtctcgatgcatatgaaaataggagagagagagagaaataagttaaaatatttctaaggtggatgtatttattcccctaaattatttaatatagaattttgttctcaggcctaatggctaatttggttggagagaagagaaaagaatggaagaaaattaaaaagaaaaagagatgtgagatctaaatcaactgtgacattttcttttcctttcactccaattttttcgcagtcaaacatactataaatgcatacctataaaaaaaaaaaaaacaaacaaacgcatatctcatgtataattggaattgaatattctttgcccatataattactattaacatagcctaacctaaaattagaaagaagatttgaattttaaaggagaagttgttatcctattaacatcgatctgggctgcattaacacatcatttaaagttctaagtgaaattacagtaaaaatgatagttaataatattttactacttatttgtacacttggaaacgaatttaaccttttttatatatagaatttaatattcaagttttttttcattttaatttaactttaaaattatcaattctaaaagaacttttttaaaaaaaattgtatataggtacatgcttaattctttttacgaaccctagtgaaggctggaaataaaattgtatgtaggttataatatgccgttaaagatataataggtaaaggaaaagtgaatttttttataaaaaagatatccctttattttaattttttgaaggaaaagatatccctttattattagtattgtatggagtatattttgttattagtgttattatattgttttaattaattattaactatttagtattttctttccaagggaattattagcatttttagtaaagattctattgctcataaacactataatccgattaaatgaactaagtggagtatattttattcagaataaatactgttatcactcctctaaaattacgttgaaataaaaggatacacacacgcataaattaatcattgttaaaacactaaatcagaaacaaagcccttactaacgaagattttcagtttctcacaaattgttgattaatggttatttccagaaaaaaggaggaaaaaaaagaaaaggaaaaaactccgaagagagaagaggagggttttgtttcgtttcgtcctctttccgtttcgggtgcaaatcattgacaggagagagagagacagaaagagtgcgtgtgagagagagaaccagcgcgcggagagatattttaaacgcggcggaaccctaacgaggcgagcggcggcgggggcggcggaggcagatcggagcgcgagcgaggaggatgagcggcaaaggcggtgggggccagaaggcagggattcctccggcgagtcggaagatggttcagagcctgaaggagatagtgagcaacatgcccgaacacgagatctacgccactctcaaagactgtaacatggaccctaacgaagccgttagtcgcctcctctcccaaggtataacactgcactgcactagggtttttcaatttcaatcacaatcactccttcgaacgtgcctaatcttctgtatgttcgtttctcgttgtgtagatacttttcacgaggtgaagagcaaacgtgagaagaaaaaagaggtgcgttttgagttacctttagttcgttttgtctttatttttgtagatgcttgttatgaggagttactcgagttagttaatactttgtttatgtatttgcttgtgatgctcagtgacgagatttttttttttattcttcagggtaaggacacaacggattccaggtctcgtgtggtaagcaatacatctagccgtggcggtggtgctagggttggcgctgaccgttatgttgggcgtggaggcgctactcaatttagtagtggtggtggtaagcggatgctggttgctatttttgaataatgtttggattaattaatatgctcttaacctaatactttatcaagtagtatttcttatgtcgctattgttgttgtgttgttgcttttttattattgtttttgttgtcatcatcatcatcaccatcacatatgtttggaggtcagattctggtctcctgcagggaaaacctgtattcaaaaaggaaaacggaacacctgcttatggaggtcttactgctcctgcatctagcgcattggacaataatgtaaacaggcaactaccatcctacaggtatattttccttcaataattttgtgcactactggaggaactaaaggaattcttgtggttatgataaacaccagttcgtggttatgatctgtttggaaattcagactgttatttaattgtatttatttctggcatttattatgcttcctccagttttttctgaaaagcaagttagctcacttggttgttaaagcatccaatccaacttttgcaagctattttcaatgcagattcacttcgattcttttctcagacagttggtgcattctgtaccacttattcactggattactctatggttctgctttatctcgtgggatgaactttataaccgtgcaaatgttcatttttctcttccaaagatataagacaccaaactgatcagaaatgtcttctatttgtaaatttttgaatttattataaatattttaaattggtcgtccaataaaatcaaattatctttcaaagtgatatattgtcatcaaattggtttttggaggaagactctgatggcattagtgatcatttaaggatcaatatgatgttgcatatatgttgagtgggccaaagttagtgtttagttgtttactcatttgtcttatttttttcaaacaaaagttttcccgtaagcgcttgaatactgagcacacttttagtatgtaagatagatggagcgtctcatgaatgttcaaaactgctgtagtgattctgtccgtgtctgtgatggtctatcttcatcacaacatggtgggttgcaatctcaatgggcggcgaacccaggtcaagtatcaatggctgacattgtcaggatgggtaggccacaggccaaggcatccatgcctaactcttctgtccacagtggtagccatcagaatgtttttgcaaccccagcaacttcacataccaatttgcattcattgcaaggtcatgcttctaaggtgtcagagacaaataatgaccatggctttgctattaactccaatgttgaacagaatgatgaatggccatcgattgagcatcaaccagctgtttctgtatcctcggttgtagatgatcatctaacatctgagtaccatacaaactcatctaactctggtgaagctaatcagcagctgaagacccatgtaaatgaatttgtagctgaagatgatcatgttgagaatccagaaaatgttggatctgcttctatatctgctaaaagtatatctgaagagaatcccgaaagtacatctgtttttgatggtagcttgtacaaggacttaaattcctaccaacctcatcggcatcctattgaaactaatgaaggtgactaggatgtttatcagtttgcatgtcttgtatgtttatttatatcgagcatatattttttacataaaatttgttaagacttagtgtggataaacttcttgataagcatttgtagaaaaagaatttggaggtaaattaaatcaaacttctcccttaagttaaaagtaaaatatgcaccttagcttttggaaaagtgaagttagatcaaagagcctctaaacaaggaaagaagtttgatttattttacctttttttgttctcctataagttcttattgagaagtttgtgcaaatagggtcataattatcatgtaattagagggatggtactggcacttccatataaaattgctttgaaattccttagttttcatgttgttatctcttttatccacgtatattctgatttggttgattgggctgaatcgttgaagtcatagaaatagcataatgaaagaatatttcaatatccttttacaagtcaatcaaagttcatcattgttgttattgttattttgttgttgttattattattattattattattttgtttttattttctttctcatccttttaacatgtgaatagtttaaaaggagttattttattactaaaatagtcatgtgccctgatctctaatggtttagagagttattataatacaattatttgaagttcattcatgattatatcaaacattcgcctacatgtaagtcctaatttcgtaacgttttctttcagctgaaggtggtgtttcatcagtggccgcgaacttagagcagctaaatttacactcaaatgatcaggggacagaacaagaggaggaaaattcttctgtagtaattccaaatcatttacaactccattctgctgaatgcttaaatctgagctttggaagttttggatctgcaaacgatgcttccctttctggatctgacccatatgcatctaggcccttgaaaagtaatttggaagatacatctggagcaaaggatgtttcaacaattgggtcctcagatgttaggcatgtgcttagacctcagtatactttgctgcactattctggtcatattttacttatgtgttttttttttcttgcagaaaccgtgactttatggcgatgagcatcttactactacctctgatgggaatgtagctcacataactggtgtggatgctgggacttatgagcattcctccatttcacaatcagaggctttaaaatctgaaccccctgaaactgctcaggaaaatcaatattcatttccttcttcttcacacgagtttacttacgaaaatgcccaacaaccgatgttacataccctcattcacagacaagctcacagatacagaacctgtctcccttctctagtgtaatggtaatgcataaattttatatcttatgacttgcaatattcagcatatttcaaggctgggtcttattttgggtgttaagttaattagagttggttctaaaatgatttgagatcttatagtgttaaaactaggggatgatcagtgctgctattcatctctttgagaataaatcaaagcttattctctccaaacaatagaacttgtggtagagtactgttttactgtaataaatactttttcgaatggacatttttaagtatattttatgattgaattgggaattgggcatagaaatgcctccatttggatatttcattcatattgttgggtggtgtatgatttctatcacaggtaattgagttgagtgtgaatttcaatgctcagttgctttacttgtatggcaacttattactacagtaacttgtacttttttccagaaaactataatatggtgcaggaccatttattgctttactgaagtaataagccatatatattatgtagtttcttttatcttctaatattaatatatgttgctattctgctatttgcactaatcttatagtgctattgtttagcaggcttatacaaattctttgcccagtgcactttggcttcaactgttcaaacagcaagggaggatatcccatactcacccttccctgcaacacaatcaatgcctgcaaaatatagcaatattgcttcttcaattggtggtcccactataaccatgtcagaggtgaacttctgctctagcttattttagtttttctatgtacaagcttttgagacaggttggatcataaataaatttaggattacagcttacagagtgttcaattattcttgtttccaagaggatgtgtactggaatttgcatgtacattatgtttgggggctgcagttatataccaatattttggttaacaataagcactaaggatatgtttgcatgtacgtgtattgaataccaactgtccagttgacttccatgtgacatcagttaaagatctgacttacattaagagcatcacaaatcaaaagattatatcttggttcaatcacttgtgtcaaaacggcattttgcatgttttgctttgagctacttgagtgcttactgattagtgtcttcacatgagctgatattttgccaataactgttttctacatatgaacttacaaagtttatattaattaattaattaattattagcaacataagaggatgtattggatgagataaggcatttggatttttatgcctaggtgtcacatcaattgtatcctgtacccattttgtgtttgattcaatacaagtatttctacactctgcagtgcaatcttgtttctttgcctgataaatggctggggatctatctgtgataaatcttgtgtgattccatttccatgtatatacattttattatactactactagacaaatccattcaatgttactagtcattttggtttcccataaaaatatgggtgaaaaatttgtagatgatatatgtatatataccgtgtgaaggtactggtcttgcaatgctatagttatttttaaaaattaagatcctggtgagacaatatgtattaaataaaatgtttatatatttaaaaataaaaattaaatttatcaatatgtgattatcctatcctaacccaagtttcatgctttctcccactgtcaagtcctgtgatacttttatggttggcaagtactttgagggtgttcatatttgaaaacagacggaagtctaaaaacacaaatatggatgtgtatgagtgcatcagtattgaatatggatttgatacaagtatctgggcattacatgcgtgtgaaagagaacacaggatttatcataaatctaagaaataatataaagtcatgggtgcaatttatattgaaattgttttccaatgattacatttgcacagtttaatgttatatctgtatatatgtatcttgattttattgttttttattaagagggagaacatgggtatttggtatcattaattttatttgtcaactcgtaggctctaagagctaataacattcaacacctcaacctaatccacaagccatgcctggtgccaatgttgccactggacctgcacttcctcaacaccttgctgtgcatccctattcccagcctactcttcctctgggacattttgctaatatgattagctatccattcttgcctcagagctatacctacatgccatcagcatttcagcaggcttttcctggaaatagtacataccaccaatctctggcagccatgcttcctcaatataaaaatagcatttctgtcagtagcttacctcagtcagctgctgttgcatctggatatggttttggaagttccaccagcattcccggaggaaattatccattgaacccacctgctgcgcctactagtacaactattgcatatgatgatgttataaactctcagtacaaggagaacaatcatatgatttcactacagcaggtataaagatcttcattttaatgcacatttaactgtttttgttttccatatgcaatttttctcttgggagttgagccaatttggtttcaacagtgcaacctttacaaaatagttattttttagtttttctatttatgcttgtgtaaaaccatgatccttttaaagcatgtaaacaaaaggtttaagatgtgtttcattttgttgtcaacaaattactgtcattttttgttgtgagggaatggggtagactgattttgtgttttcttctgtcagaatgagaattctccgatgtgggttcacggacctagctctcgaacaatgtctgcagttcctcccagcacgtattacagcttccagggacagaatcaacaaccaggggggtttcggcaaagccagcaaccctcacaacagcattttggatcccttggataccctaacttctaccattctcagactgggatttctatggaacatcagcagcagaatccaagggaggcatcccttgctggttctcaaagccaaccaccaaagcagtcccaacaaatatggcaaaacagctactaatcttattcacctcccggtttttaagggtcttgatgtgagtttgaaagtgactggtcacaggcatttccgcggtctaataattaaaatgtgccattgtttggtcccaagagaccatatatggcccgctgctgccctgtgcgaagttgtattctatacaagttataattatgctcgtgatgtttaacttaggtatttaagtgtgctaattttgtgtacaacgcacagtaccctttttatcaacattcttctcatctggttatagtggaaagtttcttggatgctactaccttggattttactcctttcattcttgcccccttcccttttatatatgcatgtctgtcgtttacctgagagttaccttgtattactgtctttgttccttttaaatataatttaatgtttttgctttttattgaaattatctaattttgtattatatactatgtttaatgattattttgtcatttattatttatttttctctttaacttcatgatttataaattgtaatttaagtgaatggaagcatatgattaataaaatagtttaatttttagaatgacattctagcaatggtagtttattgttattattccttccgatcttatttataaaacacggttttgaaaaacattattttttctataagactttcaatatctcgcaataattatttttactaaaatatttttatttattttaattatagttgattgctactcttaattgtttcttctctgttgaagatgaatagattctcaatagtattaaggacaaatttggaaaatattataaatataggtaaatttaatgttaatacatgatatgatagaaatagaaaaaataaaatatatcgtggagtgtttaaaatgtaatctcacttaaattttattgcaacataaaactttcaatcaaaatattacggattgtgtaattttgttttgcaaatccaattcaatatgatgataaatgagttgggttggtttggattaattggatttgaatatttaaaaaatattttttttttttaaaaaataatatttttaataataaattatttttgtctaaattttttaaatatataatgattgaatacattcaaaaagatcaaattgtaaaaatatttaatttatagattaaaatttcaatactaatacaatattcttattttagataaaataaaatataatattagtatgtgaaaatattaacaaaattaaaacaagataagataacttaaaaagaaacaaaatcattggtgttttaatttaaaaatttaataaattatgtgagttcaaaattattaatatattttatatttaataattaatttatatataataaataaactatataatttaatttatatatatattcaacaaatatttagaaattcaactcattgaattggattgggtcacgactcacgagaacaatgaagattcctaacaattataatcaaagtttatatcacaattataatgaaatgatacaaaaaaaattgaggttgtttttcttaatagaaattaaactctaacttgtattatttcaaaaaggaaacgattttgtgtttttttaaaataaaaaaggcatacacatggtattgcaatttgaccgagactcaaggaccaccgctaccctccaccctaaacatagtagtgcagaacaaaaaaagcacctaattatgcatcacaaaaatggaagctaacaattcatagctgttctgttctgttcctatgggatactaccatcacaaaaggaatgaccgtctcatattattatcataattattataatattccattcgcgaccttcatttttctcggagtttcaaggacgtggttgcagtggtggtggtggcagcgacagcaatggcgcaaggcatggcgagtaaccgcaaccggaacgcgagcgcgcaagaagcgcgcaaggtgatggtggtggcggacccgacgcgggaatcggcgggcgcgttgcagtacgcgctcgcgcatgcggtgatcgagcaagacgagctgattcttctgcacgttgagaaccctagctcgtggcgcaacaccatatcgacgttcctgaagatgccgtcgttgggaagctccaccactacgtcgctggaccttggaggagggggagccgcggcggatggagaagggttcgattttctggaggagatgaagcatgcatgcagtgtttctcagccgaaaatgaaggtgcgtgtgatgaagtggagatcgatggaagagacaaggctagcactattctttctctgagcaaaacgcatggggttgatgtcgtagttattggccagaagcgcaatattacttcggcgttattagggttagtatactacttcaaactgctatttaattttctgctggaattattcattcttatcaaaaatgcattgttggaactggattataacgccaagtaactttagattaaggggtttccgctatagcccaacacgggaaacattcagtcttcttctatctcattttcatcccatttttttcttaaaattttcctatttctttttcattctatcaaccttttttcttttctctctatctctctattttccattccaattcaccccaaaatgggattatatttgagatctactttctgtattttcttaaattcttgtctcaatgaagagaaagacagattcaagtattgtttccatagtgtttgattaaagaaaaaggatttttaattttttttttttatttcatttacaagtttaaacaaaggaaatagaagaaaaaaagaatcaaaattcttcctctgtctctttctatctctgctttgatatgagatttgaaaggaaagaaaaatgtataaagtctgtaaccttttgtgactggattatttttaatttgaatacttaatagtagaatttaattagaatgtactaaaacagcctacttttgtaataatttaaaattatttataattaatccattatattaatacaatattagttaattttcttatggtagaatcaattaatttcacgtttggttcatgatcaatgcattaaaaaacttttaaaaggaatttaatatgtgcagtatgtgttgtagaatgctggtgtagaagttaattttatgttgctaacttatattcttcttttgtgtttgaaatttgaatgcatggcaacagatataagcgacctgctggtggatctatgaaaggggtgaaagcgatagacactgcagagtatttgattcaaaacagctcgtgcacctgtgttagtgtacagaggaaaggccaaaatggaggctttgttctcaactccaaaacccacagaaatttctggctcttagcctaaaggcttcacacccccatggccatggatggtagacatttttcattacggcttgaacatatcaatttcgctgaggatagatttaggagaaacttttaaatagacatcatatcatatattattattacattattcattaggcactcaaatcatttaactcccagaaacttacatgggtcacaactaataatttgagtgcttatgatcaataatgtctatctaaaagttattctagatgtagtgaaattggtaagatttccccgtaactttgttgtttgcaaatggtgagaacccatggatgttatcccagattacctaaaaacaccatctactcatcttaaagacgaaaattttctgcttatctcaatgtttccaaggagaaaattctgctaacaaatgtcataaaaatgttagttaaagaattaatcaatagatagattaaaaatcacagtgtgttgcttgataaattaaatgttaaatttttacaaacttttcactatggatttgttagcaagtgttcttaacttactagcagcaatctatcatttataaaaggacatacacttaataatggaacaacactctcattctaagattcctccatgtatgcaaacaccctagcagtataaaaaggcagaagcttatctgaaactcaccagatcacagttctgaaatagacgtggataaattttgttaaaatatttgcacattcttcatcagatttgcctaaaagcaaatctgatataacaggccccaacgcaaagcttctcttgtttaatgttaataagcaaatccgtaaagtcaagccttctatgactgtataaaagaacttcatagaagcagacaaagcaaaacaatccttatttcatttgatctcatttgaatataacagaactattgttgcttgtaagctatgagaaacaatttaatggaacgaaaaatttacttatccctttgaatctttgatttcaacctttcggttttaatttcatgttttagtacacgatccgtgatgagtactcgtgtatacatatgagaaaaattcacatcaagagaaaattaaaagcttaaaaatacacttgccttcataagttagtgcacacaatttaaagaataaacaagcccgttgaattcttcaatcttcattacgcattatattgacgctgtgatgaacaaatcatgtaactccttttctttcaacgggatcaccttcctccacatccaaatttccaccatatgaagttatgagttctcaacataattgaagacgttatagaaaatcagctccaagattatcttcaggaagcaaaagttccaccaacactgtgtacactctaactgttgacataagaatttcatttttcaaaacaccacaggacgctccaatcttgaaaacattcaattgtgtgcaacttacaccaacagttacaccttcgtacttatcatagaaaacccacaaatctaagtgtgtgccatagtttcagttctgagctaataatcactgcaatagaatccttgtaccacagcaagtttttaacagcaatttaaaaaataatctttaacagacgtgttgaacgaaataatcatttcgttactaaccttgtcactcacctccacagccacccaaaacaaagtttcctccaacgtcacactgttctctgtccaaaacaagtatccattcacagttacacactgattactactatattgactacaccactgaatattttcaactcgaacagcacaagtttggtgaaataaccaccaaaacatgcattgtttgtgtttacaaaagagtgttgaaatagaagcctatgagacaatgtggtggcatcttatgaggaagcaaagcgttttgtggttccatgattcgcttggtttgtcttgtagctgggttccaaagaaaaatggtagagctttggtccaaagaataatgaacgacacaaagtaaaccgttacataaacccacaacttgaaacccatgtcagaatctgtgacttttggaacatgaagttgtttgagcttttttcttttgacatctagcagaaataagtgatggccgcagattttgtccttccagtgaaagcgatcgaggattagaagtgtgtctcttcgatgaagcgaagaaaatggtttgagatgaaggacttgacactggtcagcaaggacttcattgatggacttttgagaatgactttgatgtttcttcttgttctaatgaataggaagaattttcatctcatttagaagagttgggtgctaaacatgagaagaaaccttttttttttttttttgaattctgaattttggattatacagtactactgtatcagctctaaagaaatactactagtactaggcttaattttacattaaaaaatttaaatgagcattgaaatcaaaagggtagaatgtgcagaagcaatttggaatttcgaggctgtcttgcaatgtgagtcatattgcagtaattggtgagttgatttcatttgatgaatgatgatggcttggtggaagtggaacaggttttaagattagatcaattggcggaaacagtgaacctaattgatctctgaatgagggatatgataagttacaagttaacgatgattatccacctcaataccatacattcaattttgtttcttaaaaatgaaataatttccatatgttctccttttctcatgcagctaggtgagtaggtgcctttttcatcttgtgagatactgattgacttgagtagaatttgaagggaaaaaaaactcactctgctctgatcacttgagataaattagattagattagtttcaatattttttttttctcaactaactcaatctaatcataatcaagttttaaatttagactatttagtcattaggttgtacacttgcacataattaactattttataaaaaaaacaagattaaaaggagagcaaagtttcatactatattatatttaataatatgtttaatgttatgcaccaacggtataaaacaattttacattgtcattcaatataaatcactatatgaattattttaaataattattttaaaaatcaatatacttatcataatggtgaattataattggatgattgtaaaaaaaattatattgttagtgtatagcccattttttcttcaattatttgtctaatttttaattttttgaaatcatatttataaaaaaaaaaaaaaagataaagataaaagtttggatgtgtgatcaagtttgattgggtcaacatgcaaatcttacctattgatatattaagcttaacacaattgatctatataaattatgaaaaacaggtggtttgaattttttatttttttatcaattaataggatctaactgctagatcctattaatatatggatctaaaaaaattcatcatcacaatagaggggatatcatccattctcctctttgtgaagaattactcaatgtcaattaaattgaaataattctagagaaaattgaacaaaatcataggacaaagactagggagctaagtaaaaatcgtttgagaatcatgtggtaaggtaacaataaaataggggcctaaaactattaattgatcaacctactttatttctcaaacataaatagtagtagttatttagttatattattctacaaaaagattcacacatttcaaaaaggaatcaattatattagcaaaacaataatatcatattccgtaaaaaaggaataatatatcaaaagtacaaatcagatgcaaatgcatgtataaatacagaccttgtctccatggaaaatatcccaaatacagtatggagtaacaatgtaacatgatcaggaagttatacttcgctaatccagatcagtttgaactcatatttcacatgtcacgaatgagcttcaattttcaaatattgcaaaagtaccaaaatttccattaatgtaccccagaaaaataactgcaaaagtacattgtactaaaatcatgataaagtgtagtagcgaaagtagctgataaagtgccctacacatacggctctttcattctatacatacgacaatttcatgtgtatctgttgtattgataaaatcctaaaatactacgactaaagctataaaagactacagaaaataacataaaactgaaatatttcattcattgattaataatattaaagagaatacatttatatagacctaagtatgtcaattaataaataataattatgcaagtgttttttttttcctttactcaaaatttaggagaaagaaatgacgtcccaattcaaacagaaaaaacctattttaacacaagtaaaataaaaattgtaatttataaaatacatatttaactccatcttacatgacccttcaatcattttattttgggcataaaatccattctatcacattgtcactgggttgtgatcaccgaacgcagcagttcgtctcctaaaatcaatctgactttgtttacccattgttctcgtgaaatattttgttcctgactccaaacagattaaatttaatcagttactgcaaatttttaccttacaaattaagcagtggataaaaaaacacaaaacacaataagaacctgaaagcaagacaattatttaatattgatcattactttgaaaatccggtagtcttttgagtaacatagacatttgtgctggtttcaaatggtttgaaacccttgccactatatcgggaaatgacacatatggtgattgaggtttccgtgccccatgtatctctggatctgcacaccaaaaccaagaaatgattaagccttgatccaagcacttgttacaaatttgaaagagaataactgcaactatgctttaatatactctttctaacatattatttattattaatttgaaattattgaacactataaaatcacaggcaagattatttaacagaagtgaaagtcataattttcaatcaatttcagtaaactactaaaaaataaaaaactacttacctcattgttcggagggtccacgctatacgcagaccataactaacgagagagatattgtactcggtcttacccttgatattcaaagagactatttcaaattcgaatatccataaccaacaaatcactaagacacaatttactactgagtaaacaataacaaaattatttaaaaaaatgaactagggaatattttatatacccttaatataattatacttgaaacttataatataatttggatgaatgtgtgtattcatataagcagtccatacaatatgtcttctaggtgctgatatatcatccaccccagtgtcatattgcttagaactaggttggctccttccctaatatcaccttgcatagtagcacatgcctaaaaccatgttcatctgccacggtacacatagcactgtgaattaaatgaacaatttcttagctctatttccacatagacataaaattagttttttttatagacaaatgttagtgtattagaatgtcagttttattagtagagtggataaaattcataacattttttttatcttttcttctttcttaaccatcaaactcaccttatatcccctctcaactctattttcacatagacataaaattggtataacaaaaatagaattggttcatagaaaacattattgcacacttgcacctacctatcaatggaaaaattggcagcaaataaaggaatagcaataccatgacactcgtctttatcaccatctcgtaatggtttcgtattcttcactccttcaacttacattaaccccttcgtaatcgagttctctattggctgctgcatgtttatttatttatttatttattccgatacaataagatgattgatatgtaagtaggctatatttgttttgtgcacttgtaacctcaatatgcgattagcaatgcatgaaagaaagggttgaatatttatgtaatttgtcatgggcatgaacctggaccaagctaaagatgtttccgtgatgaaattatatttataatttcatacccctcagtttaatggatcctctctcatgtgaaaatcttcaccattaactgataattaaaatgacataactaaaatttatttgatacgaaattaaaaaataataatactaagcaatatttttttgctgaatataatactaagtaattacaattacataaaactaaaatttgggaatttaatattgtaacataaaatttaataaattaacttagattttttagggaaaaaatactgcagaagaaaagtttgttaaaaaaaactattacaaaaacagacgtgttcaaaatgagaattttgaatttgtaatataagaatttttttaatttgtaatataagaatgaatatgttgataaatgaaaattgtgtgattccttgtcactatcaagcgtgagtgattctctacattggctttcttaaggctcaagccaaagcagtgatgataaacggtaacagcttccacattgcatttcacaatgcaaattgtgagcacctttttcttttctattatcagtcgtgaatgattttattttattttattgtttttcaccttcctagttcctacttatcaattactgaattgagttgtgaatccgttgtcaaaacaaagttgaagactcccattagatttttttcttttaattttgatgacgagttagcaatagcatccattatctggacgtctctctctctctcccagaaaaaaaaatttccttaattttttccttatgataaataaacaaaacctaattctcatcattgacaataaaaagtttcttatgatacttgaaatgattttatcatccttaataatgatgataattatatatttatcacatttaaaactatataaaaaaacatgcagtagatgtacaatttgctaatcatattaaaattacaagtttagataaatataattttactgaattttatcaacacagttgaacttgttaatcgatgaatcttaacataaaatgtcatcccgaattccattgatcctattcgatacaagttcagctatattcatctaacttactatttttgccgcccgtactatgatattatctatcatagccaggtactattgttacattaacaacaacgataaattatagttagcatgtattagatgttcttatatatatatatataagaatgtgtaagaagatgttctgagctctcataatatggaagaagattaaatggcatcataatcccattcgcacacgtatttagttcttattactaccaacgaaacatcaaaatttcacaacccaaacactgcctcagaaagacatgtacaagcatgcaaccagccaatgcatgaccaaaaatgtttgcctaaaatttgttggaatataaaatgctaagatttaaataaacgctactttcagaaaaataattagaacatttttccttcaagaacaagggcattgaagataaaatgcagataccctctttaaatgcacaccagcacaacctgcaaaactctcccttttctaagcactgggaagtagatgcctcctagattcagttatactttaatcctcatttcgactttcatccttgacaagcttgatcatgtcatcaattcgaaggatagtaatagcagcttcagtagcaaactgggaaaaaaatacaacttatcagacagctgtataagaagaagctgtatcttgaagtcaagaactgttgatatttaactcaatacatacctgaataatttttactttgctcattgcaggctcaatgactccggcctccaagttgtttctaattttcccttccgaaaggtccaaacccatactggggggaaaaagagcaaaataataacaataattagcgagatagaaaagaatgccaaagtttatcaagcatcatttcatatgtattctccattgttacttttctctaatattcattaacgtattcacatgttggaataatacctgaatctacatattatgggcagatgcacaaacttattttacctgccaaattcaacatatcctgccctatatttctccttgcacacaacacccaaataaccaaaaatatggcacatgatattgcaaaatcacgtgagtagcttcatgtcaaatggttacgaagttctgagtgagtgtgtgcataataatcatatacgatgaattaccattccaacacaggttggaagaaatactaatgtttaaaatataatggcacaacaaagataaattcaacaaacagacccgaagctaggaagaagataaatacaaaggaaacaatatagttactattactagtaagcaaataccttgataaatgtttcttatcgctttagtttgtgctgaatggtggtaggcccgtaatttcgcgaccagctcagtggcatccttagcagcattaacagaaagcacctgcaccagttaagtgacaccaacatatacattgtcagtgcttaaatgtttggaaataagaaccaatcaattaaaagtgtctcaaaagagtgaaaagaccaaatatttaaatataaagtcaaaaagtaaattgtttaccacactaaccccacatgaaagtacactagactaaaattacagaatttaattattggacgggagatgaagacaaaactcaaactttacaccatgtgttcaactaggcccaaccaccctagttatttgtaaaataagcagaagacccaaaccttaagccattaatttagcttgtaacttaccttaggaatgattaacagagactcagcaaattctgctatagccaactgctcccgagatcctaacgttgtagcaaggtactccaaataaactgataatgctgcttcaacagcacctccaccagctaccacctgaattttatatattaaaaaaacaagcacaaggaaggcaaaataaaaagacatcatttgaaaaacttaatctaaagcaacattttgatttcaaccaaagtaggattaaagctacgtatgcaggataccatatttgattcaagagttctcttgacaatggacaatgcatcatgcagagctctatccatctcatcaagcatatggtcatttgcacctcttagaatcaaagtgacctacagaagaacacagaatcaggtgataccgcaagctatccacaatgtgcaccagataataaataataaactatcagtgtccccccgtacgagcatgcgtgtgtgagaagatgatgagtaaaaaatatcatatttcttaaaaaaatatttataaatataattttaatagatatccaaaactccttgtgcttttctgtctacaaataatctacaagttaataaaaacttactgcacttgtagttttggtccctttgatcataactacagcatcatcagaaattcgctcctcaacaacctcatcagcagatccaagaaaagatggttcaaatgtttcctccccttccatatcagcaaatgttgagacctgtgtcaaagtaaaaatcaagtccaatataataaaaggaaatagtattcaaaacttctatccaaaaaagaggatactatacaagagactgatgttgcttgacaaaaaatataaactgagatattgttaacacagaagtttggcattaattcaaggaaagtcaataactattaggggaaggataaaaatgcaaattgaaatgaatagaatcgaggataatgattacttctctggttttggcattttattaactacaaattcatccctcgtggttgctaattaagacacgaagctcttcttttttgtgccagaaggtatttaattacaaaagagaaaccaaaatacgattaataaaatgccctagcaaccactatttaagtaatgatcaggcatatataaaagagaaccatcttaaaacatcaagaaacttaaaatgcaatgaaattagaaaaccattttactgccagaatgattaaaagataatgaaaataaatcccttcaccaatagagaccccgggtaagacaaagattaatttagttcaatttaaatttgacattaacaatgttcatatttcagaatgcaaaagggtttcttggatggcaagcttttaaaaatctaagattttaagcaggaaatattcagagtcatcaattgttagaatgcattgaatcagtcgcattcccaccaacccataaaaatagcaacaactagtaaaaaggagttaaaaaaagaaggaatggagccctatctaatcaacactcattatgacaaatattcagctttactgtcaacttgctaacattgcaatttaaatttataaaaagaaaaaaggaaaaaaaaggctaccaatgttgcaccagtagccttggcaacatggcgcatgtcctctttccgcacacgtcttacagcaattgccccagcctcaacaaagtactgaaacaagaataaatgtcagaacaaatgcataaattcatgacttatatgtcattcatcagtaaagaacatgtatcttgaacagagaaccacaaaatccatcaatgcaaaaggaagaaaaccagaagtcatgtttaaagatccataggcacatatgtcaaaaatttggtgtattttcatcattctgaagttagtaaggtcaggcatttattccctaaaaatggaccttggtaactgaattccacaagccacaagggttataacttcaaccttttgtaccatttggtcctcagttttaactatagtccaatacaagtaatgataccgcaatcaaaaaaaatgtataggaatgaaaagaaaattttaagtaaaaatcctatcttctgtcatgtcatgagttcctgggtgtaatgcctcatccgctaaagtattaaaaactccccatcaaacccctaatactcagcttgaatttccctaaatcgataaatccatcaaacaccaaactccaatctaagatgtgaacttcacgcacccaaacagccaccaaacaacccttgtaattgatcaggatgagtaatttatacaagggttaaaacatgacatgctcaactgtcaacagatatatattatcacataatacaaaaagataaagtcaaacactttctttgacagcctaaatgtaagatttataactaaatcctcttgctcgaagaaatatatcgaagaaacataccttaagagccatgtcatcaattcctttagttgtcagaataacattagctccagccttcagcagttttccaatgcgttcttagtcatatcggcctctctgcaattagaaaaaaaggccattagtcaaaatgtattatagatattacttttttttttttttttttttttttttttttttttttttttttttttttttttttttttttttttttttttttttttttttttttttttgtatttactttatcttgcaagatgtatggatggagaattgtcccaaacaaagcaaaagcaaattcccacaatgaaacttaacataagctggcttacaaattagaacaatagtctttataagaactacacaaatcaataactaaccataatattttgagtatttagcttaacagggctttggattgatttcatgctatcatccaagttttctatttatgcctattttatacagctcttagaatgtgggtttgggcctaactcaaccccaaaagctagctaatggggaggttgccccccacttatatattctatctttgtcttattctagccaatgagggacttgggtttttcccaataacagcttattcaataagataatagatttattctcattatatttaaggaaaatgaatccagaaagttgggtatcatagtaatatagaacccatataatcatactgacagtacctttgacgaattttctctagttccctaggatcagtaactaaaacttgaacacccaactgcatttttgtcttctgaagattgaaatcaagacaggcaattcttgcaggggcaccctaagaggcattccttgagcagcacggccagtatttagagcataaccattcatcaaaagctgtctctagcactttttccatgagctttcaagatattgattccctgaagcatgaggcacaaaagaagcaagaaattaaatcaattcaaatcctatgaacattaaagcaagtaagaagcaagattaaaatatatactacagatgttcatattgtgcaaattggcatctttcatccaaaaaagaactgaaatcacaggaattctactaccaaccttgattgggtatttaacttcaccccgagcattggtcatctttacagcttgcactgcgtctacaacctgtgtaaattgcacacataatcaattaatagtgactacttatacctacagtctacactctacagaccaaaaaaaaaaaaactgtcccaaaatagcagttagcatctttttcgcaactaatccataacttcagaaaataacccttcataatgaaaacagagtttcaaaaatcacttagaccatatcccaaaaattcaatttattgactataaaaagtctcctagaccgacaacaaagtttttttcagtttcatgtgacagcacacatactgccaaaccaaatatggtcaacaataaacaattttacacatttaaaacacagtagaaacagatgaaatcaagaaatatttgaactcctttcctctaaagcagaaagaaagtgtaaaatctagtaaggttaggagattttttattttacaaaaatcaggttttaaatgagatgaggattgaaaagaatatagctttatcaatatcaagttttcaattactaatccaactaaatattgatacaagaaacagaaaatgcatataagcttcattcaattggatatgcactagaatttgcagaagcagtagaacatggtgtgcatcaatcatgtgataaaactctcaacattctatataaagccaatgcaattacaaacataccaaactggcaaagaagtcactatcaccagctatcaactttgaggacatactggtcttggcacagttaattagtgaatcctttcccagcttttcaacctaaaagtcaagagaacaatccaactgagtaacacatgatatacaacaatttgcaaatgcattaattaatagttggacataacataacaatggtcatatggtccaaagtaggtttttcaaaatataaaacagggaaccaataaccaagagatgcaagctttcgtcctcagtcctcacatcccaaacttctttttgcattagttaatgattgtatcattgatgcaaggaagacatgaacaaaaaatatgcatacaaaataaaaaagtttattaaggagatcttaccttgacagctagtttttcttctacatatttacaagcctctcgcatagcaagctataaagaataatcatcataaagagaagttagttaaaccatgcaaattcgcaattcaaatagaagaacagaaaaattcataatggtagctacaaagattaaatatagcaatcgacaattaattaagtttaagaaattattaaaagacacttactctatatccactgataatcgaggtaggatgaatcttgttcctgacaaggtcatttgccctctgcagaaaagaacactcacactcgttagttagttacatctgagacaaacacaaagacaaacaaagtgccaaccaaatagagagcgatgcagttactttgagaagctcagcagcgacaatgacgaccgaagtagtgccgtctccgacttctcggtcctgaagctcggcgagctccaccaaaacctaaaaagcaacacatgtgagtaataaaaagcaatggaacgagaaaaaagagaaagcgaagagcgagtggagtgtggttcaccttagcagcaggatgctccacttcaagcatcttgagaatcgtggcgccgtcgttggtgatagtgacgtcgccaatgtcgtcgacgagcatctgaaacgaatcgcatcagacattgcttacttcgtctaagatctaactatgtatagagagagaaagagaaagacagagagtgagagtaccttgtcgaggccaacggggcctaaagagcttttgacgatgttggcaacggcttggcatgccacaactgcatcacagagattgaacgatgttagaaatggttgttacgtttttcattgtgaaaaaaaaggagagagagacggtaccgttttgggtgcgaacgtcttggccggactgtctatcgccggcgatgtcaggggtttgcgcaacaaccgccattgcgaagtgtgtagtagtctagggcttcagtcgcagagggttttggttttttcaacttcgcccttcctttacttttctttatgctaagctatgctttcttttccctcctcctctttatttctttctttttcactttcaactccaagtgcattttttttaattatgaaaaattaacaataataattatattttaaaatgagtttatgtagattttatcagaaaatttataataatttacagatctcaaacaactaaattaaccctcttaatgtttatcttatttatttattcttttttaacatgtaataataatttttacattgattaaaaaataaaattgcataatatattattaatatatcttgagagtaagaaatttaatgtataatgatttttttaataaggataatgatttgataggttatgatttaaaaatatatatatttaatttttctatttatatatatatatttttttttttttttaaaccaacattctgttatatacttttggacatgattttcactcaatttctcttattttacaatattaaattcttaaattacataacaaatcaagtgacaaaaattaagtttgttttttatatattatgtaatttgtataacacggattttatacattttttgttttgtttctattttataagatattttatactataatttatgttgataaaattagttaaaaaattaaatgaaaattataaagttatcaaaaattaattgaaattgaaaaattaattggtagttgaaaaataatttattaatttataatgttagtaaaatgttgttgaagtagtaataagtataaaatgatgaagtaataaaattataatttattttaaaaagataataaaaaattgaataaatatattgaggataaaaaaattagaagttgtcatttaaaaatatatttcaatagagtttcaaaaaacgttaaagttattaaaaaaatttttgtcaaaaaattttcaactagtaaaaaaataaaagttaacttaaatgttttataaacatactatatttgtcaaaactaaatgaaaaattagttgatagttaaaagtcaaagttaaaagttgttagttggaagctgaaaatatatcttattaaatttctagtattccacaaattagatattgaatattgaaaaatgacataaacataataataaattattattttgttttaaaatgtaactaggaaattagataaaatattaaggataagaataaaaaaatataaaagttagaaactagagttaacatttaaaaaatgttattttaagtagtctttaaaaaatgaaaagttactaaaaaaatttattttccaataggcaaaaaaaattcaattaataaaaaaattaaaaactaactataatttttaccatcataaccttagtcttttttctcttttttaattctataatttttagtcttcataaattttttattccatgttaatatattttgacaattttaaattatttttataaaataataatagtagatatttgttaattatgctttactaatttcttttactaaatataacttaataattacttttaaatatatattaaatattgaatgtagtacattttaatttaaagtaaatttatattgttaatgtgatatttttttaacttgtttttacttccaaacaatattgatattaataatcagagcttaatggtatgcattgtaactttttacatcgtgaatcaaccaaaaatattgttaaaataacttttaaaataattgtatcacataaaagtcaacaaattcagaatactattatgatttatagatgaacaatagtacagtataaaatattgtgtcctatcattaagtaacttatttcctcaaataatggtctggtttagctttgggtgagccaaggctcgtggatctacatttaagttaaaagatggtgatttaacgttgatccaaaataagattagaattgaagtattttcaaaacatttcaacactcattatgtgtttggtagtgttaaaaaaataaaactaatgaaataaattaaggaaaaatatttaaattaaaataatatattagaggtgtgagactcacactaaattttgaaatataagatatttttgtaaaataaatttgtgcaattctgtttcttatcagttatatatataaaactgttttatctatgttatataactaaagtagtatgattttaaagtaggtaatatttttaattctatatattttaaaaattattatacatttatctggagttataaggtggattggatcattaaagaaggagaaaagcgagtaaagataactgagtttgatttctgcttgcaaaattaacagttctacttctaacaactaatattttttttttcgaaaaaattattatttatttttatattaaaatgtgcatgaacctaaatgaaaaatatgctcttgatccttttgttttatttcttacttcgtactattattttggtagaatgactcacaacattcttatgattatgtttaaatattgaaactaaatgttatggtaacgacaaatattcttctatagtattttttatgtttttaataacttataagtccaatgaaataaatatttttgaaaaacaaattgcgtaatattgtttgttcttagttttatattaaaaaaattgaatttagccatgttatataattgaagtagcatgattttaaaatagctaaacatgtctaactctatatatttttaagttattatttgtttatgttgtatatatttttatttttatattaaaatgtccatggagaaaaaataaaataaatgtttgataatttttttcttgtttcatattaattattataattatctgaatgtgaatcactcataaattttggtacgtacgtagaatcacccacaatattattaatttattatgattatatgatataaatgttatgttcacgagaaatattctatagtatatttttcttttgttaataacttataagtctaatgaaataaaatatttttgaaaaataaattcgtgtaatatttttcttctcattttttatatataaaaaactgaatttaactttattattatataattaaagtagcatatttcaaggtaggtaaacatttgtaattctatatattttttaagttatgtttcatatattttaatttatttatttttatattaaaacgtccatagccaaaaataaaaaataaatgtttgatgatgttttttgtttcttacttcatattaattacctaaatgtgaatcacttacaattttattttggtagaatcactcctaacattatttatgagtatatgctataaatattggaactgaatgtccacaagaaatattatgtatatataaaaaaaaattgaatttaactatgttatatatttaaagtgcataattttaaagtaggtaaacattttgtaattatatatatatatatatttaaattattatttatttatttatcttgtatatattttaatttgtttattttatattaaaacgttcatataaaaaaaatgaaaaataaatgggattcaaaggtagagttatgaaagttactttagtatttgtaagtttgtttgttttttttttttttttttttttttgcatttgtctcatagagacccatctagcctgccaactgcgaagcacaagatctttaaggatatataagtaatgcaagttatctcatacaatgatttgacatatatcactattcccctttctctggtaaagaacattatcaagatgttctaatatgtcaataccacattatcaaaatgtttaatacgtctttcttgaatttttttcctattaagattaactgcaaaaacattactggttctctttaacctcaagcacattccaaataacttagttccaaatacacacattactacaaacttttagtcccaaaccttcaaacacaacaaaccataaaataatacaatccaagctattttttatcgagtttcttgcaataaactaaagaaagacaaataaacatttatttttcacattcaacaggaattcttacacgcatgaaagaaaatatctaagaaaaatactcattagaggcagcaaagatgggttgcaatcgctgataccctcgttgtttgtccactccaactcatcccaccactcttgctgccctttaatggactttaagttgactgcattgtcactgtctagtggtaaagttttcaaattaggacagttatgtatccttaacagctccaaagaggaccaagccaatgtatgagttgagcatatagttttgaagttaggcaagttaaccagcagaagtatttctagttttggaagcacatccctttctctttcaatgttttctcctataagtacttcaatttttgaacaatcttcaagttttagattttgaagttctgaaaaatgttgaattgctccattgctgaaaatgtcactgagtgatggacaattcttcaatgacaaaatttgtaatttggaaaaggttccactgtgcaagggacctctaaaaacacatcttaaattgagcaaattttccaaatataattgctccaaatttggtaagatgactcttgtttctatttggattccattcatggtgttgctacttgtatcggctgacacaattgataaaactttgttacatcttgtaatcaaaagaccacgaatgcgttccaaacacactatgccagcaaaatttgtcaatttttttatatcttgatggcaaactaattcaaatgcatcagtttttggtagtacctcaataattgccgagtcatccttctgtccaccattgcagtacctcaaataattagtaattttatactcaaaagattcaagtatttgaggtgccttgtgttttggcatcccacaaaaatctaaatgaatttagctgcttacaactccatgatttacttcttgaaagaaattctccaagaatgattgaggagggaaaacaacatatgagatgtgctacattttccagagaagccacatgttgtaaacaattcagcatcatgcaccattgttcataggatatgacttgaatggttaattcttccaacctatgcagctttgaaatcacatgaacattttgagcttcattatcttcacttgcaatgaatgggattcgcaggcatcttagattaatcaaacatccaatttgtagaggtatgaatgttactttagtatctcgtatgtcaaggacctctagaaattgaagtgatccaatttcagatgataatgattccaagagctcgcaattgttcaagaataaactccgcagacaagtcaattttgataaagacgatggcagttgtgtaatcatgctattatacaagtctaacagaagtagactgctcatgttctcaaaaaagttcgtggtattgtagttagttttggattttttctcagcaacaatgtcaaaatcatgctgcaatcttggcttgttggaaaatcaagcagttgtctcatagagacccacctagccttctgccaagctcttgaatttgagagattttcagattctccaccatcttggaggtaaaagctacattcaggatctttagaggatatgtgtaatgcaagttgtctcatacaatgattcatgttgacatatatcattgattcccctttctctagtaaagagacattagcaagatgttctaatatgtcaataccacaattgcgtgcactttgatatgaccttttgtcatttatatcaccgagtaaaccttgtgctgcccaacactccactaaataatcagtgtaaaccttgctatttgcaggatacagtgaagtgtataaaaaacatttctgctttttttatctttgagttcatcataacagaatttcaggcatgagtacaactcttctaaaccttgattttcaagttctggccaaggtttaagatcttcaagtcccaccgaccaacttgaagcagactctttcaatttaaaagaatttgctatattgtaaatgagaagtggaagacgagagcaccttttgcatacaagtttggcgataggttgaatgtcaagggaatcaatattaggataaaggcatgaacagtatctctgaacatcttccatgcttcctcaggagataactccatgactttgatgaccctctgcaccttattcaacttataaactcgagggagtcgagtggcaattaccaccttactgccattgttgacatcactaggaattcccaactgctccaaattgatggcatcctcaacctcatccaaaatcaataaatacttcttcttttctagctctttgtgtattcttcttgcaacatcatcgctatgctccttgtcggtttctatgtccagtatcaaccgatcaacaattttctcttgaagcttatgatcatcagctgtggctttcacaaaaatgacaatttcaaacagtttagcaacctcttcattgttgttgaggttctgcattattgttgttttccccaccccttttgttccacacactccaacgactttaatcttattattttttagcaaacccagcatgttttccaaggcaccttgaagggttggatatccacttatctgtgggacatttaactcctttaagacaggctctggtggtttatcaacaagaaaatctcttaaacattcatccttcttaagttcacgaacacagttgcactcttctccatctcttcactcagatgtgaacgtcgttgaatacgccaccagggtagcattttctcttcgtatttagctttcagcttctgcacttcttctgcagcatctgataccctgtttgtccacagtttgtaagcattagtggtatctttgtggttgtttctttgaacctccctctctttatccttctttattgcaagtagcatctccatctctttgagcagaatgttgtagttgtcatcaaggtttctggaagacgcaattttagatgcaattgtagtatgtaattctccaaccccatgcgctcctacctctccaacaagaggggcacaacctcaagcccagacattatgaaacttcaaagcctacaatacgttaacaaagaaaataaaataaaggttatattcatataatacaccaaatcaacgtatagaaattctagacatcagcggtatagaattttgaagcatacacaaacataggcgctttattcaatatgatatgtatgtaacacccaaagccaaaacttcagtatgtaaaaactaatgattcaacctttagtaacacacttgatcattatttatcttttctgtttgacagtaaaaacattttaaatatagacaattacaataaatcttaaattctaaagcaatcattaagaaacacaaaaaaaaaaaaattatatatatatttatatagtatatataaaccttgagactagaagtagcaccatttaaaagtagtaacttattgaaactcggacggatccaggaatgcatagggacggggggggggggggggacgatttttttttcttacacaattatttaattatttaattctaataaataatatgtaataaataaaaaagtttcacaaatatttattattaattttatgcgtaaaaagaataaatatacttctagaaaataaacaaacattaactcaatactcgatttttttattcattttttattaaaatattttctttttcttgtttctcaatccgtccctattgaaactgatatacaaaatgattggaatgtatgtgagggggaatcaggagcaagagttaagtaagaaagattcatgtgtacctctgctgctaactgttaagaattgagatccatctcaagggtgagtgaggaatcagaagaacagctaagaaagattcatgcatatctacctctgccagcagctcttgtgcacagatttgcaaaatgatgggtaagtcaacgcatgagcagctccaaattgagtctctggtgtccttgttcaatactagtggaggacaggcaccaaccaaataaatactactgattaagatacatttgattattctaggtctgtttaatctataacatctacatttttaaaaaatatacttttgactacaaaattaaaaagaatatttataaatatattcttcatatcattttacatttattattagttaattcaataaatacttttatctaacgtttctaattaaatgatctactttaacaactttgatttcaaataatttgtcatctttaagccatttttttttaccaaatataatatatctgtttgataagtcatttcaaataattaagaacttatttaatttataagtttgttctaccttaatgactttcaagttttagtttaaaaaatcacttttaagcattgcgttaacttagaatttttttgtcagatatagtttcaaagctattgaatatgaaatatttagtaaaattatctaataaactaattattccatatatatgttatcagcgtgtgtataattaaaatgtaatagatttagatagatatggattatttagtattattaggtataccatattttataaaaaaattaaaagagaaaaaattaaatatacaaatataatttgttgaaaatacgagttttattaattaggaaggagtaaaataaaatcatttttggaaattagcagacaaaataaaaagacaacaatcataaaacttttgtgttataagttatatatttggaaattattgtattttagagaaagatgaaaacaaaaatagaagacaataaattaattattccttaattagttgaaagtgatatacagaatcaaactacttaagacttaagaggttagaattgagatccattcaaggtgagtgaggaatcaaaacaatagttaagaaagatttatgatatgactgtgtacctctgcgagtgcgagcagccgtagccgacagatttcttcacccattttgcaaaatgatcgatcaagtgtttgattatcgcttgctctgttttttcacaatggattcaagtcaacgcgtttatcacttggtgtgtggtgtcggctcgataccatccttataatactaatataggaaaaaaagtaaagataaatgctattgcctattgatgattttttaaaggcaaatagtattgattatattaaattaaaaatatgtatacaattacttttacattttaattcaatataatttttatcatattattatacaaatatctattaattttttataactaatcttcataaaaaaaaatctatctaatcacatctttacaagattcaaaatgaatattttgtttactagtcaaactaaagagacttatcaaatacatttgattatatacgtgaaatatatgattaaaataaatatatttaaaaaagatgaatttattttattatttaatgtgttaaataaaattgatctttttttatactgtgtttaaatataattttatttttcaataaattgatctgtataaaaatacatctttttatattttaatttatcatcagttaataacgaattttaccaagggtctattgccattatcaactgaaaaagtaacttttttttttttttaatgaaaggggctaaaaccccaaggaaaaaacactaaagccactaggaaagatcatggaaatagcatatgctaaaatataacatgtgaccctccgtagtattgacataatttcattaatttgctagcaaatccacaacttgattggcctcgtgtaaggtatgagaaccggaccaactgaaaagctaacaataaatgaaaattaagcagagttgaatatagtgtttgacaagtaattacaagtaactagttatattcctcatgaaaattcctttcatctaaaacatagagtaacagaatcacagagagtcagagacagtattgattcttacgatattcttttagtaatttttttttataaaaaaagaccaagacacgtaatgatattgcaaaacgattattatctaaagaatatttgtttctattttgctaaatcaaacattaagtgaaaacgaagatgtttacagccaaggctaaggcatataaataactctgtttaacaattagcaatagcatgtactcgaatataaacataatccaaaagaaatttactactaagattgtaatatatgaaccagaaagttgtaattgcatccttcctttcctaacccatgcgatatttaattaattctgatctaatattgttaacatcctctgcctcatggagtagggcttcaagctctgcgacctttcttttattttttgatgaggtctctgcttcggttttctattgataagacagcagtcatgccattttttgaaacaagacacgacagaaaaattttaagatggaacattcacatgaaatatgaaaaacaaaacaaaataaacgcacacaaagtgaagcataatttaatatgtatgcatctaactagcaagtaaataacttattctgttagaactgggagaaagtgacaagattcaagaaagaaatcaagaacagaaatatctaattagtaatatcctcaccggaaacataacacaaatactagaagagacgagtacgtttagtgataatggaatggcatgtacgttcctattaccttgtgtcgcaaatttatatctatgttgtttcttttttctttttatgccttatctgatttgatttgtttcgcatgcatgtgttatatactttgattatttagttatatttatattgaattgaatcgaattgtatttttattttatatttgtttcaaataattttttatctaaaaattgaatcaaacttcactgcaaacactcctatccggctctttgcatgatgcagaccccaacgacaacattgcttatagagttatagtttcgttactaacttggtatatcctttggtaactagtttttttatctttgcatcaacggagcttttaatgttgagtgaggattataaaagttattatatttaatttatatcttttgaaaatgattttttataaatgaatatattcgatagagttttaacaaaaatctttagaattattcatatttctataaacatttaactatttaattcactgtctttaatagagcaaattttgtttcttttttttagttaaaaattataatttcttaattaaattatttttatcacatataaaaatatgacttttgttatcttttagcacaataagacaatacaattttaactaattatataaaaaatattattttatatcatataagaaataatagtattagttttttttaaatcatgttttacaatttattttaagtaatctgtattttacaacaaaatttagtctaaaaataaattcaaatttgctaggcccggtccgattttgaaaaagaaaaaaaaggaatgacaaataaaacaaatgtaaaataaaggaataagaaaatgggattaaaaaatccaaacccatgcaacgtgaaagaaaaaagaaaaaagtgtctttacctttcaacatacaattttaaccctagtaaacttgactatttttatggaccgtttgcaaggagagaaattttttaatttttcaaaaaccataggataagaaacttgattttccatatttgatatacattttagaaaaataacctcgaaaaatgatatttcttgaaaatgttttttaatcaattttttatgaaattttttaatgatagagctgaaaatcttacttttttcaagtttaatttttgtctgttataaaaaaataccatattattttttattaaattataatgtaataataattaaaattattaataaaaatatgtataactttttaatttctaaaaatcttatataaaaattattaatgttgaatcaaataaattttatttattaccaaacagattcctaagaatcataatatccggaacctcaaataaccccgtaactaagaatgatgaatgtttcatcattccaactccagcatttcatttcatccacgttttgtttacggaacagcttgtgaatatcttcattttcattgatgtccatctcttgtcggacacctcctaaaccaactatttttctcctccatcgtagcacaatcttgtccaagattcgaactgccagtgcccatatagattgtaatggcccctcacatgagcctgcccaaataaattagaaataactaaggttgaatatcaaagcatgcaggtgcatgcgtagtgttctgatgtttgtgaatagctagaaaagatgctggtaatttaagttggatcaagctctttcttaaggtatttatatagaagaaatatcttcagaagtcgatcattatgtacaaagtgatatttaatcagtgaggtgaagtgtgtgaacagtgtcaataaaataaaagagaacgagaatatgtatattttttcctctgcaagtatcccttgtttataatgtacttaattcatggttagttgtggatttcacttaaggtcaacagtccactattcttcattgtaccttatcactaaacacttttaaaattcgtaacagataacttgtctataatcaactgtttttttgtttataaaaaaatcaaatctctctatatattcactttcagggtatctttaagtgctagctatatataaattaagaataatatctttttttttatcagccaaaatgataatatattaagaataatatccatgtagcagtagctcttggaatttattttgttctagtcaaactatgaagttaacatctgttacctgttccttggctactttttgattttggcgcaatgcaaagaaatctttgcgacctccatatatcttccgaatcaataaagcgactggcacgaggctagtgtcttgcgcgacgaatagcggataactattactcgtatttgcccgctctgttatcattgcaaatttacataattgggtaattttttaaaaatagatagtttttgaaaatattgtataatattaataattcgtgtttaaaataaaattttctaaaaattgtattttaatacacaactttaaaattataatttatttaaaaaatactaatgtcatgattcaaatacgacttcaatattttatatttttctaaaaaaaaatagtaaaattgtattttaaattactacttttaatattttattttttaaaaatattaaaatgatatctaaaataaaactttagtatttttttaaaaaattataccgttctaaaatatgttttaaaatatgactttttttataggaaattgtgttttaaaatagacttatcatatgtataatattttcaaaatctattaattttgtaatttttttaaaattaccccatgtaaatttgttgctatcatccctactcattaattagacttcgtatcaaatggaaataaacttttccaatctcctaatttgaaaataaataatgggcaaatatgaaatatgagtttcccaaaaataaaatatatgcaatataattatcttgttacctcctaacaaatgtggcgatattttttgcaaactcatattcccataaataaataaattgtgaaataagtattccctaatttgataatcttataagtttttattccttgtactttttgagacttgatttggttttttaaattttattttgtttatgattttaattatttttatttattttagatattaagtgatgatatgatatttattttattattattttaatttatattaaatatatttttatatttgaattttttttagtcctacaaattatatttgttttgttttttttatctttgaaattttagataatatttttatggttcaaaatattatttaaaatactttaaaaactaaaaataaaacaaacataaatgattaaaaaaacaattgtacaagaataaaaagataaaaaaggataaattataagtaaaagaatggattcaaatttttagttattacgttttctgacggccaaaaacgaacagaaattgaacgaccgaaaattttaaattatttcttttttccactttggccagagtcattttctctgctcctatcccctccgacagcggcctcttcacgcacaccgagttgagttaatgaagagaaagcggaagcggtggggatggctttgaagagagatgttcaatgccagggtcatcctcttcggtgacgtcgacgtcggcgaccaaacctccagatctggtttcactacattcaattccctaatcacgtcattgtcctctgcggtggcaactgaaagtccccaaaaactgatcgagatgctgggaaaaacgaggaaagtttcggtgcgtggcaaatctgtgacagctaactacgcctttgcttcttacacgcatcaccaccaccaggggctaccctcccttgaacaagtttcagaagaagttcaccgagctcctgaggtgaacaaggaagacaacttttttttttgtgacgaaaaaaaaaaagttacagctgtcaagttttctggaacaagcaaatttcacataggtttggattgcaggccaaaaagtcacaatataaatttacgaggacgaataacagataaaattttataaagattaaaaatgaactttgagcattttgtatagacaaaaaacatattttaagtcaattaataatttctggtttttataattttatattaatttatcatgaatacttttgatccccccacccctctcttcaaacatccaaaaatcatttttttcactacattttgatggtaaaatcatttaacccaatttcccccacttttttgccttgtaatggaggtattttttgtcttgttatgtaggcaacctttgatgatgacgatgattcaacaagagattacatgcattgtaacaatctttaattaacattcattggatactagcttgatgttttgtatgttccaagtttagtggattaccagtaacattttttggatgaaatgtatttataacttgaagattgatcactagtctttttgttcaaacttgcctcatccccgctcttaatgatcaaattctgttctttggtgcatgtatgtcttccttggtacgttatctcaattattgctgggttttcgtctaacctttgaacttgtttttttgctaggcacccttgtacagatccatatgcgcatttgtaatatcctctgcaatgcaaacgactagttttgtcaatttttcggcaaaactagaaaataacttctttttatgttcttaatataaagattaggctggcaacttagtatggtacgaacatcaaataaaaatattaatagaaacccctcttgttttaagccttgataaggaagttggagaagaaacctacattctctttttagttgctgtgaatgttatagtatagttatgtccaaaaaaaagaatgagatgttatctggagtttgtggttgttctcggttttaaattttcgtaaaggtagttgtcaaatgaacaagtttttgtcgagaatgtcaataacaagtttccaacagaaagcactaatttgggcccatttgaaaccagctgacatggtcctttagttaatttttcaaattgcaagtcattttgaaaacactgggggcatagaaccattaaaacaaggaaagagaactcattgtacatgcatattttattttccccattacgctcattagctaattggctactgattttccagttaccaggcctaaggcctctggtattaactaaacgagaggggtgaaacttgtacgtcaataacctagagggggtgaacctttctgtcacattctaatcaaatgcaattatataaacttatactacgaaaaaaattgctaattaaacttgtttaatttataacaataaaaagttaaatgagaatagaggttttaactaaccttgaaaacttagctccaagaatctcttttgcccatattttatccaattatatccatcatctaaacacccttcacattaacgcttaaaatatctttaatattagatcttggagatagattaagatctaacatttccaaattcagcaataaaaaactatcaaaaaatataaaatctcaaaatcgagaaatggagatcaagcttggagatagatcttaagctgaagatctaacatttcccaaattcagcaataaaaaactatcaaaaaaatataacatcttcaaaatcgagaacatggagatcttgatctccatgttgaaaatccagttcttcaggaaaaaatgtgtatatctgcacagattccaaataaaaaattattcatcaacaacattaacaataaaacgcagaggtaacagattcgttggaatgaagtaaaaacacaacaaatataaatgaagaagaagaaaaacaaacaacgcattggaaaaaaaaacatatcaggtgaagggggctcgcgtgtgtggaggaaaagggaggtgggggttgcgcacgcggaggagaaggagaaggtggagccgcaacaaagaaggaagaagaggaagaagaaaaagtggaataacagaggagagagggaggaggaaaaaagaagaaaagatagttttggaagttgaagaagtgaaaagaggagagagggaggagagaaaaaagtgaatagtgaaggaaaaaatggaaaaaaaaactaaaaatatatttaaatatttaaaagtgaaattcacgtgcaatccattagaagttatataagatttcaaaaaatatctcttaagatattttttaatatacaataaaagtagactaaggtattctgtagaacttgaaattcctattgaatattaaatgaaataatttctttgtgtaccgtgtttagcatctaaatgttttaagtttttaattaatgagtttttcagcacttattatatcttttcagcaaacacattcgacgtataatttacaggtttatcaaacatgctctaatgtaagtaaaactgtgatataagaaaacaaaagcaatcaatcacgaacgtgaaagcatctcaacctgtctattactttttgatgcatttgtaatatttttggctagtaacgactttcgctttggcttcatgtttcactgtttgaactactaccacagatgaactgggctaaaggtgacaacagtatttcaaagatgatcatgtgtagaacttgaaattccctgaaaggaaaacattcaagtaatacatacgaaaaatgaagctaagagggtatgatcatatagcaaaagcaattcatacagagatacaaaattatataattataacactagctcatatgacccatggttggagtttgatgagtagggagataaatatgaacagacttgtttatttaaatctccaaaattaagtatgatcataaagtgcaggaaaaaaaattgccacaatttttaaagcaccaagaagaattgttgtgaagttaattttgttttgacataaaaagatgtcattaagaaagagatatacaaaaataggaagatatcctacacatgaaaacttatcatagttattaatctcacatagaagtacatagctttaaacactatagcaggaagcacgatggtcattttttaaatattataatgcaagctaaatagtttatactacatatatattaaaaataagaaagaaaaaaatccaaaattaaagaaattcatgataaatattatttttttaaaataatataatatattttaaaataataatatataatgcaagcacgatggtcattttttttaaatattatattttgggtggttcggctctggattgggctccggattcgattcccggctagggttcaacatcaacaatatattttaaatattatttttattttagtaatgcaaatttgcaagacaagtttttttattcaaacttgcctcatcccaatctcaatgatcaaattctgttctttggtgcatgtatgtcttcctcggtaggttatctcaaatgttgttgggtcgtctaacctttgaacttgttttgttgctcggcaccttgtcattctatatgtgcatttgtaatattctctgcaatgcaaaccactagttgtcaatttttcggcaaaactagaaaacaacttttttatgttcttaatataaacattagactggcaaagttagtatggtacgaacatcaaataaaaatattaatagaaatccctcttgttttaagccttgataaggaagttggagaagaaacctacattctcttttagttgctgtgaatgttatactatagtctatgtccaaaaataaagaatgagatgttatctggagtttgtggttgttctcggttttaaattttgtaaaggtagttgtcaaatgaacaagtttttgtcgagaatgtcaataacaagtttccaacagaagcactaatttgggcccatttgaaaccagctgacatggtcctttagataatttttcaaattgcaggtcattttgaaaaactgggggcatagaaccattaaaacaaggaaagagaactcattatacatgcatattttattttccccattcattagctaattggttactgattttccagttaccaggcctaaggcctctggtattaactaaacgagaggggtgaaccttgtatgtcaataacctagaggggtgaacctttctgtcccattcaaatcaaatgccatttatatgaacttatactacgaaaaaatttgctaattaaacttgattaatttataacaagaaaaagttaaatgaaaaatagcttttaactaaccttggaaacttagctccaaggatatcttttgcccatattttctccagctacgtccatcatcaaaacaaccttccgcattgacacttatcttttctctccaaacttcagtttgaactgttcttagtttacgaacctgttaattgccatgccaaaatataaaaaccacaatagtcttttattcaacatgttaggttcgtgaaatttatttttgtttaactaaagactatagagacaccgcctacggacacatcttcacattggaactcagcaacagtatttgatctcgattcatgaataaaaccatcatcatcatttttcagttggggaagtagcttacattgtgttgaagctaaagatcgatttgcaatatagagaatatctaccttctgaatcttttgtggtataattgatgcatagtaaaattagagaacaaacaatttcaagttgcaggcgtataactccctacttatatgaccatgcatcatagcttcattggaatgagacatttccaaagtgatgttttccttttcttttctttttttcgtgacagcaatgaataacttaagttgctgataaagagtaagcaaattccactaaaaatggagagaatccgtctgttagcactttcagacccctctaagattcacttctaactagggctgtggcaaccaaaaggccatggccagttaagtagttacgtttagccttaaaaaatttatactttttgaaaaatatttattattaatttgaattattaggtgataaattttataatgacatatattactatttttattattaagactgtaattttaagattgtattaattgaacaattgaaaactttagatgaagatatggattgaaaatacttttaagttctactaagaattataatattgaaaatcttgatttatttattgcaacaaggatagacaaaaaaaattcatatttcactaaaaacattatttatttaaaaaattgtatttttctttcaaatacatgcattgtttctaatattattaataatacttgtaaatattattattattattaaaagtagttttttaaactaaaaatactcaaatcttttttaacatactaaaaatcttatttgatatactaaaatcttatttgatattgaaataatttgaatgattttgtcattttatatattgacaataaaatgctagaaatactttacactttctataaaactttgatcaataatttcgtaattgataaaaaaataaaataaagtatgacaaatattaaagaaaaatacagaagagtaagcaaattataatattgaaaatcttgatttatttttaaaataaagatattgcaagaagtatagaaaaagaaattcatatttcactaaaaatattgtatttttctttcaaatacatgcattatttctaatattattaataaactagtaattcttattattattgaaagtagtttttaaaactaaaattactcaaatctttttatgttacatactaaaatcttatttgatattaactatgttacgaaataatttgaatgactttgtcattttatatattgacaataaaatgctagaaatactttatacttacttataaaactttgatcaatgatttcgtaattgataaaaaataaataaaaatttgacaaatattaaattaaatgttaaagaaaattatagaagagagcacaaaacagagagatgaaggatctgtattagagagatgaacaatccaaggacagaacagtaaacagagcacggcagcaaaggtcgcggttggccagaaacagtgacaggttcgccagaaaatggccataaaggtcaggaatgaccggaaactatggagaatagaggctgcagaggttggggatggcaaaaaactcacagaaggcccgaaaatgcagggaaatgccaaaaatgttgccagaaaaggtgtgtattggtgggaaaaggataacaatgtcataacagtgtgtacaagtgattgagaaagcagagtttcagttgtgattcaaagaagggggcaaaatcattgcccactaaaacaccctaaatttaatggttaaattaaaataggtttttttgtgatccactccaataaagcctgctccaggagcaatttcagctattttgctagatatggcagctgtgatggtcgctacttcaaactgatacacttttcaattttcatagcatgctctagccgctctgcaatgcaattctgcgctagcaccactatttgttgctattggcaactagtcatatgaaaactgaaaataattctttacgtgaaatatgttgaatacattcagcacattgctgatactgaatgaataaagcagcaactacatcctatctgaataattaaatgacaataatttcctttggtgtcaccgtgtttagcatctaaatgttttaagttttcttaattaaatgagtttttcagcacttaaaattataatcttttcaagcaaaacacattcgacgtataattttacaggtttatcaaacatgcctctaatgtaagtaaaccaactcgtgcatataagaaaaccaaaagcaatcaatcacgaacggtgacaaggcatctcaaacctgctctattaccttttttgatgcatcttgtaatatttttggctcagtaacgactttccgcttttgggcttcactgtttgaactacccctacccacagatgaaactggggctaaaggtgacaaaacaggtatttccaaagatgactttgctatcgactgtgtagaacttgaaattccctgaaaggaaaacattcaagtaatacagtacgaaaaatgaagctaagagggtatgatcatattagcaaaagcaattcatatagagatacaaaattattataattataacactagctcagtatgacccatggttggagtttgatgagtagggagataaatatgaacagacttgtttatttaaatctccaaacataattaagtatgatcataaagtgcaggaaaaaagatttgtcacaatttttaaagcaccaagaagaattgttgtgaagttaattttgttttgacataaaaatatgttcattaagaaaaagatatacaaaaataggaagatatcctacacatgaaaactaatcatagttattaatctcacatagaagtacatagcttaaaacactatagcaggaagcaggatggtcattttttaaaatattataatgcaagctaaatagtttatactacatatatattaaaatcaagaaagaaaaaatccaaaattaaagaaattcatgataaatagtcacattttatgcacagagtcactatcaatctgagaacaaaaaaagcatagtaatagtaatgaagtaaaagaaatgaaggatgatagtaaaattaatagaaaaagaacataacgagttatatttttcaaaaatgcattaatgtattattttaggtatgttgctaacttttgttttttcctttccctatctatttatctttcaaaaacactgttcagattgaccttgcttttggggcctccaagatcaggaaaaactacactgctgcaagcacttgctgggaaactggacagggatttaagggttggccatcctcttgctccatttttaaggaacgatgcaatgatatcttcctacatatattttttcattaaatgataattttgcatgatttaggacttgcttttaactaaccaaaaaaaacccttcaatatttctccacatttggtgtgtcagtcagtgtcagtacgtataaaatagtgatacttcacgtgttaagtgaatttaaaaaacttatcatcatgtcagacagcatatatttccaatcatatctgtcatatgctaatgctttgaagtgctcactcgctgcttttgagttcaactcattccaatcatgatcatgttaggaatatggtgaattggagtgttcattcttctatctttttctcagttgcgcattatttctagtatggtgaatatgattcattttccattattgtgattatagattgtacttctcacctaaggatcatagacaaggaagttcagtaaaatgaacaacataaaactggtaattcttattattattgaaagtagtttttaaaactaaaattactcaaatcttttttatgttacatactaaaatcttatttgatattaactatgttacgaaataatttgaatgactttgtcattttatatattgacaataaaatgctagaaatactttatactttcttataaaactttgatcaatgatttcgtaattgataaaaataaaaataaaaatttgacaaatattaaattaaatgttaaagtaaattatagaagagagcacaaaacagagagatgaaggatctgtattagagagatgaacaatccaaggacagaacagtgaacagagcacggcagcaaaggtcgcggttggccagaaacagtgacaggttctccagaaaatggccataaaggtcaggaaagaccggaaactatggagaatagaggctgcagaggttggggatggcaaaaaactcacagaaggcccgaaaatgcagggaaatgccaaaaatgttgccagaaaagagtgtgtattggtgggaaaaggataacaatgtcatcacagtgtgtgcaagtgattgagaaagcagagtttcagttgtgattcaaagaagagggcaaaatcattgcccactaaaacaccctaaataaagttgtttaatggttaaattaaaataggtttttttgtgacccactccaataaagcctgctccaggagcaatttcagcaattttgctagatacggcagctgtgatggtcgctacttcaaactgatacacttttcaattttcatagcatgctctagccgctctgcaatgcaattctgcgctagcaccactatttgttgctattggcaactagtcatatgaaaactgaaaataattctttacgtgaaatatgttgaatacattcagcacattgctgatactgaatgaataaagcagcaactacatcctatctgaataattaaatgacaataatttcctttggtgtcaccgtgtttagcatctaaatgttttaagttttcttaattaaatgagtttttcagcaattaaaattataatcttttcaagcaaaacacattcgacgtataattttacaggtttatcaaacatgcctctaatgtaagtaaaccaactcgtgcatataagaaaaccaaaagcaatcaatcacgaaaggtgacaaggcatctcaaacctgctttattaccttttttgatgcatcttgtaatatttttggttcagtaacgactttccgcttttgggcttcactgtttgaactaaacctacccacagatgaaactggggctaaaggtgacaaaacaggtatttccaaagatgactttgctatcgaatgtgtagaacttgaaattccctgaaaggaaaacattcaagtaatacagtacgaaaaatgaagctaagagggtatgatcatattagcaaaagcaattcatacagagatacaaaattattataattataacactagctcagtatgacccatggttggagtttgatgagtagggagataaatatgaatagacttgtttatttaaatctccaaacataattaagtatgatcataaagtgcaggaaaaaaaatttgccacaatttttaaagcaccaagaagaattgttgtgaagttaattttgtttgacataaaaatatgttcattaagaaagagatatacaaaaataggaagatatcctacacatgaaaactaatcatagttattaatctcacatagaagtacatagcttaaaacactatagcaggaagcaggatgggcattttttaaaatattataatgcaagctaaatagtttatactacatatatattaaaatcaagaaagaaaaaaaatccaaaattaaagaaattcatgataaatagtcacattttatgctcagagtcactatcaatctgagaacaaaaaaagcatagtaatagtaatgaagtaaaagaaatgaaagatgatagtgaaattaatagaaaaagaacataacgagttatacaaaaattagcaaaaatttgaaaataccaacatgccaataacaccatgaaatttgaaaagaggataactaaaaattacctgatacgtcgtattgtgatattcatttagttgagtctcttgaagtgcagctagctggttcatcatgtcagcctcctcgttaattggtgaaaaaattcgctcaaaataattgggtcgaccagcatctccccactctgctacattccatttcaattcttcccaccagatgctttctcctttgatgatcttcaaagatttgcttgacaactctgatttggaaagactttggagttttgggcaataataaaatatcatttcttctataaaaggtccaacatgcatgccattaaaaatgttgaccaattcaggaagatagagaagcgatatcattctcaacttggggaggaaaaacactggatattgttctggtgtggcatgacttatcagggtggttacttttggacagtcttcaacaataatctcctccagaaaggaaaggtttttaacagaatctaaggtgaatatggtagttaacatggggcaagtgtgtaatgctatagactttaagcagagaaagaagggactactcccttcgcagacgcttcttaaattcttcatatagaatacactcaaaaacttcaacattagagaagctggcctatcaggtgaattgcttccactgacaattgtttccatttcattacactctgccaatatgcatacttccaactcccataaattcctcaaatcgaaatcagagagactcttgatggtcatatgtcggtctaggtacaaggctttggagcgcccaagatgcattttcactccatttggaacattcacaccattaacaaactttatgctatagtcacagtgtttaaattttgtctccagttcaggtggtacacgcgatatcaaacgtcgcatatgttgaccaacaaccaatctgaaactgagagatttttgggctggtatgactttcaagaagtcagcctctgggacatatatactcaacctctgcaaattacataatccataacaaatttccgccaagacactaataacattcacattccatcgctcatcttcagggtcaacgttgatgcttaaatacttcaattgagtaagatttgatatcaatcctggaggaataattgttgacttggaagttccatcaaagcagaggcttaagctttgaaggttgatcaattctcggatctctattggcagatgggtgatcaaagtcccatcaagatcaagctctttgagattctttagctgtccaatctgatgtggtagttccatgaagagatcacagcctctaagataaaatttctgaagttgtattaatttagagacagaagggggtaaatcccttatactagtgtaggataagtccaagtgttgaagtaggggcatgtggttgaaaaatgagtcagggatatccatcaaatcaacattgccctgcaacaacaacactttgagtttagggcaatctggtgattgtggtaattcacatattttattgtccatcaattctatctgaataagactatgccatcgtccaatgtagggtggctctgtcaatcctaatgcaccatgccttaggatggaaggctttgaggtgtgcaatgattgtattatatcataggtttctactggcaaatagacatctccactttcatatttcaacaagacaaaacggtcttgaagctcattgatgtaatgttgtaattgccttctgtattcaccaagttcttgtgtgtatcctaatattgtcttagcccaatcagacaccaagatatcatctctcacgccatttttaatgttgtgaacaggcaaactgagttcaaggcaaagcttttgtgcatcaccaatgtcttcccaaataatatttacgaatgcattgaccatgactctactaatgccaattcgatcactatcttgataatcataggaaggattcagactgcttaatttgtcaagtgcaagttcccactgtttaaaatcttgcacatacgtaagatactttgccacaaggacaatggcaagaagatgaccgtggcattccttaactatttccactgcaattttctgaatggccattgatgaacgtaccatgctactgctgatacaactgccacatagctgcagaagactttccaaggcaatagatgatcctgggtccaaatattcaaatccattgtgcatgcaattctaaagtcaacatccttctctgcttgtgttgacggctcagttgttatcaacaccacaattccagttggaaaacgcaacttttggaggtccagcttgttgttgctatctgcatccactacaattaccaactgcccattgcttcccatgtcatcaacttccatcatcatattgacatcgatttcttcctgaactcgaacctctgcatcagtctcatatgttgaggcattgatccatagggctctaagaaaatctttgtcaattccaaacatggtgtgcttatcttcaacggctgaagctattgtgtccactacagatcctttttcagccaagtttctggttaacagtctgatatagcgtgcacagtaatccccagaaaacaaagtttgaagtagttggttaactgcgagatcaacagattgttggagaatggcttctggtattgcatcaacatcattatggctgatgatggatctctcaccactttctactttacttattatttccattggcataaatcccttcatagatcccagtgccttctcagttagtacacaccatggtttgtccatcacagtatcatcaccagtggacaataactgagctttccattcaggaaatgcactaatccaagatcttaaaatatattcatcttctaatttcacgggataagtcaacacgaggctgataaaatctcttatcctcatcaaatctgacagctcatcattgtataaaacttcatctttatctgaagatgttccctctgcttcattttgaagagttgaaaatttaggacccaatagagttattatatattgaacaaattcttcaatctctgtatattgtggcctgaaattttaaagaaaatgaagaatgcgaaatcatcacccaagagaagcaaaacaggagaagataatagaagagtagttttcaacgtttaaataccatttgcatcaaacgtcaaacatttataataaatttggacccaatttgcaagttacatctttcatgagatgagagcgggttacttacttaattgggatataccaaccagagagattggccactcgagtcagagcttttctccatgtcagcatttcctcaatcctctctttatctaccaagaatctttcttcgtgtttcgaaaaggctttctcgtaccatccagtctgttttcgcacatctgatggatcaacatcataaaaaataggcagaagacgtcttggcgaagtttcaatgcaattgaagatgtgtgctagttcacgcaaacaccaagttgaggaagcatagttctttgaaaggaccacaatgaaaaggcgggagccttgaattgcatgtaacagctcgggttcacccttttcgagaagtgtatgacctttgaaggcgacgatgccttttcttctgagagcttgaaaaagaaaacctgtgaagttggtgtagttgttgcgtgtgtcatcaccgtggaagctgagaaacacgtcatacgcagaagagctgctctggacgctggagatagaagccattggaattgcgaaagtggaagtaaacttgtttgtgaaaaaggacaagtatttctcgattgctggagttggggagcgcacggaatgcggtagttgtaaaatgggatccaatggaagaaaagctgtggcctgtggcgggaattattttaatcaattactctcaatttgatttattttaaatttttaatcttatttttgaaattttaatttcgcttagttatataattcatcttttaattatagttaataattcaactgaatccattaattattaaaaaattcaatcaaataatttattaataagaaattattaatccgaatgataccgaaattaatttctttaaaaaagattatacataaaaaatattttacataattatattcatattcaatatatatattttttattttagtcgtaaaaataatatgattataacatttttattaattagataatttaatttaacttttaataataattaaatgatcaattatataacgaaagccttctaatttttacatatgatcaacatcatcaatatcaatacaactaaagaaagcaaatctctttctaacatacttatcattacttaagaaaagaattctggcacaatatttctttctttttcttttcttttgacttaccacagctcacccactcacccccaaaatatagatcttacaataatatattcccagtgtgaagcgtctgcatacaggctagcggaaaaatcatgctacagcatattacagcgcgttctagtagcttttattactctaacttcagtatgtaaaaacttatgattcaaccctttagtaacacacttgatcattatttatgcacctcggattagttctcttttctgtttgacaataaaaacaattcaaatatagacaattacaataaaatcttaaattctaaagcaatcattaagaaacacaaaaaaaaaaaaatatatatatatatatacacatatatatatagtatatataaaccttgagactagaagtagcaccatttaaaagtagtaacttattgaaactcggacggatccaggaatgcatagcgatttttttttttacacaattatttaattatttatttcaaataaataataatttaataaataaaaaagtttcacaaaaatatttattattaattttatgtgtaaaaagatcaaatctactactaaaattaaacaaacattaactcaatactctatttttttattcattttttattaacaatattttctttttcttgtttctgaatccgtccctattgaaactgatatacaaaatgattggaatgtatgtgagggggaatcaggagcaagagttaagtaagaaagattcatgtgtacctctgctgctaactgttaagaattgagatccatctcaagtggtgagtgaggaatcagaagcaacagctaagaaagatttatgataatgactttgtacctctgcgagtgcgagcagccgtagccgacagatcttcttcaccctgattttgcaaaatgatcgatcaagtgtttgattattgcttgctctgtttgtttcacaatggactcaagtcaacgcttttatcacttgaatgtgtggtttcgtctcgataccaatataggacaaaaggtaaatataatgctattgattatttttttaaggctaatagtattgattatgattaaattaaaaaatatatgtacaattacttttacttttcaatcaaatatgattttttatcatcttattaatataaaatatctattaattttgttgataactaatctatatatatcttatttataacttagatcaaggagacttaatcaaatatgtttcattatatatatgaaatatatgattaacataaatatatttaaaaatctgaatttattttattatttaatgtgtttaaataaaattgatcttttgtttataatgtgtttaaataaaagttataattttatttttcactaaattgatctgtatacaaatacatctttttatattttgatttatcagtcaattaataacgaatttcaccaaggatctattgtcattatcaattatcaactgaaaaggctaactttttttttatatgtgtttgcttaatattttaaaaaaatattaacaatttgcttaatatttatctcttaaaatttaataattgtttctttaagttcattttatttttttgtatttgactccttctatccttcaaaaaatttgtttttgtaatgagagaaagacagaagaaaagaaaacttaaaatttgaatatgaagaaaagtcaaaagaaatttgattttttgttgtttaaaaattaactccccccccccccacaccttctttctattttttctcgttaattatctatattttgctatcttttttttttcattcaaaccaaatattaatcttatacatcataggtattttcttttctttctatctcttcgttcttatttgatcacctccttataataataaatattatttgttttatgatcacattgattacaaacttgagtacatgagattatatattgtatgcattatactactataatttataggctttctacatcggttatacaacacattcaaagacggagtgtgagagagaagaggaagttatagggtctagcgaagcaggaaaaggggtgtacaatatacatatttttacgatttctttcaaacccttttcttttttctatttttctatttcggattcgaaccattttgttgtaaatgaaagaggtggatttttgtatatattgattgatatcgatatcgatatgcactttcgtgagatcgacacagattacgagtaatctatttgcattgacaaatcgattgaaaatggaatccatgaaaaaaaaatatttttttgtttatttaaatattttccctatattttctatttatagatcttgatatgatcgagcaggacgaatattgtggtttcaagggttaatgtgagagcgaagccacatccagcaatgtgagaaaaccctaatggaggaagaagagaagaagaagaaggacgtgagtggtgagaatatggaatcgcgcccgtggagttgggaataagaagagaatgttcaagaatcacgagaaggaggaacaactgattcaaagacgatttcgtaaaagcaactttgtattctcttaatctacattggtttttaaataaaccaatgtcgtaatgagttttcaaagacgatttttattgacctatctttaaaaatttgcaattacttacaaaaatgccaccacgtcttctacgacatcaggttttgtgaaaccgtcgtaaaactgatgtcgtagaagactgcttttgtagtagtgttattttgacaccttctttttggtatgatggccatagtggatttatccttatttagccttctttcctatcttcgattatccttctaaactcgttcacacctcatcatgctttctttcattaattctcaagcttgatctcactctcactctcatattacatgatttgatgagttagaaaacatgcacgcccgcatgcaaattgtttgacaagaagaagaggcaggacaaacattaaatcccaaatactcacactggtctcataattctctctcaagaaagaaagaaagaaaatggttgtaaaatcaagaaacaaagatggtacattttgagatttgagagataattgtgaacttaagtgagcctctgagaccaattgagataactgtttgggctgtttcttcttcttaccaaacaatttgaaatttgaagaatgaatatataagagaaagaaaaaagaaggccagggagaaatacaggaagggaagttttaatttgtcaatgttcaagatgatagaaggaaaaaggttagaaaatttcctccaaatttacacgtttatttcaataaattcttttatttcatagtttagaatagaagttaagagatctcttcttaagaggaaaacttttttaatttaattttgattttgaaggaaaatacgcacgagtttttcgtgcaataacgcatgaaccggtggtctttgtcaaaattcattcagagttatttggtatgagaaaatctttacaaaaatgagtacaaagcgatagaaattcataaccacacataatgggtccctataaaaattgattttaatgtatctgcaatttaacattttgagtcaatcatattgtttggttaaactttcatgaatttggattcgtacaatatagcatttttcattcatttatatgtgtttaatttttataaaaaataaaaaaacattggtccacatcattattcatgcgttttgtgtcttatgtctttcgtaatgaataatattactgaattttgatatacttattagcgtaattttttatactaccaattaacatattaaaatcagtttaaatattattattattataaaaagtactggtttttaattatatgaaaactcattattagatttacttttgaattatagctttctcaaccttcagtatacttttatatctttcacttttcttctctttcaaataacagaaattgattactattatatatttgctaaaatatgtttgatcttataaatatttgaattttatatttatattctaataaatttttctttgtattgaatttttaataaaataacaatttttttgttctgtcactactttttaatatttgataaattaataaattttatgttttttattttattttctatacattattaatgtataaatatattttttctacgttggagccaacgaattctgacataaaatgatgaaaaacatatcaccaacttccttatatctcattttttcttgtggatttcaaactcatctctttcaattcattcattcaccggtatttttattctcttctctttttctccgtaatctatctttacacgctcaattattagtttctctctattttgttcattttcttctccttccctcacgtgaaagaagattcgtttaatgcaaacattattctttgaaatttatttttttcctaacacccagattatccaacattttctggcagtttgacaagcattttcattatcctccaattcgttgtaaccgaaatatcttaaatttaaggttggttgctgagaaaatattgtggtttcaatactttttttataatgaacattttggggggtttcatcacttggaaaatgaaaatgggaggagggggttaccccatattcttattatttatttatttattatgaacgaataatgtacgtaaattcatgcatttatctaatgctagtgtaaaaaagttcaatatttaacacacgtacaacattgcaattttgatgtctgctgataataccaaaatttgaccttttttcttaatggaaactgggtcatattaatttattcaaaacaatgtcagcaatacatcaccgaactgatagagaccagctaaagaatttgcctcctagctaaactatgaccgacagaatttgtgtgtctcataacaaagcaaacgctgaaatttggttaactatgaagcaagttatgacattgatcaattattttttaactcttattttttatgcttgatctatctatctatcttccccttaaagattaatcagactaatctgcaacggagttattgttgatcatgttaattattcaaatatatttttgtttttttggggggttgggggagagattaaggaactaattaaggattattgtagcagaaaagttttgttattatagcatttcttgagggatttgttttgttagtctataagaggatatttctttctttccaggtagtttagtttggctgctattactgaagttgcagttttgaacgattgctggcttcaagggtgccaatgaataatcaaccgttggagtttgggaggcctgtctcaagtatgctatgattcttaatttcatactctcatgtatttaactgatttccccttattaaaatcaatcatttactttcttttctactaatttactccccctcttaaataaggataagaataaataatgattaagggtaagcctaaaaaatttataatcaatacttcattggttttccgtttgttaatgtcctaaagcacattcaacccaatccatcgatagtgtgattgaactgaacgtccgtttgaagcttcttaatgaaacatcaaacatacttttaatagataaaactcggaggatttgaatccatatttttttattgaagttggaatgattgatcctgatatggtacttgaatgactgttgggtcacgtgatggcttatgcatttatacagtttttctctggtgtatttagtagttattgactaacttcatgatccctgatgagtggtttttcaccctaccagagggaatacttaaagcaagaatatttttccatctttattaggttgcatatttgttgtcaatgttgttgcctagtatttttaatattgttttattattttggtgcacgtaaggtttctgggatttcaaataatgactggatggttgtgactggaaactgtctctataccaagctttattggaatatttggtcttcttgtcaattgtttggactcagagagcttgattttaagcatagcagcttaagattctttagaaattctattacagaaataaagggatgtttcaaattgtgctggaagtggtgaacagctcatcattatacttataagtttattaattttatcaatatattacaaaaacattttcaacatattgtatctcttgaaaaccaaggcttagacctgttggcttttgtaaaagctacaatgcaaagtaagccttttaggttaggccaagcagaaaacgaatagcctatttcttataatagactggactcatactttatgtttgaaaaacaggcttaatctgtttaaggtaaatctgatgttgcttatttccatgtccaattgtcaatgtaaagttattttcacttatttttcttgagaagttgaatgattggcaggtttcttacaggtaaaagaagagtgaaggatttattgcttcaaaaagataatcgcttttgtgctgattgcaatgctccagatcctaaatgggcgtaagtgtattcaccattgtacatttttttgccgtgtgtgtgtgtggtttatggtcatggtcaccgattataatactcaaaactggagtctgagtgttgaatattttctgggaagaatttataaagcatccttgtgattaaattgtagtaaactggctacatgaattttcctaaattgataatgtggaatgcatagtacctctaagttgtgaatccatttttctaactgcttctacaggtcagccaatattggagtttttgtatgcttaaaatgctgtggtgtgcacagaagtcttggctctcgatatcaaaggtaactattcctaatccacttaagagtttagaaagaagattttcactttactaataaggaatttaaactgagttccttcttcaattgtctacaacaaattgagaaactaatatacctatagatgtggctaatcattttttgaaatgggttcaacttgatttgatgagaaaagaatcaaccactcttatatgtctatactcatgaatagtccggtgaactttgctttgtcaggggtgcattattttgtttcagttttactgccttatgttgtgggggtttgcagggcagccttattcttagattccatcccacaacatgctgtgatatgatatcttgtgaaatttagacaaaagaaacactaaaattagtgatctgagactagaagtgaaaacttttcaaataaggtttcttttcaatgtactatttatttatcctgtaatatagctgtaatcactaatctttcaggaattttcattgttaaatgaataatactggtaggaaaggaaaataatatcttatagataattattacaaggtatctcttttcatgtctaattatgaaatgtgaactttcaatttagtgttgccctctgccactggatcgtgttatttgagtttctcttggtctttattgtcaaatatgcacatttttctttacgtggtttaaaataaaaattcagaatttgtcaacttttatattagatacagggtgctagtgattttttacatcaaagcagatagaaccaacagctagacacaggttctagctgtaataagtgagaagtgagaaaggaatctctgcaactcttagctacgaagtaaacttgttattttgattaccaaggtcattgcattggacttttattaaatctatgaagtatgatccacattttaagaaagttagtcatgtcaagtaaaacttagtttaaagcttatgtagcatgaaattaggccaaataaatattcagttcttcacagataactaaatgatagatagtgtgatcattctaccagtgcattaacggccctccaaatttatcactctgcctactagttacctgtgttaggatttcgtataatgaatgtactatagccaaggtgctgaaaggcgtacctaagccactgaggcatggtgcatgaagcttttttttatttttttttatcattttatgctgctctcttttcaacgagttgtgtctatcaagttaatagtgtgctgaacttatttatttatgcttggtcttgtgtgcattaaagccttgggacattattttcttactttcaggttttgtctgtgacattggatgaatggtcaagtgatgaaatagatgcaatgattgaagttggaggaaattattctgctaattcaatttatgaggcttattttccagaaggatatacaaaacctggaccagatgccagtcatgagcagcgtgcgaaattcatccggttagatatgttttcatctaactttacactgtacatctaccattcttagcatcattttgcttgttttataaatctattatatattatatttatggtcacacaaaatgggtaaaagctgtagtcaactttatatgatatagatactaacttctgtgccctcattgcaatttttttcttctcatgttttcttttttcttttttaccattttgctttgctgagtcatttattttcaagtttctgttttttttggtactctttttcattcagtccattgtcctggttgataatggactaaccggcatggcgttgggattgctcatggtagcatcatctatgatagcaatctgaccaatgctcaagttaagagtggcattttaattgtggcaatttttactgcaggttaaagtatgagcgtcaagaatttttgaaacctagtttgcgcattgtgtcaggaaaaagcaatcccccatcaagtatatccaaagggattatggatagttttcgaattactagtgattcacagcatatggtaattatattttatactttagttcctttgatggatatgtatttgtttgttggccacatgttgagttagcatatcaaaggtaactgagttaaattgatgttgtacccagatgaaagccttctaatcgagataattatatatatacagcacttgttgcatgcatccaactttactacttggtagtaaatgaaacgaaattattttcgtgagtggtttacttggatgtttgactgatatttatggttaaaacaggaaggaatggtagaatttattggaatgttaaaggtgaaagtgatcaaaggcacagatttagctgtcagagatatgatgacaagtgatccatatgttatcttgaaacttggccaacaggttggttgttctcagttctcattagcataaattatttcatgggaaactttcatttttaattgaagagtagtagatgctgataattttctttctgaattgacttcggtgctatatgccttcagactgttaagacaactgtaataaagagtaatttgaatccagtctggaatgaggaacttatgctgtctgttcctcagcaatttggaatattgaatttggtaaggttcaatttcatcttgtcttgttaggaaatggaaacaaattctgtgatgcttatttggtggttggacatttggatcttcatacgtgatacttctatttgtctctctgtgtgtttgatacagaagatacaaaactcattctggtgtaaaaacatggaactttatcctaatgatttggttacattgcattgcagaatgtatttgattatgacttgttttcggctgatgacataatgggggaagcagatattgatcttcagccgctgataacatccgcaatagcgtacggagatgcaagaatgtttgatgatatgcagataggaaaatggctgaaatcccatgacaatgtgcttatagatgatagcacagttaatattgttgatggtaagattaaacaagacatgtcaatcaagcttcagaacgttgaatctggagaattagacttagaactcgaatggatacctcttgattattagaattgaatgaagcattcttggattgaatggggaacagtaattccaaatcaataactgcacggcacgtcagaaaaaagaatgctagaattgctttcattagaatagttttcgtgtaaatgcggtgtgaattcctacctttctcataggtattggtttgaatttctcgacattatttctctcgcttggtggaaatattaatataaattctcctccaagaaatcctctagcactaggttctgaaatttaaactattaacataaactttgaagatttatattaatgatataatatgttatactaatatttgatgtattgataatatataacaatattttatattgtcaaaatttgttaatataatatataattttgttaacataaattcataatgtctctataacagtcttacactagtttaattttcagtagaaaaaggttacactaacataacttaattcagtactaacacatttttattgaataatttaaaagaataggtaaaaaaaattatatgaagatttataaattttctcaatgaagctgtttttttttacgaagctggtgttgaaagtggtcacaatttaagttttgtgcataattgacatcaaaatataaatgccacatatacattcattatttgaacattaaaatattaatgccacatataatcatttttaactcttgtatttttatttttcatagacccacgttttgaatgtatatcccaaaatcaaatatatttttttacagaaaaataaatagattatttaatgagaataattataatcatacatctacttttcttctacttcattttcgaccttttttttcttatttatggtaattatctacttaattatcaaaataaaatgtacgtgtattgtcaaaagtaccagcaacaagagaattagtgtaatcctagtacaaatgtagggcacgcttgtaattttgactcatattttttgttaccatctttttctcatactcgcattaaaattaaaacttagttattttgtcaaaatggctaaatgaaaaactaatttgagtaaaaaataataattgtggaatgaagggaaaaaccacaaaggacactaaaaatcgcaaggacaacagtacaacataaaaaatgcgcaaacgatcatcaatagagtgagcattatttgctaattaaggtgtctgtcacctgattaacttatcgcagcgtatgactccaagagaaatcaccatttaaggtttaaattccgttaatatgtattcctaaaaaaatacattaatatggagtatgacgcagaagaactaatgaaaaagattgtctctaaaaataaaaaaaattaaaactttgacttccaaattccaatgaatcttttttttagaggaattccaatgaatttattacgtgaactcttactatatatttttatccgaccatcacatgataccatattgttaacaaaagacctttttttttatggcaacaaaagcccgtaaacaatacaatgtggacacaggcaaattttttaaaataatataaattaaataaataattgggaaaagggggtagttggaacaaaatttagcaaaatggggtgatgaaacacgcccagctggggcgtgtttaaacacgcccagatgaggcgtgtttcaccagatggcgccacgtggcaggctgaaacagtgtcctagggttttcgcgatgttttcgtaaattacggaaggtcgtaacttttgactgggacgtccgattgacgcgaaaccggtggccacacgctcgaaattgagaggagaaggcttgggcaagtccccgaagggtttatgttttagggtttcagattttggattttgggtatcgaatttagggtttaggatctagggtttagggtttagggttttcagatttaggttgatggatttcagattaggttaggggtttacgttgtgattagggttttagattttggattttgggtatcgaatttagggtttaggatctagggtttagggtttcagatttaggttgatggatttcagttgaggttaggggtttacgttgtgattagggtttcagattttggattttgggtatcgaatttagggtttaggatctagggtttatggtttcagatttaggttgatggatttcagattaggttaggggtttacgttgtgattagggtttcagatatagtgttgacgatttagggtgtagggcttattctttagggtttagggtgtagggtgtagggtgtagggtgtagggtttaggatttagggtttatggtttagggtttaggggtataggggtttagggtttagggtttaggatttagggttttggggtttagggtttatggtttagggttttgggttttggggtttaggattttggggttagggtttagggttttgggggttggggttttagggtttagggttttagggtttagggtttagggtttatggtttagggtttagtgtttagggttttggggtgtagggtttagggtttagggtttagggtttaggatttaggatttagcaccattcattactcgtaatcatggaaatcagggcccttctctgtctcctttttttcttttcaaattgatctcttctcgaactcgacgtagagactagtaagccatggtggcacggtgggcacttagaggcgcagttggcaaagtaagggttccagttcgagggtttaggcgcgtgggcaagggagatttggaatgacagtaataagaccaatgcccttgctgatcacgattgtaacaagtgctttgctgcagtagtttcgctagttctagagagcagtttgcgggcattaaaggattgctccctaaaccctaactcctaaaccctaaaccctaaaccctaaaccctaaatcctaaaccctaaaccctacaccctacaccctaaatccctaaaccctaaaccctaaaccctaaacccctaaaccctaaacaccaaaatcctaaaccctacaccctacaccctacaccctaaaccctaaaccctaaacccctaaaccctaaacaccaaaatcctaaacccctaaaccctacaccctacaccctaaaccccaaaaccctaaacccctaaaccctaaaccctaaaccctaaatcctaaaccctacatcctacaccctaaaccctaaagaataagccctacaccctaaatcgtcaacactaaatttgataccctaaatcgtaatttctcgtagcaatgtccgatgaagacgtattctatgtcagaacgctcaaaattgagaggagtaattagataaacaaagaatagcttgcaattcactgattgagtacataaaatatcagaaaataaaaaaaaatttagggcttcaaaacttaaatcacagttttgagacacttagaggcctcgtttgggaaaaaattttgggcaagtcccttcggatcttgcccaagccttctcctcttaatttcgagcgcgtggccaccggtttcgcgtcaatcggacgtcccagtcaaaagttacgaccttccgtaatttacgaaaacatcgcgaaaatcctaggacactgtttcagcctgccacgtggcgccatctggtgaaacacgcctcatctgggcgtgtttaaacacgccctaactgggcgtgtttcatcaccccattttactaaattttgttccaactaccccttttcctaattattgatttaatttgtattattttaaaaaattagcctgtgaacacattaatcccacatttttcctaaaaaacgaatatggtttctaatttttcaatcaatgcgacaattcgtagtagatatacaacaatagtgcactttatacatgaagaaactcaaaattaaggctttgttttaaatttaagatttttcttaaatgaagttgatgttaaaataataattcatgtttaaacaccaccttttaaaagtaaaatgacaggtattaatttacgttttgttcgaatggtaaagtaaaataggttttatactataaacataattattttggtcgatcattccggtcatcaaaagaagcacaagatgaacagaaaaaagtaaaataattaaataaacaaataatatcataaatctagaaccgctaccctttacatgcaacgtggaatcatatatagaacactagctagctagtgggaaacaaggaaaaatcataatcaaaatcaaaatgaagcaagaacacacaacactcactcaagggttgcgtaccaccaattgcaacttgttgttgtcttcatcatttccaccttcattctcattctcaccgcaaaacgctgcgtttaacttctgctttctgtttctgtttctgtttcggttcttgaacaaatagatcaaacccgaagccactagcagaaccgcgccggccacgccgcacgccaagctcgccaccgtaagcgccttccccaggcctttgccggagtgtcctctgacaggttgccaccactccggcggcgaggcgtctccggagtccatagcccggggaagtgccacgtcggaggaggaggaggacatcgacggcgaggagtcggcgctgttgaagaaggatcgcatctccggcgaggaatgcggccccgccggcgagaatgtctggaaggtgaggccgtggtccgacggccggagctccctggcggaggaagctccggcgagaatgagtggcacgaagacagcgagggcgaaggtgactacttccatgaagagtgaatttggagtgacggttggaagaggaagcatatatagagagaaagatggaagtgtggtggagaatacggtgtcgttttgaaatgggcaatgatgagagtgggagaggcttaaacttaaagaaagagaagaagagtgggttttgttttgtctgagtgtggaaaactgtctgttttacattgtgtcggaggaaaagcttacttcctcttccaccctcgccgctctctcctttgtctttttactaactcactttttcttttctttaagcttggttaataatgggataagtattctcctcaagtttattaattacaaatttttatgtttttattttcttctcattttatgtatataaaaaaaacaataagatctgataattaaatggacacaaacatagataaaaggaagtatatagtatgaacacatgaccatcaactttgttaagttcgttaatttaatcataaaatggatacaaacattactacagtcagtacaatattagtgaaaattctatttgttaagccaacaatttcttatcataaagagaagattttgaacacgacaagtgcgagactgcaaagtcatgtgtattataaagagttgtagaaagtgacgcaagacaatcaatctaaggtcaactctcattaatgtacgtagatttaccaagaaatctggcgagtttgtcgttgaagaaattgtaatttattcccatttcccgtattagtaattgacatgcaatatagtttgcgttgttaaattagattagtggtgcgagtgcgactatatatggagaattttaagcattaagatgataacgtaatgggttttaattttatagggatgcgactaatatatgagttccgaacgtgtgtgtctcatggaagctgtttgcgtgttcaagtttaaggacctgagatgtgtaattcgaatctgaaaattttgtttagcatgagagagacggtttgaaaaagagaaaaccaatttttaacggttaccagttatcaaaaatcatttaatatatatatatatttcaaacgagttttctaaacatttttttaaaagtttttaaatgtcaaaaataaattccattaaataattttttaaaaaaatacacatagtaacgatcatgtcatcatttaacaacaaaatctaacagttgcaaccaaacataatggaatgaaagttctagaactaaaaatttaattaactattttctttatcctaatcattaagtgagttcttaaagtttgtcgtgaaataaagtcaactttgacgcaaaaaaaagtgtgctgtgttaggattaaatccttaatttttaaattttgaaatcaattatacatattttttttattttaaatatttttatgttgactcattaccaatttttaaatatgttagtaagtcgtttcccttgtgaatgaagttttcaatactgaatcaaatatttaatttacatagaaataatttatgaattaattggaatgtacatcaatataaaagttttttaaactaatattcaactataaattgttgtgtatgatatataattacttaaatagttatataaaatagtttctaatagttgatacttttcatccacaatgcatccaaactaaactcatacttttcttggtgtagctttttcttttttatatatcgatcgaggttcttcttgttcagctgatttgtttttctatactcttgtatatgggttcttggtacccctcgtacctagcaatcaatatatttttattttctgatataaaaatatcagctttaaatatattgttttgggtaacgggtacaatttcaatactaattatacgtgcatggaaaatgttagcaaggaataatttccgccataaccagaatgtaactatgtaagtaggaaccaaccgagaagaggaaaaactaaaaaaagtaaagcaggagtgtgacaagaaattccaaggaaaattccgaagatgctgccgggtttcactcctgttatagaattgcttttgtgaagaaaagtcgtagaaggaaggaatagtataaaagataaaagaacaaacaaataaaaaagaaaaagtaacagggcaaagacatattcgaatgtgaattaaaaagatacaatccatgtatgtactgggggaaaaagagaaagaaaaaaaaaaaaaaagataaactccaagttcaacaacgcttgttttagtgtaattacaagtattttttgcagattatatgcttcatctgtaaaagatgtctagggctctattccacatggcccttgacctacgctttcattattcatcatggatgatcggtgttcatgtactccaaaaagaagtaccgaataaagaattgatccatgatgtgtctctctccattccacataagacttcctttgatgaaaagggaaagaaatacatctaatatatacacacgtacatagaaatacatctaatatacagagaaagggataagatgagtgaattttaaccatataattcatatagatagttaagatgaaaatgattaaaacaactttgatcgcgctcatgtataattatgtgttccaaagtcatcatgtattttttttaaaagaatggttatataactttaatcttaaatattcagtatagtttatacaaatagatttacttcttaacttttatatagaaataatttttctactaactatatctcatatagagatcgagatggagagaatccttttaatcaaagtatctagtataaaattcgtatgaaagatataaacattcgatataaattacaaattattaaagaatttgattatcattaccattattttagagatttaacctttttaaataagtgtcaagaaatcattaaataataatcttttttgtttctcataactattctcacttaaagacaatttattcaagacaattttatcacctcttctaaacctagttcttcatgaaattaattccttcactaaatccaacctccattgatcattaaacaataatcataaaaactatacaaacaagacatcaaaataaaaattaattaattttgtattagattagagttctttttaatcattttattagtgcaaaatatccattaacttgataacgattgttctatgcaaagaaaccttataggcttatattatcatctattttagtcaataagtatctttgaaaatttcacgattttcttgtaacgtgacattattatttttaacagacaaataagatattcaacaaaattcaccaattttttttattaatctaaacatcatagttatatgtttgatcaaaattagtagtgcatataatacttcgctgtacgtttattatattcaataatgacattgattcaaaatttatttcccctacttcgtcttctttttttgtttcttttttctcttgaaaacgtgtcaagaagaaacttgaaatttacagcacaaaaataaagcaagaacagacataagactcaaatatgcaataattattgttggttgggaaacgatcattcaacatatggagcattgcttaattggttttgttatgatgccgaagtatatacattttctcatacaagcctcgtgctgctgattatataacacatggaagggcataactaaagcttccatgcattttcgcgccaagatgatgtttccttgtttctatgcgcatggaggtatacttggggtgctgaatcaacctcttctaaagtggtagatatatgttgttgatatgagagaacacaaccccatgcagagggaatgttggtggtgtctagatattgatgttgttgcttttccatttgcagttttgcattgcacctactagtactttgaaactaacgtattctcacattcctttcgttgaaagattgttagggttgaaaggtagttgggccagaaaattttggttgttcgggatgtgtacaaaagataaattatatgtagctcaattttgaacatttatttatataaataagagcgagataaagaaaaaaaaaaaagaaaagagatagctgatagatgagtgatgtaatgagaaaaaataaagtgaaaattgaactatgagaatgttgtaagaataatatattttttgtacaatggtcacttttttgtacctatatattttgtcggcacaaccaccggggtgggttcatgggagatggattgtattccacttttgcatcattctgttcttctagtacatcagcagaacagagaacaaagtgggccctatatgttaaggccagcccaacgggaagcccacaatgtacattctttagtctttcaaaaaataatgttacttattaatttactatgttttaaagaaacaattaattgataaattatttataaaaaaaaaacacaaaacagcttaacattgtattgataaaaaattcaagggtcttgacagaaaccaggaaaactgttataagagagtattctctgtgaacaaattaattatgctattaaacactgatttcgaacaaagtttaccattaaagacaaaataaatagtcttggtaagcttcctggcgtaactctgatttctcagaaacttgggatccattctttggttgtggtggtaattctgggtttcttgatgccattttgtgggctttggtacgacaggtcgtaggcagttgcttcctgcaccctcagaggacactaatacccttcttgtaacccagcaccccattgagcggccacaattcacccagttactttatttgtggcattggagcctaacgatgtaatttgctctcttggtttaaatacttttttccgaaatttaacgttttttttataattttcgcccttttaatttttgtgttataatcttgataaaatgtatttattttatttttatttttacactattctgaacagtaaaaaaattaaacagtaaaacaaaattatctaaaagacttccaaatttaaagataaaaaaataaacacgtcttgccataactaaaacgataaaaaaaattacaaaacattaaattaccgataaaaaaagtatttaagcccttccattggtagtataaaatttgactcaattccaaattgaagatcggatgaaggggtattactaattattacacgtaggtggaatcataaaaaataatgatttttaacaatactagtagagaatattggttggcgaatatcgaaccataagagaaagagagaaaaggaaaaggaaaggaaggatctgttggaaattgggagcaaaaggaaagaaagatgcaggatctgatgtgcggataggagggtccaggtagtactacacaacacattctgctaacataacacaacataacaccgacttttctctcaaacgaacgacataattcaactgctgcactgcaaaggttcatttccaatctctaaccctaattttcctccctccaattcacctcgaggaaccacgaaacaaattcactttttctattttcgattggtttaatggaattcccttgtttaagatgctattcaaatgttccgttatctctttctctgcttgtattgaaattgggtttaactatgccctgatttttcttaatcagattgaaacttattttgaagaatgaacgtgggttttggttttgtgcttgggatgtgaattttttactctgttttatctgtatagaatgcacccgaaatacttctaaattcagttaacaatctctgttctggttccaggtttggacaatgttacgtgcttcacgaaacatgacctctgcgcaggacattactggtattttacatgaacaatatccttgatccattttattgttttactgtaacttttccatttataattagtggcttacccgcatgttttaattttagttaacaaaaaacaacacatggagcaatatcattggtgtttttgtgtctaatggaattgttacaacaacaatagccttgtccagtctaatggaattgttaatggagaaacttctattcaacacaaattagtaaagttgaagatggaaaagatgaataactactgttgtgagtgcagtaaaatcttcttttatcttgtattttgtgtgctggaattattccttagtgaaaatcataagaaatggtaaaaaaacacctttcttaaaggaaaaaaatgtttgcataaaaactcatgtttcttactgtctagtaacttttaatgtttggctacaattcataggcaactacactggatgttccttttctgtattggttgccttgtgaaaattattattttgtcataaaattattttcaccactcagtgtcatagatctatagctccctgtcttttgggtttgcctatgtatcttttaatcatttaagtcattgaacccatactcttgctcagaagctgcataaatgatttatgccttatcttcatcctcttcttttgcaattacgttgtgtgtaaaccccttcgcagtccaccctccagcaaggcagaaagaggaaaaacatgaaatagacatttaggcttcacttttaatcacgtgtttgctggttttctgagaagcatcttatttgtatgtcttgcctagggactgcaatcaatatatcctagctattttatttttcgttattacgcacagcttcaccttacactatctttaaacttaaagtatcttattttagcttcaaatttgaacttcaaaacttatttcaactttaataagtcctgtactcctctaatcctgtaactatttttgtttttaactaactcctgcactggccacccgtctgacctacaaaatatgtcaatatattgttattgctttgctgttcattagagtagaacctatccctcagcaactctagtgtactctagattctaaccttcactgtgaaaatggtgaactgtaataactaataactatgaatgtgttcatatattatattggaaaaaattcaagtcccacattggctagagatagtgtcaagacagagtatatcagtgggaggcaaccttcaccccatgagttagcttttgggattgagttaggccaaaccacattttaagatggtatcagagtctatcctagattcatcaaaaaaggtcacctaccatattatccacgcaccaaactaaaaagtgttgggcgtgaggggatgtattggaaaaaactcaagtttcacatcggctagagatagtgtcaagacagagtatataagtgggaggcaacccacatcccatgagttagcttttgaagttgaattagactcaaactcacattctaagtattatatgctatagccatactacgatactaatacctgcacaagtgaagccaaaatgtctatttcatgtttttcctctttctgcctcgctggagggtggactgcgaagggtttagactttagatagtattagtctttaggtattattcatattcatctacttattgtgattactcgcctttcttatttctgctttatctatatcagttcccccttaaagttgtctctttgaacataagactcctttgcattctgacttggtaagaaatgaagagtcttttgtatctattgcttgagaatatttatgttgctttccctctcctttgtatttctttttccacctttgtttatgattctctgtttcttgactgatctattgaattagcctcatccaggctaattttttaaaaattcataaagggattagttttagaatgcaggagtttgaagtaatatcttgttatgtagctgaggaaattattttctagcaaaaaaagtgtgcattaagttgaagataggtaaatttaagatgaaaggaatgaaattatagggctcacatgtttggtagttgagagatttgggcagaaaaattcacttcaaactaatgttttttgacaatcactgtttcttctgtatttacaaactcaacataaatctggagtttgtgttcctattgtgatatatgcttctacgttctgattgctgctcatgcattataaaacactaggttcgtttttaagatattgtgttaattttttattgagcttctttgctattatcctatgaagcatttcacttgttccttcactccatcccaagcacaaatttactgtctaaacctatgtagcaaaatgtctatccagataatgaagatgatggacagcggcagtcagaatcaccaatgcagtccccatctgcaaatggatattgatccaggtattagtacccagaatgtcaatgtacagtatgcagcacctggccagcttggaactgggcatgcaatggtatgaacttcaagctcctttgggtttcttctgattttgtcttggaagaacaaaatatgtttcttcaatgatttgacatcatcagtccaatttgaatcagctcctaatatttaattaattccagaaatactaaggaatattttgttttgcaaaggccatagccattgtatatcatccaatgtgtcttgcctgttgtaggtataagatagacacacattgccgttgttttgtcattgaagcaaattgactctgaatattagcaaatcatgatgaaaattttccccaggtttattcttcctctaattcatgaataaattggctttttttacattttcccgtgaaggtggcattcctattttgacacagcaagctaatttgaaagtagccattaaatttcttgatcttgtaatagttaaaactgaatttcttaatcagtacctactttgcatgcgaaaacttaaggcttctggtctggcaaataatgatgcaatctgaagtttttcttataaaatgttctttagaggttgtgttttggtgaattaaggttgatttttaagaaaccagagttttttgtcatggatattgaaggcaaatgataattgcccgagtgagtactggtgtcagttgttatttagatgtgatattaaagtttgttcagaatcactgtttgcactagaattgttcttggtatttgattttaaaatgtaaatttcttacgcattgtactaatttatgttactttcttatctaattgaaggcaccacctgtgtatccagatcctgaccttactatagaagcatctttgctccctatgatacacaaccttatcccccacaagcctatagtgggcagccaatggtttgctctaattctttaatgttgattctattaatattatagtggcttcttgtgtctttttccgatcctccaattattaaactttatgtccatcttcagttaatgggaattcagcaagctggtgttcctctgccaactgatgcagttgaggagcctgtgtttgtcaatgcaaaacaatatcacggtatattaagacgtagacaatcccgtgcgaaagctgaatcagaaaataaagttataaggaataggaaggtatatcattctctgcatctttatagttctttctatgaaccaaaagtagtgttgttattgttgtaagctgcttgcttctcttctctggaagtacttacttgttcttataataaatcttgcagccatacttgcatgaatctcgacacaagcatgcactgacaagaccaagaggatgtggtggtcggtttctgaattcaaagaaagacgagaatcagcatggtgatgtggcatcagctgacaaatcacaatccaatatcaatctcaattttaataaaaacgatcaaacttcatcagatagggcatcctaaactacagaaatgatgataccttagacagtggggatctattttatgtcacaagatcaataatacctgctttggatatcccacttttgcttcattctggctttgtacaacactgtagtggtgtggtaggtagcgttaggatgtcgcacgatgcaggtaaaattaaattggttattttatcaaatattgtcctttggtaggggagatttttatggtgatcattcctttgtatttggttctgtagagaggttagagattggtgttttgtttggttgaatcgtatttatttaccttgctagtgacagttgaagaagtttcaaccatgattggtgatggatattgatagttgtttttgttcagtgattaatagatagataaataaggttcacatgacttgctgatattgaatgaatcccgtctttggttagaatttgtcctaccacccttggcttgaaaaaataaatgttacatatattttatatgattcttttatatctatatatatctttttaaaaagttataactaaaaaagcattttaattttttacctgcattaacacgttaaactcaattatatcactattttataaccatattgtttatgaaaagaaaactaaatttactaatgataaatactcaattatatattttataaaaaaaacattcaaataagttaatttaatattattatataataaaaataatttatatatttattattacataaaattagacatgataatattataattctaaagacagtcaaataatgtaatgacaaaatccggaatatttctttaaaactttcataattataaaaactttaacataataagataaataaaataaagaattagtatttgttatcaataactattattttgtataaaaaataataactattattttgtataaaaaatattaataacttatttaattcattaaataattataaaattatattccaaattattatcctctaggtattaaaatactttataatcatatacgggacattttcttacttttattgctatctatatctatattattttttttttttttttttttatctatatctatatagtaatcttattttctattttaaaaaaataacaccgtaaaaagtaggagattaaattgagtaactcatttaatgttggttttaatctttatcatttatttttatgaaatttaatagttaataataattatttattataatattagatttaagaaaataaattataagataaaagagtaatatttatttatatattatatgtaaaggaagttgaacttttgtgaatagtcagatcgaaattttaatttgtcaacaatcattaattgatttgatatataaaaaaagttaaaaatttatctatcgttggatcaaattttaaattttaatggttgatttcattccaataaatatatatcatacttaatatttgtgagttattagatcaagatttgagttcacaacagtcattaatttgactacactttccttccactcaccctcccctccttaagaattacataatcttttctttcatctctccattcaatttcatcatttttgcatcctctttgtgaattctctttgcatcttatttatcttgttaaaacaattattttgttacttttgcatcttttcttgatgaattttctttatgtgaatttatatcttatttatcttacatatctttattttgtgtgcatgtacatatttttgaattagaaaaatgttctttagtttgtgaataaatttgaggaatcatccttatctttgaaattgagcaaccatgttatctctaaaattgagttataatctttatagtatattttttcttcttcaggtgttatgaaatacttgatctgaaacatagaaaaaagtaaagcaatgagcaattaattgatagttttggagattcagaaaataaaaataagcatagagaaataatttactttgatcggaagagggaaaacaaataagcactgagacacgcgaagagaaaaacttttgcattttatagacttttttattgtgttttctttttacgccttcgttcttttattaaaacttttgttatgtatttcatctcttctccttttttataacgtgtttattctttttgtgtgttattatatgtggtatcatttatgtcatgagtatgttttatttcaatgcttgtatgagtttattaggttcatttttaattgtggaagttcataattgtgatttctcattatccgtgtcttttaatcctttccatcttttgtttgtttacatttttctttttatatatatactgcatataaatattttaaaaaatatgatttaatcaaagggtttaaactctagtttttatgataagaaccttatttttttttgtacatattttgaaatattttttcatatttattttttcatctttgttattcctattttaatgttgaaattcttaggaaaaaaattgctcattcaagagagaatactgaaaaaaaaaaaaacaagttatcaaataaaatataacaaatcatcaatcctttctttatatctaatttatatattttttgacgtgatatctaattcataatatatttttcaatgattttcatgtgtttaattaaatagatttcatatagaatagatcataaattcactcctatgtctaattacgttcactaatcaattgatcatactagtagaatcggattttgtaatttaatcaaacttattttgtttttgaattggatatgcaattaatttaatcaaatttgatcgattcttaattggatcagtctgatttaattaatttttaaaaagaagttgaaaaaaattatgaaatttatatataatattaattatatatttatatagaatacatacataatttaaatttttaatataaataaattaaactagatcaattactataagacattgcttaaaccactaatccactaatccatttagttgatcacgtgaatgaccgaacccagaaagcatgattccacttctaataccaaatacatttgtgagactggacacccgaaagaaacaaagcgttttgaagagtattgttccgctctcatagggttctattctaacaaagatggcagcgatactcggtgaggacctgatagtggaaattctcacatgggttccagtgaaatctctgatgcgtttcaggtgcgtttccaaatcttggaattccctcatcttccatcccaccttcgtgaaattgcaccttcaaaatcaaagggcttccaaaacacccacctcctattaaggtgccgccgagatagcatgtttaatctctctgacgaattcatcggaccctgttctgttcgcattttacttgagaacccatcatccactgttgatgatgcttgccgccaattatagccgggtactttttcataggttcctgcaatggcttggtttccttgctttatcattctcgttctcttgttatacatggatccattgaataccgggtccggttttggaacccggccactaggatcatgtccctaaatttgtctcacttaactttccattcatcccaggatcatgatattggctttgggtttggttacgattatttgagtgacacttacaaggtggtgtttctcctttaggacattaaatcaaacaattgggaggtgagagttcactgcttgggtgacactgatacttgttggaggagaaatacgtaactgtaacttgccctgatttcccactttggggaggacgcgatggtaagcttgtgagtggcacttttaactggttagcagttcgctggcaaaccgatactgtcaatcagttggtaattttttcgtatgatctaaacaaggagacatataagtatttgttgttgcctggtggtctttctgaacatgctgataaccctagtcttggggttttgaagggttgcctgtgtctttaccatggtcaggagcaagtaagaacccgttttgttgtttggcttatgagggaatttggagttgaaaactcttggactccgtggctgaatatgagttttgagcttgttcaactcttggactccgtggctgaatatgagttttgagttgttcaactcttttcaccttggcaattattggcagcgcctttgtgtatgtttgaaaatgatgatgtcatgttgctggcaaactatccgcttcccaatacattttctataatcggagagataatagaatagtccgtactaagatttcaatgacaaagtgccgctgttctcccatgatgattatgttcaaagcttggttctaccatattaagctaccctatatttgcttgcatgaatttatgttaaattgtgtaagtgatttcagaacctcgccatttcatgtatcgacatgacagagagtgaataattttggtggttccttagtttaattactttgttggatgattctatttctattggcaattgctaattgtgtgtgtctgctttggttttgccttaatttccttttcctgattgataccttgttctcatctccagtgaggcaagggaagtatttggggttccacttgaagtgcgtttagagagtagagatactcattgacataaatccactgaaaaggccaatgtcactgacagtaacactgtattgtataactgtataagttatacatgtcatgtggctaatttgtactcaattatgattgttgcccttttgagttttgacaacaatgaaacaatgtattttcttattatggtgcaaagtactttctttgttttacaaagttaaactgcggtgcatttcattactgaaacatatttcttataatggatatccaatacaaatgtgtacatttcattacttaaactttacttttttgtttacatgggcatctatagttataggaagattaccaacccactctgatgcaaaatagcctttactgcaggtaccactgttagcacagttataacttggtctgtaaatgctatacaattcacatttcaatcataagatgttaaggtgtacatttaccaactcttgacactaaaataaatcatgtgctgtaaatttacaatttcaagccttccaccttggtctaaaattgctgtaacttacccagttacagtggagatatctgggcttggcagtaggaatagtttgtaatatgagtcattaggctaggtaagtttcaggcacattgcaagcgataataaggtttgtataaacagctgatcacatttttaagacttagtcttacatgccttacttgtagcagataagaaaaatggccaaattgtagctcatcacagcatactcaaattgatgtatttaataaatgcaacaggtgataatggaattattggtgagcagggtaaaataagagacagtattcttaatttttttaaaaaaaaattggattcaaagtacaattgtggccatgtttactccactatttttattattttttataatatttaaggggattgtagtaacttgaataattcattgacttcatatagtgagtaaacttaaagaagaaatattttagttttgttgaacagtgaaaaggcaatagtatagagtatattaaccttgagcgatattatattttattttttatgggcactgttttgatcaattgaccttgagtaatgcattacgagttaaaatactccttacctacatctttgtattttttttctctcactctccctttaccctctcaagtgttcaaccttgtagccaccgccaaagatggaagatgttgtcgaggacttgctaggtgtccatgtgtgattttagtttcgggtttctaatcttccatcatcttgtttttttacttcgcattttgtttttaatttgataccaatttctagggatccaaaaaatatcttttattgttaaacaatgtatattagacaactataatttattttaaaaaaaatgaatattcagttgaggaaataagtatccaattttgacctttcaattaagatgagaaataagaggaaggaaggagaaacacgtaccaagcagaaaacaacaacacgagcatatatacgaacaaaattcctttcataagaaaacccatccattacgttatcctttctacactacactgccaaacacaacataactacttccggtcaagggacaaatccaaggaaacactaatctagaaaaggcaataattttagcttattcacgcgtgttatattgatatttttatttgataacttttttttatatttttataaacataataattatttcggaaatggttcttggtacgaaagataatacgtattaaaagtatgaatggcatgacacacgattccctttcatattgactttctttcagcaatgagccaaatatttcttattaaaatttcaatcgaagttcaagtcttccaggccttctcttcctcccttatggtagtgataacaaataaataatgtaaagcccacttataattgcaagttttttttttcttgtatttgaaaggcatcatttttttgcttattttatatagtgtccttcttatcaatgatttagggaccttctaaaaacttcataatcgaaatgtataatctattttagaatatataccaaacataaaggacccttttgtgtcatagcacttgtgagagagcatacatgattagtgggaatctcggctagaatcagaaaaaaaaaaattaatattttatttttctaataatattttaaattattatttttaaaataattgcgttgcacatcagaaattgaaatgaacacacggctacacatcagctatttcttgcgttttggtctagtacattgctgttttttatatcataatttatgcatcaacccaatgatagaaaatgctttttcaccttagtttttgcttttcacgccccaaactttgtttgttatttctcattttttatacacctctgatggaaatgcaattttggtgtataatatacacaatgaaaatatgttttcactaaattaaggggtgcattctccatataaaatgaaaatgcattttagttatacacaatacacggcaaaaacacatttatgttgtataattaattttagatataaaataattctttttaaaaaataccttttccagttcaacagggacaaataagagaaattacattaaaataaaagcggagttgacactccactaagataagctaggagcaacaaactcaacatagaaggaagttttgattcatacttttttttattcatagacaaaaggaagttgctacatcataaaatcatcctgagcatcacatgccaagtttgccaacgcataccttttagtagtaatacaaaatctaattaattatgacataactttctccttttaatagtaatcgaatatgttacaaataattttttttcattgaaattaaattaggtatgatagaagttaacatttataataaataattgaattaactatcatacaattactttttttaatagtaaccatcgattgattaaaaatgataatttgtgtcatcattgattcaaaagtattttatatcataattatttatattactattaataacttttctgatcaattatcgttaagataatttgtatcataaagttcaccattgatgaaaagagagtattcaaacaaaattgaatgtgagggagtagagagagtgaaggcatgaaaatatatatatatatatatatgtggtgttgtggataataaacaaatatcataaaaggcacaaactctatatatttttgtttggagaagaccgcaaaatattttaatatgagtgactatattttggtttaaaatgaaattatcaaaagaaattgtattattttctattacagaggtaggacaacggataatacatctgtcatatcgtatcggcgaaaaaaaaaaaaaaaaacttataacaattgtaaaataactatcatatcttttcgtatattagccaccaaaaaaactctaaactctctttggaactcatctttatattcttgattttttttaaaaaaaagtgaacatatgattctttttaagaggaacacgaattatgtattcaggtttcttagggaaaaaaatatttatgtgattgatgagataattaagccaacagttcatatagaaataaataaatagaaataagactcgggtggtgtataaatgtactagtattttttttaatcattcggttcattcaataaattatgactaatttagagtttagttaaaaaataaataaagactaattatttttatcaatatttgaattcgagtaatatctatacattcaacattaactatttaccacttatgttgaatcacttagcataagtgtattagtgtagatacaagatgataccacaaaaataaaaaaaataaataatcaaatttgtctttgaaagtgtaatatggtacaaataaattcttgaaagatgaaaatataaatttagtctttcaatgtgtaaaaaataccataaattagtctgtagttaaatttgtgagactaatttgtcattaaattgtaatgttcaataatcagtttaataataaattgtatttatggaggaccaatttatattaagttacaaagtttaagatcaatttgtcattaaattgtgtgcatgattaatttattgtactttttacctattcaagtattaaatttaatttttcatgggaccaatttgattatttacccaaaataaaaagaaagcttaataaatttttaatacttggaaaatagatcttttcatattactatctaatatattttttccaaataagtaccttaaaaaaattatgtttcaacgcattatctgtcgttagtcccctttcattaagtgatgacgtgacagacaaaatgttaagtcattaaaccttatcactaaacacatagcagatacaaccatgtattatttattaatttattaaaaaaaaatcatccactgctgcctacccttctcattgctacttttgtcattatcgccgccattgcatctacaccaaagccgtcaacgacaggaaacctccaccatttcaagtatcctttattttcattacccttccacctccaaagaacaatcaatttagatcaaattaaacctccattctcaattggatctcgattgtgatacaccttataaacgaaagttttagatttttaaaaaaattctaaaattagaatgcaaatttgttttaaatgaagtgttcatatttagatcctagcaccaaacaacaccatgaaccaaccctgaaccgtgtgaaccaccacgaaactcatcaccaaaaatcattgcaaacccgccccaaagcacaacaaaaagactacaagccactacaaatccaccgcaaacccaccacggtggcaacaacaatgaattttcctctctttcttagatctagaaaccagagtttttcctttctcaaattaaaaacacacacagacaatctcttttatcaaatcacataagaagaaaaaagaataaaaaaacaaagtgattctgtcgtcaaactggatcccataacgggttaggttgagtttgagtcagggtctaggaggaataataaagatggcaacaccacaagtttggtggaattggtaaaagggggagaaagtgaaaaagaaacaaaaaaaataataaataatgacatggtcatttttgttatatttagtgataaaagtttcatctgttatatcatcgtttaattgaagggaactaactatatatattgcgttgaaatataattttttttccaggtatttagttaaaaaaataatgttaagtaatattgaaaatgatctgttttcaaataagaaaaacttaattaagcctaaaagaagaaaaaaataaaacaaaataaaaatgggcttgggcgaaaagcgttgctgtatggtagtagtagcggtcatcctcattgggcgatggatggatagatagatataaaagactgcctcagtccgtagcataagagagagcttaaaaccctttcgctgcgcctcacccaatcctaaaaccttatctcttcttcatcttcatcttctctcaaaattcattccaatggattcttcttcttccgacccttctcttccccaaacctctcttctcgtctctgaccaatcaccctctctccctcccggttccgactctgagaacgacgatggcttcgtaagcggtgaagagggcgatttggaggccgaacccaccaagcccgttctcgtcaagtcttctgagcccgtcgtcgattctcctcccgacgagtcccacaggcccattgcgaaggtgtccggggacgatgatgacgacggttccgttgttgaggatgcgaacgacgtcgttttggaggaaggcggcgagaaaaggaacgggggaggcagtgaaggagggggattttagcgatagtaacgaggtctttgtggaggcctctggcggtgatgatgatattaaagagattcagagtggtggtgttgctgtggagaatggagtcgaactgagtggtactgataaagggtttgaggctgctgctgctgttgaattgaatgaggaagatgcgaaagagaaggaggtggaggagaaagttaatgacggtgtgaccgataattcggattctgtggtggatgaaaaagtgagggtgttgatgttgaaaaggacgaggtggtggtgtggatgctgttgttgatagcgtcgaggttaatgtgttggggtctggggttgctgctgttggggatgaggtgggggttgatgagtctgagattaaagggctagacgagccggagagtcgtggggtgagtctggataatggttttgagcccattgagaagggtgaggaggaggttgttgataagcttgttgatgggggtgatgagtctgctgttgaccttgtacttgatgatcaatcgggtgctgaaggtgttgttgttggtggggatgatgtgtctgttgagaatggagttggtggagatgggttgacgagtgacattgttgttcctcccgaggaaggtggtggaggttcggagtttgttgagaaagatgaggtaaagatggagggtggtgttgttgacggagaaaatgggagccgtgtggaggagggtgataaggaggaggaggttggtcatcatggtgacagggagattgatgattcggcattggatgggaaaattgggagccatgtggaggaggttgaggagattggtgccaatggtgacagggagattaatggttcggtgtcggatgagaagggcgatggagtggtgtttggaagcaccgaggctgccaataagttcctggagaatttggaattacagcaatcacgtgccagcgggagttcccgggatgatgagaggattgatggccagattgttactgattcggacgaagaagaggagactgatgatgaaggagatggcaaagagctgtttgatactgctacattggcggctcttttgaaagcggcgtctggtgcggaccaggatggtggcagtatcacaataacctctcaagatgggtccaggcttttctctgttgagcgccctgctggtttgggatcatcgctctcgtcaggtaaacctgccatgaggcaaactcgtccgagtctttttactccttccattagtagagctagtgccatttctgataccaatttgagcgaagaggagaaaaagaaactggagaagttgcatgaaattagggtgaaatacttgagactgcttcataggctgggttttactacagaagagtcaatagcagctcaggtactgtaccggatgacacatgttgcagggaggcaaagtggtcaaatgtttagcgtagagtccgcaaaggagatgctttccagcttgaagctgaggcaagagataattttgatttttctgtaaatattctggttcttgggaaagcaggtgtgggcaagagtgctacgatcaattcaatttttggtgagacgaagaccagcattaatgcttgtggtcctgctactactgctgtgaccgaaattgttggggtggttgatggagtgaagataaggatttttgacacaccaggcctcaagtcctctgcatttgaacaaaatttcaatacaaaagtctgtccgcggtgaagaaattgactaaaaaatctccccctgatattgtgctctatgtggatcgcctggacctgcaaactagagatatgaatgatctgccaatgttaagacaattaccagtgcctgggttcatcaatatggcgaaatgtcatagtcactctgtcccatgctgcctctgctcctccagacgggccatctggtgccccattgagttatgatgtatttgttgctcaaagatctcatatagttcaacaaaccattggacaagctgttggggacctacgacttatgaatccgagcttaatgaatccagtttctcttgttgaaaaccatccttcttgtcggaaaaatagagatggccagaaggtgcttcctaatggtcaaacttggaggcctctcttgttgctcttatgctactcaatgaagattctttctgaagccagtaacgtttcaaaaactcaagaatcaccatttgaccagcgcaggctgtttggttttcgtcctcgctccccaccacttccatacttgttgtcttggttactgcagacacgtacctacccaaaactccctgctgatcaaggtggggctgacaatggtgattctgatattgaaatggctgatttatctgattctgatctagatgaagatgaggatgagtatgaccagctcccaccatttaagcctatgaagaaatctcaggttgctaagcttactaaagagcagcagaaagcatattttgaggagtacgattatcgggtgaaacttctacagaaaaacaatggagagaggagttgagaaggatgagagagatgaagaaaaaaggtaacactaaagaaaatgactatggttacatggaagaagatgatcaagataatggaagtccagcagcagtgccagtaccattgcctgatatggccctgccaccatcctttgacagtgacaatccagcttatagataccgtttcttagagccaacttctcagctcctcacaaggccagtcttagacaaccatgggtgggatcatgattgtggttatgatggtgtaaacattgaacagagtctagccatcatcaataaattcccagcagctgttactgttcaggtaacaaaggataagaaagacttcagcatccacttggattcctcagttgctgcaaaacttggagagaatggatctgccatggcaggctttgacattcaaaacattggaaagcagctagcttacattgttagaggagagaccaaattaaaaaatttcaaaagaaataaaacttctgctggtgtgtctgtgacatttttgggtgaaaatgtgtctactgggctgaaagttgaggatcagattgctgtggggaaacgcttggtattagtaggtagcacaggggttgtgaagtctcaaactgattctgcttatggtgccaatgttgaagtgcggcttagagaggcagattttccaattggccaggaccagtcttcactgagcctttctcttgtgaagtggagaggagacctggctttgggggctaatcttcagtcccaattttctgttggacgaggttataaggtggctgttcgggctggattgaacaacaagctcagtggacagatcactgtgagaacaagtagctcagaccagcttcagattgcccttattgctattcttccgattgccaaggctatctacaaaaacttctggcctggggctagtgagaattattctatctactagattgtgtcttttgtttgcgttgctagcaaggaaagtagactacgagtttatcatatcatgttgcttcttttcgtgactgtcttaaataatgagttttttttttttttttttttttttttttttagtttcgtctagactattgaatctcctgctatatagtgcttttatgtgcctgaaaattgtactgcaattgagatggaacctaaaaggaattgattcataaattttgttagcatctatttgaataatgttgatgtcagattatgctgttattctgatttctttgctctataacttctgtttgttggttatacattgaaacctgattgctgagcaattcctgaatatgataatgtgcctagtttgattggcccagaagtggtttgcaactcgtggtatctttatatatactattggctaaaggctttcttttttctcccattttatttctttcttttcctttgttttttttcctaatctccagcatgttgtgcattcttagagaaataattaacaatgcttgtctattgacatttattgagcatgatttagcttttcaagttctgcaaatggactgaaatgcaatgtgaggtttttgatgtcctttacggaagataattttattcgagttaaggtaagatcattaatggatgacaaagcctaacgtattacattatggagaatatgatcgaatcacataatgtcagaattattaattaataccatttttcccattaagatgaacattacgaacttgacatcatagaataagactcaaatcgataggaaggtttgggcctgcccatgtcatttatgctgagctaaatctagttcgtcgaggaaacgaggttgtaatgcttctttttattaactttctctttttatttgtgtacctagttgtgtttttggtgaaataaatttaaaaaatatcttatttcctaagattaaggtctggagtttattttggtacgagtaaatgttccaacagaaaccactctagatataattttatgtttaattgagttattgataggtaatttgttgaatgagaggttttagtcctatgatttcatttgttcaaatcaaatctccatacctttataattaattaaatctaatttaatatttaatttataatcaatttttaatgacgtgctaaagattatgtgagttgacatagtgatgtgacatttaaaaatgggatttgaaatatgcaaaaattgttttatccttgtttggttagaaaaaagaggtttttttttccaaaaattaatgagtttaacatcttcatttctttattttaatttaaatatttttctttctttattttcttttacacgatcaaactcacccttaaggttagatttgaactcactatcctttaacccacacatgagaagtattaaagacgaagaaatggataaacaaattattctttgctgtcattactaaccatattcgtcaattatttgctaaccatgagggacctcaaagttcaaaagggaactgctggcatctttttgttgcaagtatctgattgtcttactgttacaaaaaactgcgtggtttttgttttcttatttaccagaagttgttggatcaaagaaaacttcttagtcatccttgttatttgcccttgtccacctatgaatatgattctattcttatcattaataatgctgctaaaaggttacatgacatattcaacatatatatatatatatattatatatatatatatatatattctttcatcatttaattacacggaaaaacagtcaaatcattatagacttacactaagcactctaatcatagcccataacattcactacctttcagaaaataaagaagcccatagcatttaggatttaagtagagctcctttaaattgtggtataatataatataatgtaacaaaagaggcacatcatatatgaattataactaattaatcaataaagcatttccctatcatggaaatcagcacttctacaatcagcctacttgtgtttttcttttatcactcttctaaacaaaagatatagtataacaaaatttggaaattgacggagtcaaattttgtaacaattaccaaaagtgagtaccgataaatcatgtttgggaatcttattcagaaatacaatagtaatgcttttgacttcaacaacttcttaattattgcgacccagaatttgaattaccaagaacatgaaaagtttagattcataaccttttgttcacatatgaattgatactgatcgtggaatgaaccttacttacgttacctgctcaccattcttcaaatagcatcaatttattctgatgattcactattataagcgcattccaaattctgaagattatgaataattgtcttggcggcttgacttgattccagcaataattgagtagtataattatatataaaaaatacatttcagtccagaggacttgcatgatttcaatcctaagttttttttgtagacattctagttaaattatggatgatattatcaagctagtgtgtttaatattcattattcttaatcccaaacattaaatccacaaatttgaagtaaatgaatttcttattgagtatagaaatgtgtcaagtcaaattctatacccatatctatctccatgaggccttaatttcagggagttttcaacatagtcaacacccagagtaaaactattccaaacaaacatcgaactttaggcgctctgtgttgcactaccaacatcactataagacatacacatttaatatgtctagtcagaaatatggccaccaaattaatcaattttaagatacaagtctaagatcaagttgaatgaaaatagagggattctaaaacacattttacctaaaaatacaattaaatacaataaaattatctgaagaccacttttttatgtgaaaatcaattggctaagttaattttattataattattaaaaatgtaagtagttattataacagttaaattatttaattataatattaatacaattaacttggccaattggatttccaaaaaaaatatggttagttaagtagagaaatttattatttattattaaattttgggtgatatgtatttttagtcaattttatctagtatcttaaaattaatgaatttaattctcacatttttaaataactttttgatgtaacatgatagctatattatcgtaacaatcattgataacatttattgtagccacgccaataaataaatttaatgacattataagtgaaagttaattccacaagtttttagaaatgcaaggatcacttttattaattttgaaatacaaagagtatgatcaaatctgattaaaaataaaggacttaaatatatttattttttaataataaatgactaaattaaccaactattggaatgaatttgtccatctcaacataatattttttattttcatttttcctcgctaaagctcctcacatgagcttcccttcttccttctcctctctctctcctctctctctctcttatattcacgtgagcttcctttatgacccacccttggaaaatatataaataaatataggcaaatattaaagagttcttgcgatattgattaaaaatttaaaaaaatatttttattaaaatatgtaaaattatattatttatgatttcttttacactttcttacaatttctacaataaatgttttttattttattttttaattaatatcctaaaaatactgattagtaatacccataaatataaaagaatgaatcaatttatgcatgttgaattgatgatacaagacagccaagttgggaatttaattattaatcgatattatgtagggtaaataaacacatcggagtatacttgccatttaaattcacagtattttgttaaataccacaactaaccatgacaataataaatgatatcttgttacaattaattgcagaacattacataaacaacctatatataatcgatttttcagactcaaaactgtcgacatgccctttcacacttctttccatctttatatttccttccaattaagtatctcatcataggctttccaatccaagcttctaatataggtgcaatgtcacacaaaaagagagtaaaaaactctatccaatttctatgtatatcaacctagcttacatatttcttgtcgtgcatggatccctttgcgacacctcaagaacaagagtaagattcaggaaaggtgtaaaatgaaagtaaagacattctagagtgagaaagttggtgggaggggtcttgtaaagaaaatagaccatcactcatcacccaaaagtctaggacactcttttggtgcatgtcaagaaatagatcatcacccatcgtccaccaaggaacaaaaaagccttaggtccccccttgggacttgaaggggatctctaccttaatttatatttgtttttctattaagaaattaatgtattatatatcaaaaggagatttcagtggacccaacacaacccattggcctaaaactcctcctcttcaagaagttatggcacaaattgatttatccagaaggatgcaatcatgcaaagctatgcgtctatttaattacagattattacataagataattttattgatttttatataataattattcttaaaattatatttattactataatttttatttacagtgtactttttttttatcttgtcctattattctcttttgatatgaaacatgtaaacttttattgtggtccaaagtcagcaaatgagaaataaagttgagggaggagatcttccaacccatacaatgcttacatttcattcaggccaggcatccctcactcaattacgtacgtaacgtgggagtatatttcgtacgaattttcaaacaaagatgttgctagtatttcgtacgaatttgttaataccaaaatgtcacaaccaatcatgatgtgtataaatcacacgtatagatgagttaaaatgaaaaagaaattacctgtcaaattgtatgaatttaatttgtactcttttgtctagtttgttttcgtattctttatcattttccaatttcaaatcctcgtaatgccgtaatgggccaagtaaaaaggtattcattgcaatttgccttattatggatttgttttctagagaaagtaccaaaagtaaattgcattacgtgcatcgcccatttttttttttaaattatgattggatttgattgtttaaagaaaggaagacttctagttttctgctcaatgttttaattataaatcgttttaaatgttaaataaataattttaaacgttaaataaataagtagtataataattacaaggctaaattactaatttaatctctctatttatttaattactttaacttgggctatctattattaaaattgtaatttgttccttaaatttcaaaattgatgcaatgttctccattctgcaatattttttttaaagattgttatttttatgcatcagaaaattgtaacttatgtttttttatcaacttttttctttttaacttcataatagtattttttatgtaaaagttaaaaaaattattgcataaaaacaaaattaattatcttaaaatcacttttaagcaaatttatgcaaacaaaagttggtgtaattataatcgattatttaaataatctaaatttttataattattcgagacgtacccctttctcaattataccattaatcaaggaaataattttattaaaacgcgttcttttatattttttaaagacattatcatatgatttttaataaaatctttcctcttttaattatttaaccaaatatccttagaatacttgttagcaagactctaaatgaaaaatggtaaaaaaaaaaaaacttaataactaatattttatataaaaacaaaaaagattacatttgttgatttcataaaaaaaacctttaaatgacatttgtaaaagaacaaagatagtaaaaaatagagtaactaatttaacatttatatatcattaacggatactataaaagtggttgtaggattagaattcaagaccatcaagttagaattactgtgtgtttggataccaagcataaacaatctcaactccaaaaaccatagtgaaaacttgaacagttaaaagtaacaaaaaagagttgttttgttgtgattgtaaaaaataattgaggtgcgataaacacaccgtatactcaaacacgcattcaattgattcacatactcaagtgattaaaaggaagactaaaagcaaaatgtaaattcttaaacttagtcctactaatcaatatggttttgacattacaaaaaaactgtactagtatttatttgaatacatttgttgtggcagatgtacgtgcaattaggttattcccttaaccgcgagatgctgtttttaggtcaaagttagcaacctgcaacctttacaccctacaccacactctgcaacaaccagcacaccaaacgcttgtccatatcttcctgtctgctatctcccttcaagcctaacgtaccatgtctacatccccatctctctctcatctatggacatgcatcacatgccccccactcatgcatgcatcacaacccatcaacatttaatttcaaaccatttctcatgaaatgaaatggttttatcccacggattaaccctatacccaaattgttaccaccacctttttttttttttttctttttcttttaaattcacatgttgaattaactactttgcacctaacgttttgaaataacgaattagctaatttgtaccaagcgttgctttaattgatccacagacaaaatgtacttcaccaatatctttgtcttgctcaaagaggagatagattattaattaagcatttttttaagccaaaaggcttcctcattaaatagatgcgtcatatactattttttcctctctaattctgttttaattttattacaaaagtaatacagaataaatagtaataaataatcatcaagagggaggaaaacccctatcatctttaaatataatttggaaatcataatttaacttaataaaattgatttctttataaagaatctaactcagttaactaaatataaaattagtatttttattcttacaaataaaaaatatttataatttatcagaaattattagtatctcaatatcttgttattactttttacaagagcatctgagtaaatttttggctattatttttacaagactccttctatatttctattactttaattgttttatttcaaggtcaggttttacttttggtagtagttcttgatatattctaggaaaggttttaggattctggaagttttctataaatattttagaaaaagaaaataaaagaagaaaaataaaatgatttttttataagttaaaatgagtttttattactactttgtaaatgtatccatcttttgaaaagctatattggtaaacttttaaaaattagctaataaaaattatttttacttatgaaaagttcatctcatttttttttcatattttcttttttaaaatgttttaagaagtttatccaaacatatccccctatttcttttcactttatgtgttaatttggttgctttacttaatttataatgatcaaatataaggattggaatattctttgtataacaatggaattgattaagtggaagtagttattatatcacaatttagtgaaccgatgtttaaattctcaattgaggagtatttatgtttgtattccattatgtcttgaatatgattacattcaaaggaggaaatttggaaaaagaaaacattctttgtagtttcaatgtagtagtatttgctaaaaaaaacttaaagtaaattacacatgctcctttgagatttaaggattatgcatgtctttattttctttaaaaatatacgtgtcttatgagatttaaaaaaattatatatgtcctcgagatttaaggaacttacatgttttaaaaacctatacgaagtcatgtgcgttgacaatttgattaaaagaaggttaaaatatgtttttattttcataaatatgaaaatttcagaatttgtagttgcaaattttttgtctattttcgtccttgcaaaaatttagatatgatattctttttccaaagctaattcagatacattgacctatgtatatgttgttatagaaagtgtcatgttttaacttttctacatcgattatatgatctgaagctatatctgaacctacatataagttatagaaagtatcaattttttaactttttacaataatatacatataagtgacataaaaaagttgaaaatctatagtttctccgataacatatgtgtagctttgaatgtatttaattaattcatgtcaaaaagtaataaatttaaattttgtgagaacgaaaaatagataattttttataacaattttaaatatttttatattatagaacgaaaaaatattttaatctttttaataaaaattgtaacacatatgattttactatttagacgatatttaaagatttgtagtttaaaaagaataaaaatatgtaatttttaaataagatgatttagtaatttttaaaaaagaataaaaactttagtttaaaagctcgaaactgataaaatgcaaaggagaacaatcgtgtactgtttttcaaaagaaatttcgataagtaaaaaagacaaatgatgatattaaaaaaagactgataattttttatttatcaaaataaatgaaaccaaaccatataaaaatttcaccgatgtaaattaccaaattacaattaaaacgtgtaatcattagttaaaaaaacgtatatttttggttctgctgtgcttttgttggcagcgcctaaaagtaagctccatgtcctttcatttgatattctctctctttgataagaaaaaagataaataattatttttattaataaatgtataaaatattgataaattcatttcaaaaaaattaaatttaattttaatcatcaaaatgaaaaatacaacaaattcatttattagttaattttatctttatcattaataaaatagtctatgtgatataaagagatgaaaatatcataaaaatgattgtcaacctgattgtgattaaatcaaaaattggtaaacttttattaaattattctgtcatattcaaaatttgtaaaatataatttaatctcattttttatcattataagtataatattataataaatacttaaaaaaataaaaaaaatataagttataataaatataatattaattaatatacactaataattttggtaaacttataaaaaatgagaaattaagttaattgttataaaaaatgagacccaccttacatttattaattaatattatatttattattattttttctattttttaaatatttatgataatgttatatttataatgataaaaaaaaaaaataaagattaaattatattttattcttaatgaaacgaaatttaaaatctgatcaattagtctaatgaaaatttaatgacatttttagtctaatatattcaacacccaaattataattatttttatgatatttttttggtgttatataattctttcattaatattaataatcaaacttaatgaatgaataaattatcatatttttttattttcaaaattaaatttttattttttggaaatgaatctgtgaattctctcatatattttggcatcacacaatatcatataaagagatcgagacaagggttttgcaaaaaaaaaaatccaagtaaatttaaggagccaccactgttccaaccagccctttcattttacagtgcctgtttgttttttcgtgtttgcattcactgttctacagaagcaaaaaagagtgctttgttccatctctttctgtgggtgtgtctcgagattggtgtgtatgctcaagataaagctcactcactcagtcacagcagcaacaaccctttttccttaactcttgaaactgtgttcaaagtttggattttgagagagcatgatctgatgaaggaatgtggaggctctcttgggggagagggcaaggaagaagaggactactgaaaacaagtgttgcctttttgaaccccaaaaaatacgtttttttttttggttttgttgttatggcactttgtatgcagagtcagcagagagattcagcatcaaacaagcagctcatggattgtggcaagtatgtgaggtacacacctgaacaggtggaggctttggagagggtgtatgttgaatgtccaaagcctagttcttccagaaggcaacaaatcattagggagtgtccactacttgctaacattgaaacaaagcagatcaaagtgtggttccagaatcgcaggtagggaagaagagaaccaaaacatgcatatcattgtttggtttcaaccttgccacatcataaaaaaaactatttttgtcatgttttgtgttgtgtgtgtgtcctatggttgaggatgctcaagggtgtttctgagcttctttctctttgtaaagttgagttttttggtttagtatatttgttattcagtgtttttttttttgcctttttttccttttcaaaaatggaatgtcataaagtgatgtttcattatttgcattttttttaaatgtgttatttgggttcaattttagagaaaaagagtaagtcatccctcttgaaaggaagatctactgggaaagttacttaatttttgtcattttccttgtggttatccaactagttaagatcgatcgtttttatttatttatttccctcgaaaaggagtttcttttctggagttgattaaatgggagataatgacagctgactgttcatttttgttgatgagttttttactgctttcttctgaccttcatcatttttgttttagaccattttctgatgtttctgtgtaagatgctttaacagaaatgttcatatgatcatttggcttttgttttgggttggtcatagataagaggaaggataataacagctgattttaacgacttctcccactagattaatcagttttcaactttagcttctttttttctttcatttttcctctttaaagattttttttttcaggtctctaatattttctctttttgaattacggaagagaggagattatgttttgttctacactctaaacttttctcgaactaatttttcaccttgtccctgcattagtatttttttattaaatcaacatgcatatatcatgtttccaaccttttatctgcaattctgcattgactgattaaaacaagttttagtcttggtccgatagtaggtatctgaatttagtatgtaattcttgttaaggatattcacatgtataatattcttggtctgatagtgtaagggacttgtccaatagtaaagtgggaaacttcaaagagtgaaatgaataatgaatgattatcatacaatgttatggtaaattgtatgggaaagatgacctactctacctgccttacactctgccaattttcttctgtagatgtcgtgaaaagcagcggaaggaagcctctcgtctgcagacagtgaatagaaagctgtctgcaatgaacaagttgttaatggaagagaatgaccgactgcagaagcaggtctcacagttggtttatgataatggattcatgaaacaacaaatacatactgtgagtaactttatctttgagtgattgctcttctcaattatcattctgaatgttcattggtgtaccattctatctatatacaagtatatgtgtagtgtactattttattgttattgaagaatctcatttactggtttcttaacaggcatctgctactactactactactgagaatagctgtgagtctgtggtagtgagtggtcaacaccaacagcaaaaccccaaaactcagcatccccagtgggatgccaacaacccagctgggtaagtaacttcataatgcaaacaaatttgtttaattaatatatactccttcaccatcgtcacgagtctccaattctttattctgccagtcttcttgcaattgctcaggagaccctggcggagttcctttccaaagctactggaactgctgtcaactgggtccagatgattgggatgaaggtatgacttattcaaaaactcttcttcatggtcattgctgcataaatgtattggtataattatattttgcctcattttttctgtcttaatgtagcctggtccggattctattggaattgttgctgtttcccgcaactgtagtggggtagcggcaagagcctgtggccttgtgagcctagagcccacaaaggtattatgctgtaatgaagcttattcattgcagaattattttctttgctgaacaatgaaaccttgttttattgaactaattgctttccacatcatctcaggttgccgagattctcaaagatcgtccatcatggtatcgtgactgtcgatgcctcaatgtattgagtgtagtccccacagggaatgggggcacaatagagcttatgtacatgcaggtctactgattattttatgcaaaaaaagaagttgaactgttgtttaaattacttttaaattattcctctgttgtttttcttgatatttaaatttgatttttttccagacatatgcaccaacaacattggcagctgcaagagacttctggactctcagatacactactagtttggaagatggggtcttgtggtactgagtggaatcttgattgttgtgtttttcttgatttactgtggcttctttcctaggaagagtttgtctcaaagaatgactattatttttttggccttgcagatttgtgagaggtccttgacttcttcaactggtggccccacagggccagctgtttcaaacttcatacgagctgaaatgcttcccagtggctatctaattagatcctgtgagggtggtggatctattattcacattgttgatcatgttgatttagatgtaaggaagattatgctattcaaatcattttttaaatttccatatatttgaacttcttcttcctacttatataactttgtttttgatgtaggttttgagtgttcctgaagtactgagacccctctacgaatcaccaaaattcttggctcagaaattgactactgctgtgagatttcttctaacactgcattatatgtttcacatgacaaaagctgttgatttaaatttcaaatattattgtgcaggccttgcgacatgcaagacaaattgcacaggaatcaagtggagaagttcaatatggtgggggtcgtcagcctgctgtcttgaggacatttagtcaaaggctttgcaagtaaggcccttccatatttggtggttgcatagttgggcatttgattaatcactttgtcttcatcaatccttactgaccaataattttttaaaatttgatttagagggttcaatgatgctgtcaacgggtttgtggatgatggttggtcactgatgggtaatgatggggtggaagatgtgaccatagccataaactcatctccaaacaagtttttcggttcccattacaatacatcaatgcttccagcatttggaggtggggtactgtgtgccaaggcatcgatgctgctacaggtacttctcagaccaatctatgaggaaattatcattgttctctaaattaactctagtatagtagcagcaatcaattccaagaactcttgctccttgttcccccatgtcccaacctgctagaatcttctggatttttgtagtgtttatcttcattatactcaattataaaacggtgttctgcagaatgttcctcctgctttgcttgttcgttttctgagggagcatcgttcagagtgggctaattatggggttgatgcatactcttctgcatgtctcaaagctagtccttatgcagttccttgtgcaagacctagtggtttcccaagcagccacgtcattataccacttgctcatactattgagcatgaggaggtattaatcattttcagggaatgattgatgaacttcattttataattttatttatttatatggtcattttccacccactacaatgatgcagttcttggaggtagttcgtattgagggtaatgcatttccccctgatgatgtagctttggcatgtgatatgtatctaatgcaggtaaatcatttttgtgtttgggttgtttgtctgcttatcttatttaagcaggaacttgatgttactgtgaatgatttttatgtaccttattatgcaatttgatgtggcagctgtgcagtggaatcgatgaaaatgcaattggagcgtgtgcacagcttgtgtttgcacctatcgatgaatcatttgcagatgatgctctcttactgccttctggtttccgcataataccattggatcctaaaacagttagtgacatttctcagtagcttgatagttttaagggaattggtcatgaagttattttgttaggttttttaatgtttaattgccatttcactacttcattttatctttagtttgagggtctaaaattagcatgaaccatcaggtgaattcataattgtcatatcttggtgcttcttttatacaatttatatctagactgtgattggccgactaaatttatctatcttgaagtcttagttcacatttgtttcaatgaagtaatttgggcttttagcaaaaccaagcctttcttacagatgctatgctactacatttgagcatgcattgactaacaagatttcttttttctgtatgttttgctttcaggatggtctggcttcaactaagacattggacttagcgtcaacactggaaacaggatctggtaatgcccgctcagctggtgaaagtgattgaataactacaaccttaggtcggtcctcacaattgcatttcaatttacctttgagaaccatttgctggacaatgtggctgttatggctcgccagtatgtgcgtaatgttgtgcgatctgttcagagggttgccatggcaattgctccctcaaggctcagtacacagttggggccaaagtcacttcctggtccaccagaggctcttaccttagcaagatggatctgcagaagctacaggtttacaatcttccattaatcttgtctgtaagtctatttttgtaatgattaatgtattttcctaaattatttgatatccttgtcttgagttgtcttcaaggttagttaaagtacctatagaaacttaccttgtatttgttaacttggttattcaccttgtatttgtaatttttagctgtgtcctgtaattgtctgaaaaaggctcagtttcagatacaaattgcacaaatttcaccatcttatttcttgtgtctggtatgatatagtaaagattgttttttcaggctccacacctgcacagagcttttcagcattgagtccacatctggtgatgcaatcttgaaaaaactttggcaccatccagatgcaatattgtgctgttctgtaaaaacaaatgtaaatcattgctgcatctatataatcctaatctgcctcaatttttatttttttccagaagtttcttgtttttagtccaataaactcagcaagtaagacatttgagtgccaaaattatgcaggcatctccagtgttcacctttgcaaaccaagctggacttgacatgcttgaaacactcttgttgctcttcaagacataatgctggataaagttcttgatgaagctggcaggaaggttctctgcattgagttctccaagataatgctacaggtgattcacttgtaaactaacaatgtctagtctttttagggtgtactttttttttattggcaaatgttagttgtagaatgttagttttgttagctgagggggatcaagttttgacattttctccattcccttctcccttaaccaattcaccttatatcccttttagtgtgtacttgtaagaattgtttacatctttttcaagtcttgactataattagtgctcttatcttatttgtcctttttcatatcagggatttgcatatctgccagcaggaatatgtgtatcaagtatgaatcgaccagtgtcttttgagcaggccattgcatggaaagttctggatgatgatgattccaatcactgccttgccttcgtgttcatgaactggtcttttgtctgatggggggaaccatcatttagatactttattatatctattaatttatattgagtactttactaagatattgtcacatcaacatcgaatgtaactaatgtctggatttcgtgaactcatggttgtgtgtgccattagattagctttgctctatgcttttaccaaggatgtacctttcttactatataaactccttgttgaagtatagcctacttattcgcaaaaattatcctttagtggcagtttagtttttatatttatttatgtgaactcagtcttttaatttataaatctcacatatatctttttggttttaattgaactctgcggcattgtgatttatgtagaccttcctagaataaggttttttattgtcttgatatctttgtagatattagagtgagatgcaaaagtaggattcttttcgttttaaaataagtcagatttagattgtgttacttatattaaaaaaaaagttaataaataaataaaagtgataattttacaaaattagttttagtattaatattacattgaaagactatagggatatttattgggaatattagtaaaaaaagtaattaatatcatgttaaaaagttaaatatgaatttactttggataatttttttctcaatgtgatgcttaatttggtaaattcatgaattaaatgcgaatgtcggacttgaatttgtcaaaatactgcctaaaatatgaaattacagaaggtatatcatggattgatgcttaacaagcttgatttgtaggtgtaatgtgttgaattagggtttttctttgcaccttattttagaggcgttttgattttgacaacagatccagcaggattgcattgttattgttcccggaacatgtcatgattgtgttttacttgtttgttgaaggaagcgtgtcttgatttcgacagaatcaatataatgagtgagatcttagaaggaatgttttatgaccaaatttctacctatttatcgtttgtatttctatttatggtcgaggaaattcaactttctgtctgtcacaattctttcttttcaaacaagtaatgtgaaattctgaactcctcgcagtgggttttgatgttaaacttaagattcaagtagtgcctcttccttctagagaatttaaaactaagatatatttttcttatttaaaatattacattttttaaagagactattttatatgattgagtgtgttaacaacagtgaattatgattgaatcaatataaataccacttaccagtaaccaaatagatttatttatttatacttgaccagaaaaaactatgacacaaaaattagcagtttattgatcactaatttgattaaaaatgtttgtgatgtgaagcagatttacaagtgacaatatgaatttcctagaaaagtagaaaaataagaattgtatccgaatctagccatgtaacaggtatttgtattgtacctgtgctataatatgcatctggagcagcttgaaattttgtctcagttacatatttgccataatggattctctttgagagagcctgcagtcacaagaaaacaaaagttttcatcaatgtaacagccaaaatttatgattacaatctctacttactaagagaaatttctgaagttttcaaaataaagcaagctaaatgttgactaaggaaactcgcaagttacaataatctctctatggaaaccaagcactttcatgcagaactttgcacgaggcctgatcctgttttgggagtcaccacatagtacagagtttaccttcttaggaaaaaatttccactaatatgatcctgttataataagatcactttttttgttctggcgtgaaaatgattgtttcaaaaatatcaaaccaattggtcttgacattgcacatgtaaaaagttaagttaaataccaaaatagaaataaaaaaggatatgaaatgatggtatagaatatagatagatacgtatataattgataataatactatgctttttaatatgaagtaaattaaataattcaaaaaaaaaaaaaaaaaaaaaaaaaaaaaaaaaaaaaaaaaaaataaataaattaaataattaaaacacaaggtggtacaacccctggacatcatttcaatatagaaatgaatttaactaaaaggcaactaatgtgtaccagcaagcatattaagtttacaacaaaacaacatggaatcagagttaacatcatctcccttctggctattagtcggataggaactctgaggtgaaacctccatactttatcattatattaattgaatcagcaatagggtgcaacacctattcatacacgacaaagaaattcagtatagatgcaattagcacataaaagatgaaccaacaaattcattaaatatgtagcacacacagacatttgctagatttttagcaacaatagtaaataattatttcatgtcacctgactaaatagatagcaatgaaacaaacacatgctgaactctgaatcaaaccatgcctaagctggaagatgacaattaacatgaacaacattaatattgtaaaccaataattcacacaataaaattacccatgataaagcaaagtcgaatgaaaaattgttaggccagccaattgatctcctaatattatcaagggattttatgcttatctgtttttgttattaattagacttgtctgattgttattaatttgaatttatttgctttgaattgatgataacatatcaagttgttatatacacctccaaagcaatagaaaggctgagtcattatcattcaattatgagtaatgatagacgcacaacaatttcttcaataaattgtacaacgaatgtcatgtcagccaaaaaaatcaaattttaattttaattaatgaaaaaaaaaaccatcggagaaattatatgggaccaccaaggcaactatggttctattaagtaattttgtgatacatggacaaataagatacaacaaacagaaaggtaacagtgttatcttttaacagaataatatcaaatttaaatcttccttaattaaattaacccaaatcttttacaaatcacatttatgattgatatcaaattcaaaactttcaaaagtaatactactctatcatcaagtatgtctatcttctcccacgttttgaaaatcataaagttctgtcattgttataccgtgaaacaaccacgaaagctctgccatggtttatgcatggttgcttcccagaacaacaatgatagaggtggagataagagagaccataaaacatgaaaatctgattatttgtttttggtataaaaaatgtaattagtattgaacagtgatttttttttgttaatggaaacttaattatcttttttgtttgttattaaaattaaaatttgatttttttggctgatgtaacatttgttttacaatctgttgtaaaaaaaattttcgtctatcatttctcttcaattatctactacaaaaatgtttaattaatttaaatggactaaaaaacagtacaaagggacattgataataaattattatttgcgtacacatccttactcttattatatagtcaagactgtcaagttctgaccatatccattgtactccgatgcctccaaatttcatcattttaccttattttaataattacacagagcattggtcataccgattttgtactaaagtttacacacgactagaatagagacagttaggtaatgccaatgtcacactcatcactcatgctttgtctgtttaggaactttttttttatttagatggtgaaaattggtttattttttttaatcattaaatgtgtgtttggattatcgttgatagaattgatgttagatcaacttggttttaaattaacatgattttatataattaattttgaagtaacttaattttgtttggataacatatattaaaaaattgatttttcaaaaaattaatgtttgaatagtttgagtcataattgattttaagtgtcaaattattaaaatagactttaatgtctttgaatatttatttgttattataatttgctgtttatatatatatatatatataaacaaattaaaattaaatagatatataactgacctttgagctactactcttaccattttttaagaaaatgatttttttatatttttttatatatattattaactgacctttgagttaagagagtccagtatagtatctgtaacacagcacaagattccagcacaatgttcgtactatcgttcaatgcagatcctatgaactatgaagtgaagatggtaataatctttctttaattgagagaacaagtaaatataataataaattttcaactaccaaaataaatgaaggtccaaggaaatataataaatgcaaataaaaaataaagaatgtacttgttcaattattaagtatagcatttgcaaaaagtataaaaagtacaaggattttattgtggggaatatatacataatgatattttatattttcttgaatcaaaatcactgtaatttattgtggttacatccccaaaccaaacatgctctaaatgattgctaaaacccaaccttcctcatgttcttagatggcatgtctcaattttttttttaccttaatgactcttttcttctgaataatatcaaaaataaataaaatagcagcatgtgaaaaacattttgtcatgttttaaacatttaaaaaattatatgtaaataaaaaaaatatttcatgtattaataaatcacgtgtattatattaaaatttatttatttattaaaatataatttataaaatatttcaatgtaattttttttcaaaattcataagatattctagaaaattattaatattgttttttccattttggtaacatttatgaaataataatacgtattttagacattaaatacaaattatcaatatatggctaacataactttagaaaaataaattagtattaataatataaaatattttttatattattaattaatcataaattatcatataaaatatatattattataataaatatcttaaaaattatactatcattaattttaattgattaagtaaaattattttaattattgatggatgtgattaaattctaatttttaataggataactctactgtcattgtagtaaaactttttttatttgttttcttactaataacattctaaaaacttagacccgttagtttattcagtgaatggacaaatgttttcaaacaatataaaaggtcttatttatttttatgttccacaaagcccattttcaccctatggccataaacactttctcacaccacaatgcagcacttgcgttaactgccagaaatagttaattaaatttttaatacaggaagatcttgcactggaagtgggccccactggatcttcagcgcatttaaagctagtataacattagcatccatcccatgtatgtatacgtatgaatgtttatgtatatgtcctaaacatatcatgcatcattcgatattatcatgcatgatgaattgatcacatgtcactacttttttgtgtctgtgttttcttttatttttccgaaatttggattgtccccggttaagtaaaaggacccttaattttttttttataagataacaatgatacatgaatttaaatcattttaattacaaatacaaattacaaacaattacatttaaattatttttatttgaaatattgttttcactttgttattttttattaatgctaaggctaaagttaaggaacaaatttatcaccgcattaatttcaaaacaggtaaataaatagactaacttttcaactttacaaaatcaaatattaagtatatgaatcaactcatataatattattttaatttaattaaaagttcgaattcaaattttaatacgcaacacttaagaagaattttattatacataataattttatctaattcgataaaaaaataaaaaaaaaaactccacaactcggtctccattccattttaacaagttggatccctttatttttcctctctcttatggtgcctctttatgatcgtcccaaaagtaaacacgtagatcttattagcatcaatgtgtggggaaaaagagagattcaaaataagcacaattttgcatgcagtgtttaatatggcttctgagcatgtaaaagttggaaagatatactgtagctctcaaaatccaaggaaagtgcgtatctaaattcctagctcttgtaatgtcacgttagggagtgagattccagatgcaaaaaagaaacacacatcgttgtcttgcagccttgcaggtttaaaagactaatcaaaacaacaaattaaagcactggagaagaagaaatcaaatactagtggggtaggaggatatttgtgttctgttctgtcatcatctgtgaacttttcactgttttaaacatttccttgaactcaactgggtattaatttctacctcttttgcttcaaatatgtaatatggtacataataatcttttggttctcttaattatgtaacaaccggctcgttcggtgtgtgtgtgtgtctgaataggactttttggattgttttgtttgtttcggttctagagttaataattattgttgttttattgtttttgggattttgtgttgggtcacggctactcaccctgtgaactttgggttaataacttttcttttgtcataacgacaatgaccttaagatttaagaatgctataaaacataacttattacagtagatcattttgcaattagggtttctttggtttaatttgtgatttaaccactctttgaagatcttttaactgaaaatcaaacatacacttaatctcttaaagtaggattattaattttattatgtactacctctagacttaaaatccatgtatacatatatatatatatatataatatatatatatatatatatatatatatatatatatatataaaagacaaaactaaagaacagaaggcagcccataaatttctggactagtcatgataagtgagaaaacttatagtatatatagtagataaataggtcagaaagggtggctcatgcggaatgaccgaatgatgttaatattaagcactttcatattgtccatatttagataaactccttgctaaacatttataagtaaagaaaaaaaaacttaaaggaaattgctaacatactttcacttttttcaattggaataggttaacaataccaaaagttttggacaaaaaattagttttttgttttaataaatttctttaggaatattaaagtcatttagtatttattttatttataaaaaaaaaaactctttctctctctcatctgtcatatctctcatcgatctgttaccttacctctttgcatttcaccaaaaaatttcagacttcaacatttcgttaactctcaagagtttggttctaaaggtgacaggaacaccatcatcgactttgggggcacctttccgttcattcaatccgttaagtatttggttgcccaagaatttgagaacctgttggccaattacaatagaaccaaaaaaaaaaaaatagaatgaatgttaaatgactttaatatcccttaagtaatttattaaaacaaaaaaaatactttttttttccaaattttttggtgtagataacctactccaactgaaaaagtgtgagtattagtaattctcaaatttaaaatgtccatatacttattcaaaagcaaatttagaaacagtttttaagcattttcaatagactcttgttatttacaccctcatactccctttctacctcttaactattcatcatattatttttcttaaagaattacacattttttatttttggaaatgtatttctaaaattacatataccattttgaaaatgtatcttcggaattataattcataatatcaagatatactttgaaatatgtatatatttttaataaatatcacttaagaattaagatgattgatgagaaataaaaaaaatgattaatatttatcttatatccatatttgttagttttattttcattctatcattagttatctttaaatcttatctaaaatcttatttttcatcttatctttattatcctttaaattctaattttaaattatcttcactatatattcattatataataatgcgttttcatcattactatacaatattttgtatttttcttcatgtaaaaagcatttcaaggaaagttcatcactaacttcatgtgggactgaatcattgatatagacttgaattaaatgaatgcacttaaaggaaataaactattgtcaaaagctttgctttgtaattaaggtgtataaaatataaagttaatgatgattgtaccttgaaacatagtgccacatgaagaaaaatacaaaatattgtataatgatgatgaaaacccagtattatataataaatatatggtcaagatagtttagaattagggtttcaagaataataaagataagatgaaaataagattttagataggatttgaagagtactgatgataggatgaaaataatactaacaaatatggatataagataaatatttatcatttttttatttatcatcaatcatcttaattcttaagtgatattttattaaaaatatatacatattttagagtatatttctagaactatgaattatagttctcaaatacattttcaaaatatgtatatatacttctagaaatacatttccagaaaacaaaaagggtgtatttctttaagaaaagggtataatgaataattgggaggtagaaagggagcatggggtgtacttagaaatatgaagtgtaaataataagagcctttaatattagaattttatttcatgaatcttgttaacttttaacgtgatccagatccagaagcataacaaattggacccataggctcggttggtgctaatcaaacgatgcgttttgcggtgttaacgaaagagaaagacaatgaaggaggtagagcaagtgcagttttgttttattggttgagaagagaaaagaagagaataatgtcgtcagagaaggaaacagagagtcggaagttgggttcggaagaaatttcgcgcgagttcaaaaccctagtcagctccaatgatctccactcccttaaccacatgcaacacaccatgtgcgtgtcacaatctccaattcaatttgtttgtaactttgtgtgttcgttaattgattgattgaaatgtgtttcagattgggaaggttgcaggacagcaatgcggtcttgtcgcatttcaatgacttctctcagcactgcttcgctgagatttccggcgacatcgctagaaacacgcgtgttttgaagtctgtcaagtctgaccttgattacatctttcagaaactcaggtattctttttcttttcatagccttggttactctccatgttagtaggtttgtgaaatatgggttccaacttttctatcattcttgtaaggctataaatatatatatgaccatattagttcatcaatataggccaagtttttactctttactattttgagtaactagcaagtgatattagagccccaatcaaaatggcctgattctttatagagacttggagagaatatggcaacaatagtggatttttgccaccagttattccaaagtttggtggactgattacttgagtatgctcatggagaattttctgcaatctaattgaggaaggagttcaacatagtgaagcacaaaagaaagccattgagggtgcaagagtgaaagatatgaaggcaaaaaattatctcttccgaagcaacggatcaatgctagagaccatttttgaacaatatatatctaaaagcatctaggacgcctggaagaaaaagaatcaagggacagtgcaagtatagtgttgggaatgtcaattgcaaatttccaaactttaattcaggtgagtggttttgagatataataaattgatgaggaaaaagtggtgactattttgtgtgtgtgatgataatttctaagggggttgagtattggaattgtaagaaatacttaatcggtgtttatccaaaaactcttcaaaagtcatttgccgccattataagagaaatccctgtgaagagaagagacaccaccttaagttgaagggggttcatatgaaggaccgaaaatcttaaatagaagagatgtgaagcaaagatgtgagaagatctcttgtgagtgagagtgttatcatcccttgtaactcttgagtgggagactcgcgtttgtagggtgataaactatttggggagggtattttcaaatttgccagaaaacttgtaatcttatttgagatggtgcatatttgttgagatgtttttgtggatgtaggcaggtggtgtcaaactattaaaattatgtgtctttcactatttctatcagtagtgtgttttttgtgtgtgatcctatagtcaatctttcttgctgcagtttcttgcacctgtcaaatcatttacataaggagaattttgaataattttaatcctgatcaaagtgatggcacaacaattttctatgacagttattcagcaattgagctttcaaaaagtctgtttttcatggccatagctagcacatagatgtcagatttcactttcttcgtgatctcacggggtggagttgtaaagttagtccactgtcatactcaagaacaatttgcgaatatagtgaccaagccattaaagcttgatttgcatgtaaagctttgaggtctttgaggagtatgtgttggtccaaatgtaaactgaatgatttgatattcagtttaagggaggatgttgaattgttaacatttgcattagtttgactttgaactagtctttagatattttagtgatttccttcttttagaaattagatattgacttccattttaatctcccattagtaggttttactgggctgcaactttatgttattcttgtacatctatatatatggttatattatttttatcaacatagctcaaatttatctctctcatattttgagcacctacatgtaaaaatgtcctaatttgaagatgatagttgagaagggagtaagaagcaagtggatgattttgttttatattttgaagaacttattcttatatgctatgttcaaagggtgttattgtgaagctaggttatcgatagcggccgtcgcgatcgcggatgacgtggccgcgatttggtttgtagacctaggtcgaaaatacgctcagtatttaaagggctgggttacgttcttgtgcgacttgccttgactacttttgtgcgaccttcgttcactcgacgtacctgctcggccagcagctcttccttctccggcggcactttgttctccttctccgtcgaggttttgttttcttactttctttctctccttctcatcggtgtctcacactctcaccgtctctttccttttgggttacctctgtttcttcttctttcttcttctttgtcttccttcccttgtcgttttcatgcctctgcctccgccatgctcaatcgagaaagagagaaatcgagaataagtcacgaggtctcacgggttgggagagaaagagtttttttataaataacattagtgtttttttttattgggcccccagattgcttcttgcactccctttattgcttactttactcttggttcatttttttttaattaaaaactggacttgtttttaatgccaactagggataatctattatttgttttatgattttccttttattatattttattaatatgaaatacactctatatataaaaacattagaatagcggtcatccgctatccgctatcccagtttgagggtggctgctccgctccgctatcgggattgataactatgttatgaaggagcatgtcagatataaaatcatttatgttgtgctccacctaacaacttaagcctttggttttcttgtgtttgaaaattaatagacagatattcatgtaactccttcattggtcatgctcctagggaattagcagtcattcttcttatcaacatatcacaggatgttttaatggagatgggcctgctgttccctctgtctaacagaagaagaaactggcttttcaagtcataatcaattctgcatatatttatttatttatttatcttcagttgtctgaaatgaactgtcactgtacacctatgttgattcctgctatttcctgaggttgatctacaggaaaccacgaatttctcctctaattggttctatctccatactccctgtatgggctttctctccggtctcaagcaaatcaagtttatcatatatatttgtctcacaaaaaagattagtttcttaaatttcaatgatgtcccaaataaatacattacaataatacataatttagttgaattgttatacttagtgttggaggctttggttgtgatcgcataggcataaagttttccacacttgttattgtctcctcatgtttttgttcatatggtgaatgcatttttgggtttcgacacttccatgtctctgtatctggttccacatttcgttttggacctggtctggcttgacaatagctagctgatgtattggtctaagatcaatcagcagctaggattttagacaaaaatgggtaaggctacttagtgtagagggaaatactttagtgtagtatgtacaggtgcaaagtgcaatgtgtctgcaactatgctttttatagatatctatcctgtcttcaagttcaataattaattaaatgcctgaaatataaaggttataattttaatagttctataaaatgaaaattcctaatattagtatacatatgccttattgacattatatgtacataaagactagatgattttcttttatgttttctcgctataatgcttcctataataagtgttttctctagtattgtgcacaaaaagcaatttctttttttttttctgtagtcaagccagaaacctttgagttgagcacctcgtgtctacagttggaacactttctgttctgcaggctatttagtcattattgatttgtgctcgtcttcagtaataaatagtaataaaaaaaatatcaaatgtaaaaatatagtttgggcctttggcacagtgctggggtttgtaaacaatctaaattgaagaagaggtaaaaattggaggaaaacctaggttggttattaaccatatgttgaagtattgatggcattggtaacaacaggaaatatggtgaaagagaagcaagtaaacagtaggagcgaagccaaaaaggcccaaagctcaattgtggcttcctaacaaatgaagagatggaaatgatgataactatggaattgggtcttgtgttatttgcttagatgcaccatttctctgtatgttacagcttataagtatcgagtatcctagctagattgctagtgtctacattttgacgttacaaattactaagttttaggtcttcacccgaaaaaaaaattacgaaattgaagattgccacatgtgataaacatgatagatgataaagtgaggcaacagtaaaagaaggattgaaagagcataaggtaactgtatataatgtaattaaacaaccacctatctgtgcatgctaccccccaaaccacacacacatttctattttttgtgggttcttattttcttattttatttactttacgaagtcttgcattaaaagcttggttaaccctctcttgcagaagtatgaaatcaaaaattatggcaacttatcccgacgcttttcctgaagactcaacgagcgaagtgattgataggagaccggatcttgaaatgcccaagtaactaatgttattagaacacagattagaaagagttatatgagagtttgtttttggtttttcttctactcttgtgataaacttgtcctatttgtcttaaacgttttaccagagcttcttgcccttaattaaattctctaaacttttgtctatacacttttatactgacagtaaatgcattacgcacaaatgataaaatattttcagatagaactttggttttgttatgggtgactatggaaatacgggtggcggtggtgcaactcgtgcggttcactaaaaaagatgagcaaaacgactgaaaaaagaacgagaaaccctcggtcaacattatcatttttaatctctgaaattataaaagaatctaaattttggaaattattaaattatctaaatcgcgactgtcttatggattaatatgatcaacaaattttaatttcattagttctgtatttccgagatgagaaatactagtgacagtctaacattctttcaaatactcttttataattagttaaaatttattgaaaatttaatgattatttctcctaatttatattaaataaaaaatgaaacttaccaaaattgataacttttaataaattttaaccaatcatcgagagagtcttcaaggaaaagtgtcactagcattcatcttgttgagattactattatctttgattctatatataaaaaacatcaaacaaatcattaagatcaagaaaagtaaggtcccatttaatgtcatcataaatttaaattatattacaaaaatacccttaaatttaaatgtgatattcacatttaatgccaatactcataatccaatgaataagtaactaaaaaattttaaaactaatcattatttcttataactagtaacaaaagaaaaacacaattcgtttcctaaaaagtagttatatattcacaattcagatactaaaatagtaattagtttgtgggggtcaagtgaggtggtttgataatacgtttgagtggagaattggggagggtagaaatttaagattttggaaggacacgtggtgtgagggtgggtgtctaaaaaacttgtttcctagaatctttgttaattccgaacaaggagaagctaccataaaaaaatatgaggaggttggagtatggtaggtgagggtggatcttatttggcggagggagtggtttgagtggagaaggccttggtggaagaaatgtatagattggtggatggtgtcaccatttcgggacatggagatgatgcttgaatttgggtggaagattagttcaaattcattcactgtgagatccacctatgagctttacatagattaagagattaaggttttgttggagttaggagaggaaggaaagaaagagatttaagggaagggagggaaggaaaatgagggaagttctttcctccttgtttgagagttaaaaatatattaagagagggaaatggagagttgataagatagatacttttacaattttgtccatacttcaaaaattaatacactctatatttacaaataaaacttaattttaaatttgtagctggataggatagtaatttattgcttttccttctaaaaccccaaattggggaacaacaattttaatgatttggaggattcagaggagttttaaaatcctcaaatcttttcctcaaaaattaaaactctcaaacaaggagatgtcaccacctaaacctttcccttccctccttccctctaaatctctctccaaacaacctaagagttggagccaagagaaggacatctttatgagcctatgtaagatcaaagtgccaccatagttatccttttttatttggtgggtcttcctaaataggcttccttctaaggatatctcattaagagaagcattgatcttgaggatgataatggttcctgccccctctgtcacgaattggtcaagaacatttaaatcttttattctcttgtcctgttgcatacaatatcggtacaatgtgctaggggcactctcaccaaaacagccttgatttgattggtaacaaggctagtagtgggcaacaggttggagtgtcatcgtttggaacttatggcaacaaggttatgttatgttgtttgaaggaaaaccttttgataaggagcaactatggcacaaaatcatgttttctatgtggacttggttgaagtcataccacagagattttggtgcttcattccagcagtgacagtgcaatccctcggcgtgcttgttatgaggagtgatggactttctgtatgatgtgtggctgattgatacctaaggctcgtatcttcccgtatgcaggttctgtgtaaactaagattcgacctcttttggttagataggcggcagacatcttctggtttctttacagctattgtttcataggcctcaatttttgaggatcccgatgtgtaatctttgcacactttcttgtgcagttaatgatgtcatttgcttaaaaaaaatattaaaatagtaatttactcatttaataaattaaatatattaaatacaccgagactaacgagaagtcatcaagacaagaatgaaaatgtctttatagggtagcttcctacgtctgatacaactagtcaactgttactttacagttttaccgcatgtattctagctatgcaacatttttttcgacaatggtggaaacaagccatgaatgaatttaacgcttcaggatgccacaattaatcaaaaagcttgctagattaaaaaaaaaaaaaagacggacatgtagtgtagtaacataataaggccaatcagtaacaaatgtgattgatttaattgaactgtggtgttaataaaactaaagaactaaatctgagatactagctaaaattgacggtgaaaaaaatcttaaaagagcaggaaggactactagaacaaaaacaatattgtgacctacttcatagccagaaaacaccctattacataacagattgtccacaaatataaatctttttccagtatgcccaagtcaatcatcggatagaaaataaacagagactaaattaaaacgaaaactcaaaaacttaaaagccaactatatttcagtatttcccaccttgcttctacccctgttgaaagtaacaaagtaagctgctctgcaacaaagtagatctaaatgtacaagacaggaaacgaccaaccaagtaaataaaaagaaagaaaaaaggcaaagtgaaggataaacccgaacaaaaaccaaaagatataagcatcttaggcagaaaaccctaaaaaacccaaaaaccctaggagtaaaccctgttaggagctaaccactgtaaacaaaacccaatgagaagggattggtgctagcattctatgaactaactccgcccagccaatctcaatatacagatctttatcttcactaggcaaccaatcacactatcttcagactgcaagagaaggcaagacaaatcaaatcaggcggtaccaaattgctgataaatatacttctaagaaccaatatatgccactgaagtgggttggaccgcctccttcgaacacattagagcttagacaccattagaaacaaccccattggctacaatcttactctcgggaacaactggtttagcaccctttggggcatctccagtttttgtagcagatccattctcgggaactttgtggtcatcactatccttctcagcaagggtagactccttgagcaattccgagctaacttcagatttttgagtattaacttccccatttatctcaattttctcatcagcaggtttcccttcccatacctgcatcagtagagtaaggtaacaaaaatacatcatcagcacacacaatcaattatttcacttaattagaataattgaaatgtgacttgcctgctttgggaattgttgctttgctttcttctccaaaatagttttctgacgggcctcatagaagccaaaatcatccagaatgcatgtcttgctggtatattccttgaaaattttaattaatttcagcccaggctccaacattacctgcaaacataaacttggttgatcagattaaaaacaaaactacattacaaagaactgacaactacaagtgcagaaccaaattacctcttgtgtatccctactgttagtgacaggtttgttctcattgttgtccaaggtaatgtgcctcaacaaattgttaggaacatccttaacaatgtgccacttaagaggaaagcaaccattccacttgtcttgctgccaatactcaacactcttgttaaaatcaacaggaccaaccatctcagcaagccccacaaattgcccactggtattaacctgcataggcacataacacattagctatatataaccaaaactgcaaataagagtaatgacttccatcattcacagagatacttactgagaaaaagagaaaaacaggggcgccaccaggtttctgctgtgcctcctgatatgcagcatcaagcttcttgttgccattttgtgtactagcccacacattatacttaatactcttatggatatcatcctcgctgtaagacttgatgacaaaaaatttggcatcagtatattcttctggaaaatcagctttgttatattgatcaaattccagaatggtatagtcttgtctttctcttcatctgtgcctaaacttgcaggcaaattctgcctttgactgccaaaatagttggtgcaaaacctttttggttttgccacccttggccctaggccctctgttcagttcgttcaaaccatctacgttctcattgccatagccaaagtagccaccacttcttcccctagttttgtatttactgtcaacagctaaccaagcccgtccattagtgcgagaatcatacccatgtgtaccataacccattccagatctgacgtgttcccatattgaccatatagtttgtttgggtaatcctatttatgaagctatgggtggctcccatggcaggcattggtcttgggtggtgcaacccctgacaccaaaaaaacaaattgtgaataaataatcataacagcagtctagatagaaacatgacagtatggcacactaagctctattagaacagcacagatggaccaagcaaccaattattaggactttacggccatcaaatttaacaaatagaacaaagtaaaaccagacacttcaaaataggatacataccataaactgagaattagggcggaaagtctggttccttgaggcagcgttgttgccacctgatattgaagaagtgatggttgtgctacttacaggccttggctgcccatctgaaaataatggggcatctagccaggggataggtgagcgtactccatcaaaaccaaatcttggatcctgataacctgaagttggccacgacctggcatagcaaccctttcatttgatatttggaactaaaagatgaattctgattgacctgtttaatagaagcagcagcattattacctttcgcgttgccaccatttgcaacaccattagaatttccattggctgcatcaacagggagaggcttttgatcagcagctacagaggtggaaacctcaccctgaggtaggacagcaggagtaggtgtgaatggcgcactggttggtgttaacggttggaaatatggagggtactgatagtgctgaggcccatacaactgaccatcattccccatggttggaactggagaccctgctggcgaataggggccatagggcgcatatccatatccatggtgataaagtagagacccattatccccataaactccctgcaaatgttaaaatatattaatgtaaataaaacatttgcagcagaatgaaaaagcctgcacaataattttggaaaatgagaaggaaaaaaatacttaccgaagtcatctcaactccttccgaattcacatatctagaataatcatcccactcgttaccagttccatcatatcctataataaacaaaaccatgtcagcttgaataagatttacgtgtttcgttttcagaatttttcaaaaggtatttcatgtcgtttttcagaagcacttatccataaacttaccaccgtaataataggcagtagatgggtaaccatttgggaggtaacacatagtaggatcaataaaatcctgcaacacgggggttacagaccggtcatacgactggatctggccattcgcagcatttcctgaatcaactgatccatactgattcccagtggcctgcacaattgaacaaatccactcaataccacacaattcactaaaagaacacaaaaccaggtacaaatacatctcgctgaacattccaaatttataccactaacacaacagagtgaaatcgtgaattttcaatagcagccataaaaaatacaagcttttaccttcttggtaggctctggaatctccaagggcttgggctgtgtttctaacgatagcttctgtagcaaatcagttgcttctgtgcaaacagcagtaaaggaacacaaaacatctcgaaaaattgaacttttcaacaaccagaaaacctaaaacccgcaacacacaaataaaaattcaaaaaacctaaaaaaaaccaacaccccgcaatcccaaacgagtgaatcagccataaagtcaacaccgtcaaaaactcaagcagattaacaagaacacgagaacagaaaaaacccaacacccgaacatcataaatcagcaagctacccaactaacactaaaagatcaccctaccccgaacccaaaaatcaagtttcagaaacgaaaatccaccggatccaataaacgattcaatacagcagaccaataaaagacaaacacgagagaaactgcacagcagagaaggatacgatccgcgggattagcaacggtggccatgacgaaccaaccacgagatctggtttttctttggaggaggaatagagaaacggaagccctaaatccgaatctgaatcggagagggtttaagcctcaaatcgaaaagttgagaaaaccctaaaaggagcgaagaagagagggaaagagaaaaaaaaagaaaagagagagaagagagaacacaacgggtctcgcagccgccaagggtttgggtttttggggagagagggttttgttcctccaaaagcagtgattcaaatagcaccaccacctctctttaggcactctcgctctctcactcgcgggtcactctgtgatctcattcgccttctcccattggtggatccagccacgtggcgcctctccaccggactttttctttgtaaattatttctacggttggtctgtcgtgcttgtttctttaaggtggtgggtgatgttagtgagaccccttgtgaatcttgtagatgcggggtttgggcaaaagatggaaaccctaattagaaaatgacacggatgtcctcgtccagctggacttgttgtaacccttcttcgatttttttctttgggcaccttctgtcatgtgctccaccacacacacatatcgtgttcaaattcatttccagtttatcagaagaaaaaataaacaaataataattaattatatatttaaattttatacgttattatgcgtttcaattaatatttttaataatagaattcaattattataaagataatttggattttagctttaagaatgttggcaaattttatctacgttagattaatcgttttaaatttgaaataatatataaaatgtttattattattaaataagtaccttcgatattaagatacgacattttcaaactatttgttggtcaagatggggaagataaagataggaccaccgcttacattgttttgattaaatatatctattgtttgataaatcaataagataaaaaatatttttctttgccgtaaaaaacacaaatttattttattttatttattagatcaaatgtttaaatttattgaataaaaagtttgtcttatcttaaaaatagaatagaaaaaagtttgaattacaatttcagtccctattttcacaaattggcattttgattctcttgatttttatttagacatttaatccctctaatttcataaattcacgattttgattcttctatcaattgacaccattacatgctcaccattaatccttatgttgacacgcttactctgaaacacgtttgaagtgcaagcattttctttcccatacatgtatcgatcattgcttcaatttcacttaaacataacaaacaaacttgtatgtgcgagtactcttctgattttgatagagaatctttagttttaacgaacatggtataggtataagtaacatccaatttttttaaataggattgggcatgggtatgtacctacctgtccctacccatacccatatccgacaatataattactaaattacccttaatgtagtattgtgtataatacacaattaattttattaaacttttatacttactaatcattgtctatttttttaagactaaaactaaaactcttaagcaaatataagtcataagggattacaatctctctcaagtaggcatggcatcttgacccgcatccgtggcatccatccgaatccgcctcgatgtcaacggggaaaactgagttgaccgatttcgggttcgaattcgggttcgggttcgatttttcctcacctgttgaattcggggcggggaggtttggtaatgttgataaccaccccccccgccccgccatgctatatttaattatttacaaaatacctttatatatgtggaacaccttggaataaaggcttaattttattcaagaattaggagtataactaattttattttccagcaataaacatctaatgttgaaatttattgtaattacatacaattgggacttagcgcgatcaaatttttgctatggttgttgtttaaattaattttttaatagcaatttttaagtgttcggggtggggcggggcgggggaattttttagcccatcggttttcggaggcggggcgggggtggttttgagggcggggcggggtggtataagtaaaaaccgccccgactcgctccgttgccatgcctactctcaagtctcatgtttcaagacaattttaggtgatgatgactaccaagacatgattgtttggattagatcgttttcggattgcaaacttcaagactccatggattgttgtttgaaacttaaacagaaaaatggaaaagatgaagaaatgatggtgaatgccgtcacgatccgtaacgaagcgataagtcggaggaggattgtcacaaaggaaagcttccttgataagaatcaatttggtttcattcaagaatcaacaggagactaagctctcaatgcaagcaaaatgcttaatttcattaatcaaagttgtccaaaaatagcatagtctgagtagttatatagctaagcctttaatgatcgcctaaaaacgtaagttaggcctattttggtaatattaaacccattacaaaaataaataaaattacgaaagtcctcgcagaggtggcgcgctgagcgagacaagtggcgcactaagcgagcagaggtgtgctaagcctaaaagctctcgatcaggaattgggctgagcgagccaaaggcgcgttgagcgagcagaggtggcttgctgagtgagcaaaggtggcgcgttgagcgagtagaggcgcgctaagcctaaaagctctcgatcaggaattaggtgagcgagccagtggcgcgctgagcgagcagaggtggcgtgctaagcaagaagaggcgcgctaagagagctcacccataatcttcaaggtgcttcaattcagctctttgtgtcttccttcattcttgcccttgttaactagtccagctatgattctcttggtcatcttttcttgaagaagcttggctttgaccttgtcattggacccttcaattcatggagtgcttctagaacttcataatcttggatagtcctctattaggtgataagaatatgattttcatggattttttttattgtgataggattttatattgggtgatggcaagttgattgtctaagcttgactccttgaataataatatatttagttttgtttaaaaaattaaaattatttttatgattttttgtatttttttaaattattaggtagggacggtattgggcgggtatacccaatccccaatgaagactgtgataaggaaaaaattcatacccatcgaagagggaaaggaatcacatattcatccttccccgtctcgttgccatgctaatctcaccactcaacaccaacaaaaatattaaccaaacttacccttctctttgtaacaatatcaaattctcactatatactcccattgattttctaccactttttctcctttgttaaaaaataaaacagtgtgttcccattccctaatccctacatcgtgcccatgtcccttaccataaaacataaaagaagagagcaaaatataaaaaaaaaatcattagtagatctaaaaaaaaaaaaagccatatcatatctaaaataaacaaataaaatagaaagataaattggagagagagaaaacaagaataaggtgatgcatggtcaaaatagtgtttcctatatctgtttttgtgtttcatgtatttggggagaatggggcttagaagaaaatcaagtggttgttgggatattcgcaatgagagtgaggttgaagagtgtgatgatgtgtgaggacgagttcaaaaatgttatgaggttcatcttcgcaaagtgtgcgctgacaataacgacggggagggtgaggatggttcaaaagcaaaagtaacaacaaagggtatggtgggaacattgattaagattgtggtttggttgtggtgttttgttttgtttgaattttgttgtttatgcccattcaaaaataggatttgttttgcatttctctaactcaggattgaatttggtgttgtgttcattaattcatcagtgtttttttatttgttttctgtctattgaagattgggatctaattttgtctcctgttaaaatgtaagattaggagcaaggtgaaaagaggaacacctgacattggggataggaatggttatggtaagagggatgatgttactcaacgttaaagtatagcggtcaatgactaattgacggaaaaaactaaaaaaatcatttttaaacattaagaggaccagtatataaaaatcaggaataaaattgtgaatttgggatattaagaggaccaaaattgcaatttagcttagataaaacatactttggtttggtgaccttataatacttatggttgatttgaaatttttgggtattgattacaataattatggaaaataaaagactaaattacacaaaactattatgaggtttgtaaaaaatatataacctctcttttattgttgagacattacttgtacccttttcattttaacattgtttaacctcatttacttattttctatatattcattgtgtccctttgaatcagtctatcactcttatttgtttccaagaacctcacaaactacaactattggacaacttatttagggttctaaagaaagggaaaattcatgcatttgttagtcgttgacaaaccaaatagcatggtgaacgggtgtaatgagctcgtgcacgatttgaaacaacgatgttaggttcgttcttgattttaaacaatggtgacgatatttgatcatgatttgaatcaggggtggtaaggttcgtgcataatttgaaaacaacaatggtggggttcatgcacaatttgaataatgatggtgaaaggggttgttgcggcaaagtctaagctttcaaacaacaaaaaaggtgaaaataaaacaaaaaagagtgtaaagcaaaacataaaagattagaggttgcataccgaagcaccaaaaccatgaatgttaacaaattattggttggaacgggttaaccaattatttcaacaagttcctatagtcttcatatgcagaagagtcactatcttatattgtttttttcttttttacattaagatattataggttgaagaaaagggtatttgggagatgttatttcaattaaggtcatgtgacaacaccattttctcatttactaacaacttaaatggagatagtggcttagggatcataatatacactcttaaaataactttcacatggtgcataaggaatttaacttacacatcgtagcctccatccataaaacatatttatacatgatttattggttatcatatgacacaattcaagagtgtaaattatgattgatcattcaatacattaaaagtaaatgcaagggaaaacagcggagcaaagttttggtaaaataaaataaaagtatattttcatattcaagatggttatgcttggagttttataatatcttttaagagagaactatttctcagtttttttttttcaaaaaactatttctagcatcctcttcaaaagatatgagcagaaaaaatatatatatatatcaaaaagggaaacttaattgaattgaaaatgtttttgaaaaaatataaaagggaggtatatatatcattgcatgtatagcgcaaaaatgctcaagttcaatttgggttgttaaacaagctcaaacttataaaagtacaattgttgagcttttaacgacttttgtggcttggcttgtattaagatgtgattgtctaggaataaaaggttagtgttttatttatttataagctagaaattttgggtcaaaccttagcttttcatccaccatgttcggaccgacttaattgatctaacccattccccccttttaaatatgagtatttatgaaccaacccaattcaataagaatcaagaaaattgattcaaaaaattgaaaataaaataaataaataaaacaaacgaatcaaaaaatcaaaaaatcaaaattttattggattggataaaattttagatttaatttcaaaagtcattcaattcaaaccaaatggaacttgttgtacccatatatatttattcataattgataatatcactcatgtttatattttatttttattatttgtaaaattattacataacttatacatatttataaaaaaatatttaattgaagatcactttttactaattttttgaattaagatgcttaaatatagttatataatgacatataaataaaataattaaattagaagaagccatagacgatatcaaaggaggtggggacagtgaagttgttgtggttggcgaaggtgacaaagttgatgagggaggtgaggagtgagttgacggtgtcttcgtaggcaaaatccaacgtgagctttggcggggagcagacttgggcaagagtgataggcacagttaataaatgatgattatttaggggagataaaagaaatataattttaggagggtgcaagtgtaataaacgttaaatttagggcatgagtataatttgctctttaaattaatattttctcaaaaaaataaaagtatgactaaaattgaaaatctatctgatcactccaactgtttaaattgaattggattaaagttttgaacaaaataattggataataaattaaacaaattcaaagtgactgaattgaatgatattttcgttcaaaatcatacaatccataaatagtcatacttctaaataaaaatgtggattttaatttacgaatccaattatactactcaattaatattagacagccttaacttaacagggacagttttcttaaattcactaaatcattagaagttccgatcgaacatctaattcttattgcaaataataatataacatatacacatacaaaatctcaaactttagtttcaccaaggtgaaggtgaaaaggaggagggggaggttacaaacactccaaacctgttgatcagtccgataaatttgggtttgttcctccacagtaacacttggatcctccattaaaccgtaatttgtcatggcaccatggcaatctttaccaacatcgcgcacaaggttgcggcaacaattttgctcttttccggtgttagagaatatcttctggagcatttggtcgccacagtttgaacgtaacttgtgcgtgcaattgatcatatgatccgcataaggttggagacttggagtattggaaatcctccttcatgtccagcgcagatgtctttcaagatatctggctaataaagtggcaattaccgcaaacagaaccattattaggcaaaacttgttaagggtccacgccgtgaccactgtttatttagatgaaatctgattattgtggggtgtgatgaaaagctttgttggtataggagctgaatatgtagtaagacctatttacagttacaaaaaatgaagtttaatttcaagattcgtattaatggatttttgctcaagtctaatgaaacaaacaaaataatttgatcattaattactgttatagttaagttaataaatggaaacctttgctttagcattcattacgtgctttttattcccccagtaacgaaggacttgtttagagtggcagttaagtttatttttttttaaaacaaaacattttggttgagtcgaaaaaattgagacatcaaagttatatataatttaaatcactagtaacttaagtccttagtttttaaataactttattttatttttataatttgattataatagaaatatagtcaatataaaagtttagattgaattaaaaacggtcttaattaaaataaattatttctgtaaattgcaggcacatttattataattcaatagttatacatagttaagttatgcatgattattcctcaacaaacagtcccacctcaagatcttgaatttgctcaatacgtgggtcctcaaacttaaaccttcgaaccaccattctctctcgatcttcctgcttgcaagaaaatccagatgacagtccaaccacatatttataagattttaaacaacgtttggtatactccagttcagccaacaataccttatttgaatccttgatatttaacaaggcttgagactggagattcagacttggcaccctctgttgccacaactctcttttgagatgatgaaacaaatagttagaaatcaaaacaaatgtaaaagaacttaaccaaagaaaaatcaacatgcagaagatacagctctatttccatgttttgaaacaccattggcagttgatttcccagccttagctttcgatgttgcaccctttgaaactgctctaccataaattcctcaagtggtcacttcatccatagaaaaagacattgaactcttgcaatttatacaccaatgcaaaaacactacccaattcaacaaaataacacagatgtacttttttttttaacaagtttcgttttcaaagatatatatcactaggcacaagtatttttcaagcacattggaaaccagaaagatggagttctacagtgtatggcattactagaatcttataaccagtagctagtgtatttaatgcagctttcctagtttcaccatccagttctgcagtcaaatttgcaacaatttgcaatgactttagctgccactaatctgtccacataatgcaaggagtaactattcaaggaaaatactgaataggaaaaagaaatcattaaaaagcattagtaacattacctctgcaccatgatgatcaataataaatccaacaagatcggcacattcaattcgagttcggttattctttgagcgcaaaccctgtaatatataagggaaacatttagacgcagaatatatggcaacaaattgttttgtcagctccagcattttttctcgtacttctcaatgttatgccctaactgcaacattaaaataagaaatgaattgtgacttactcatctgtaacaccctaggaagtacactagtcaaacctagtatctatgtaaaccaaaaatttgctgaaatcaactataccatcagaaagattcactggaataacaacatcctcaggtgtcacaaatactaaagttgctaatataaaccttctctactaagcacggaagaaacactaccccttcagaatcggtcaaagagtacccctcgtccttcaaagtgtcaagcagttcaggaagaaattccagcacctaagcaattaagaaaagataagactctatcgagtaagtatactcctataaattaaattgaataaagttaagactaacagccgacatctccatgacaaggaaggaaaggaaaagaagaaaactgaaatcacaacaaaaccaaaaataaattgaaccttcaatagacatgttgtgtttgatttgcagaactgcaacacaaagcacctcagaagaatgtccaatacttctacaacttccttagcaatggatggaagtgcctgaaatgtgcaatagcagtttgtataagttctagtgcactcaacacttcaaaagaatgtaattcacaaggttaaaagaacaccttcaaaagttctagccgatgtagacagcgtactgatgatttgaaggttaaatcctccaccagcctacctatcacctcatttacctacatgctcccccccaaatgtaaattaaaaaagtcacaacagacagaagactaccaaccttctagacgctccttccacacagcactttttaagagtgatagtatccgactgtataagagaacctattcggctttcaatctctttaagactcatctcagtaggctgcataatgttagataaacaaaaattgtatgataagttattacagaaactgtgtcggaagattcagatcagggagaagacaaacagatatcaatttaactcaacatccttaggtggttcaactgattttgaagccttcacttgtggaactccacctgttttttttgtttgtccctgactttacaatccccccttttcttagcaacaggcttgaatgtgcaaattattgagcatatctactcgcatgcatataaaataataccatgttaattttacaagcaagaagatgcaatcttacaactgactgaacaggtctctttccactatgcatgcctgctgctgaccttttgacaagtacactttcagaggtctgtatgcaaatcaagttaaaagtaaatgccagtctccaatatatgctttcaactttaaaattaaaacattcataaattttattatatccatctttaacatggttctcaaattcctgtctaaaatccattagcaatttagcattcatattcccatttgatattaaagcaaagcttgggctcacattttcttttcataccaagagttctgtctctattgctcacaatcctgtgttccatagctgcaccaagcatatggaaataaatgttctttgttcgggagaaaattctggccaagcagctatccattgtgcatattcctgccctggatcaatggactgatgttctcaccaaacctctctctactaccagatttaactttctcaaaagcaaactcaatgtaaaaagtttttcttctgaaaacttttccccttgagtttgaggggggatattagaatatgtaagcgctgttagcagatagtattttgctaactgtacctctctttgtataagtgttagtttctgttattgacagttagtttttattctgtcagtatcagatcaagaggttataaataactcagttttactaagcttcaattaacttttcataataagagaacaatattcagagttactttctgttttctcttttctcttcttttcattctgttcaacaggaaaggaagaccaaagaaagaaaggaaaacttgggagagaacttccaaactacatatagtccaacaaaaataaccagtcaactctaggtgcaacacataaagaaatgaaactgaagattagtcaaactaaactaaagaaaagaaaattaaacccacctctgcagaagatgcacttacacgtgtattttacacagaagctggaacatcattatcaagtgtcagcataaaagaatcaaatttacacatttaaaattaataaaatcactatatagagagccaatcaaactaggaattttgaaacataagcaagatttgggaaatttcaaacagtgtaactgaccatttgagtgttgcccagcatatttatagaaatttaatgtctggttgaggcataactcgaaaagcaattatcagcatggcagtaggaatttattatgtgattatcatggtcacttttaatgggtcatatccaaatcaatggaattcttttaccaataattattataatcaatggtcaatctgatccaattttaaataggttggtgccaaaatagagaaacagcatatgttcaaagacattggcacatacactagtaaacccaactttgaaaagcatataaggttgttaacatttaagaaggcaggtgaagttcaacccaactgcaaaagtcaaccccctaatttgagaaaggaatcagccacgtgcatcacagattgaaatagttaaagatgttcaaagacatgggcacatacactagtaaccctaaatttgaaaagcatatacggttgtaaaaggtttcagaattgaaaaagagaaaaaatcttcaacttcagaaatgaaatatttttgtattaactatcccaactgaaaagtagttacacctgtagtatttatactagagctacgtgtgctgtttacaactgtcataactgacagagcagctgtcaactaacctaaggttgttttttttatcagcaaaaataattatattaataaaaatatagtagcatcagtacaagtagtactactaagattacattttcagaatgcaaacctgcagaagaagcaccaggcacagcatcttcagatcctgaaatcatttccgaaagctcatttcttctaacatcatcaagtttctccaactacctctccagaggtctcatgccaactgactataacagagtgaacaatatgatgctcaaaatctcaaacagcaaaagcacattcacaagcacgcaaacagatgtagttgtaacaagttttaccttagctattcctgccaatactgaaaaggcagcatccctgacttcaggaataccgtcatttaggcactgcaatatccaaattttagcattttaaaaaggtgaataaataagtacaaatcaaacatcgacagtgtactttaaaaaaaaacaattgaaataaattgaatcctataataaactacagctcagaacttgaagactatacatgaaacaaataaacacgactgtaaccgaacagtttattacatcaagttcagagtagtcctactcctacaccaaggatagaagggggtcaaactgatatttaaataaaaagagctaaagctgctgaaccaaataaaagccagagattctaaatcacttttaaattccagcaggaaaataagagcattttactaaacaaattaaacggcaagaacaaactgacctacatacagattggcacatattccttgtgcaccttcgtaataaaacccttgttacttgtttgaatacaaaaagtcacccaggtcaaggttaacgatcgcacaagatggactttgtttttggtggctgtcttaacatctgcaacagattaaatgtaatacactcaacaagaagcaaacataaaaaactattgagaaagaatgataccttaaatagtgaggttaaaagaacaacaccttctgcagcatttcaagtccatcaacttgcttcttaaaatctgcacttaagagtcgcctatgtaaatcctctctgaaatacttcatcctatcattctgcaaattgcaggcacatttattataattcattagttatacatagttcaagttatgcatgattattcctcaacaaacagtcccacctcaagatcttgaatttgctcaatgcgtgggtcctcaaacttaaaccttcaaaccaccattctctctcgaccttcctgcttgttagaaaatccaaatgacagtccaaccacatatttataagattttaaacaatgcttggtataattgcgaggacgataactggacagcaactaatcctccaatgctctgcaacgacaattctgtagtttgaaagcgataatagctctcgattgattattatacatattctcatctaaacccacctgtatcgaaaattatatgaccgccacgtgctgtatgccacggcatcatgggaataatgtcttcaaaatctgactttatcaaggaattttttctctttacctttacagaggttcaagagacccacttttcaatctttccatccacgtttgaagcccggacaatgttttctcatccataggaagtacctcaccgtgcattgtattctcagtaccaacatgctctgatgcatgaggaatctgactaggaggaggaagtccctgattgaagttgtcatttgcacttgttaagtgcctgccaccagatactgtactaccagcagcagctgctaattgcatgcctcttcatcctctctctgtttgcatccaatgttccactggtagttcatatgcaacttctccaagtcaacattctttcttttaaaattaaaaatagattcaaaacaaatagaattatgttaccgtacctcctgtcataaatctatcatttctttggtcacctattgtgtagtcagaatttaatgctctagaagtaatgacaatcacagccctattctcctcattgtatgaggatgggggttaaaatttgttggctcaggtttgacatttaatttagcatcaccgaatggatttgcgtttacaggtgagaggtgaaaaatcaggggaagatatatttaaagatgctggtggaggggttggcatcggtaaactcaaaggggttcttccagctgcagcattcttctccatctgccaaaatgttaatatcaattgccaattgtcaaatactcaattctactactctaaatcgctggtacaaatacaaaatgcaaattcaattaagaacatgtggtaatacaagtaaattaactaaacctgatctctaatgtaggtgcgaaatgcctcactagcattttgaagctgagcaaatatgtcaacctgagataaagcaccagaaccttaatcaattgagcaaaaatgatataggcttaaggttttattaaaatcataacattacatcttatccaaatattaacatgaaacttgaaataggtgtgtttgtgtttggtacggtggaactcaaggaaggagagaaaattttgaaaataaaattttgatttctgtttctagtagtcaaattttctctcccttttcctttcactttcttaccaacgaaacaagaaaatgcatagcaatgtgtttcctttcttctttattttcttttcccccaatcgaatataccattaatacttatctttgggtacaattgggtaatctgatatagttcatatagatcaattgtgcaagtttgcttctcccgaatcttcttaaatatagcagccagctctggctgcaatttaattttaaggataggaacagagtcaagggtaaatagcctttgaatttgcagtaaaataggatattagggaagaataacacaaataaaaacataatataaattagaaatattgacatatatatcaattgttattaggatcgcaaatcaaatcgtaggatcgtaagatcctaagtttagccacttctgcgctgactgctcatgggatcattggtgagtgagattagcgtatagttaatgggatcatctgcaacccaaagttcagtctagtgatgccaactgcaaccaacccacctccagcctgcgccccaccaactgcgtctcttctttggctcaacgaagtgcaaactgcaaacaactggctctacttatgtttttttgaaaatgttatgaacttaagttgagtagtgtgttttcgaaatactgtatttggatcttatgacttattgtgatttgatttttcaataagtttgtttaacgttgtgaattagaggttattttctttcttgtgttgtttttttatgcatgtgtgtatataattttgaattttaggtagtaggatcttacgatctaagtcatgaccctttgtagaaacttgagtttaacaacaattgatatatctttagtgcccaccaaaatactgagaaatagagcataatgattgagcatcagccgaaagggtgccccaggctgaattattggttgctgaatctccccattggttttgtctcccaggtccagatgcagtcaacattcttgcagcagccaaagtctaaaatacaaaagtgagaataaatacagtataaataagtctactcctacctcaaaataagttaatttgtttgaatttatacctcaagattaagttcaatgtaggcaaggatgatgggttgaggtttagcatcgataggaaccattgaaagatgaccctttattgctgcaccacaaagcttgacaagttcatgcagaacagtttttaccattcgtaaaggtttgtcatcagcaccagccctatacaacattagaaaataaaaagtggttctggctttattttataaggaaaaaaaagaagaagaaaaaagtagtaactctacccaacaaagttatataccttctcctaatttcctccattcccaagtcttgcaggtacaaatggatgctttgaagcatgcgatcaaggtcaacatcatagatagtactctaaagaacctgcagcacaaacaaatacatgttaataagattacaatgaataaaaggtatcaagacagaatttggcaattttaactctgcttcttcaccatgaaaaatagatcataatggatttgtatcttgaatatctaatagatatcagttatacattctggcccattatataatcatccactaaccaaaaataatataattcatcaaatccattaaatatttcagcaattgtgcaaacggtgagcaaatatgaaaaagtgtgcaagccatgaacagtggccttgaatttgagaatggaattcaatcaaaaagggagaggggagtgggatgagtaataagagagcagtttgttgcattgattgtgaactgaacaatcatccattcaataagcataaatcatacaaaaaatgaccaaaaggccacccatacctaaacacaattagatacataaattttagagtccagcacaaataatcaattagccctgtgatccagcaactattggtttatgggctatattacatccagaccgataatatttataaaaaaataatagttaagtttatctttatctcatatccctctagattttactgatgactgcacaagttacctttgtaagcgtgataaggcatttcacaactagatcggagaacttctgatttcttgaagcaagatttatgggctatattacgtccagtccaataatatttaaaaattaataaaatagttaattttatctttatcttatatctttcaagattttactgatggctgcacgagttacctttgtagcaatttcacaactagatcagagaacttctgatttctggaagcaagtgactcatttgatgctggtgaaggccacctggataaatctagtggccgcaaaagattgatcaagacaacaaaggatgaattcctatctgcattatcctgaattgacaaacactagttactaaaataggcccaaaattaatgaatttcacaataaaactttaaccatacctcaatattggaccagcaagagatctagtcatttctccactttgttttgtgacatcatacctgataatggaagcaataacataataacatattcactgttatctatattaaactttttatatttgataatctacacaaaaaacaaactcttcacctaagcaaaaagattttggaaaaaactattgtacaattcataagggaataatgcacaataaagattggtattataggttggcactaatgacaaatgtgtaactccaattttgattagtgaatagtactaaaacacctaaagaaatgcaccatagtattatgtatggattttggaggttcaacctccaggcttaatgacatcccataatatggccatcaaaacaagagaaattatagaggggaagaaagagaaggaaccaaaaaattattttcaacttatctgcaacaagtcactcaagtgacagattcgtcaagggattattaattaagaattgtaaaccacaaattgaacaatttattatatgcgtttaattctccaaattcgcacatccagacatctactaactggctcagcctttttttcaaaaattactttctttaactctattttcattacccctaaaaaattccatactataattcttaaatctcgacaatcacagcatagcttcccacaaaaccattcatgctcccatcatacttatttaaaaggcaaaattagcaaatatgctcacagtaaacaaatgcctaaaaaagggactcccgtcttgtttgttttcattttatagatgatgatcaggatcaaaagatcagagcacaaattagaaggaaatttttaaggcattaactgaaaagcataaaatacagaacaaattggaaagaaaagacacacccattttccctgaccgagcgccttaaaatgcccttgcttcaccaggctttccttgcttcttcttttccatctcccggacctagtaaattacacaaccaacatctcaagaattcagtatagcaaaaggagaaataaacaagtaaagtatgtactgaccttccacttgaatctatcatctaacatgctcttttaagcatcagttagcttcccaacatatttccatatgtcctcacctgcatagcaagtttatagaaggaaaataactatgccaggccaagaggtatgaagaaaagtaaccataatttagcacataaactcctcaagtggtcacttcatccatagaaaaggacattgaactcttgcaatttacacaccaatgcaaaaacactacccaattcaacaaaataacacagatgtacttttttttaaacaagtttccttttcaaagatatatatatatatatatatatatatatatatatcactaggcacaagtattttttcaagcacattgggtgtagtgtgtgtttttggggggtggaaaaaataattgtcttgagtgggaattactgtaggagacagtggtctcttgggaattaggaattcatctctcctaattctttctactgaattgtaaaagctattcttggaaggaataaagattcagcgtattattcagaactttctgtgtttgtttgaagattcaagaacttctatttcttggttcataccaaaccacatattcataagattttaaacaacttttggtatactccagttcagccaaccataccttatttgaatccttgatatttaacaaggcttgagactgatcttgaaaatatattgattcagacttggcaccctctgttgccacaactctcttttgagatgatgaaacaaatagttagaaatcaaaacaaatttaaatgtacttaaaagtacttaatcaaagaaacatcaacatacagcagatatagctctatttccatggtttaaaacaccattggcagttgatttaccagcctttgcttttgatgttgcacccactgaaactgctctacctgactcaaatgactctaaagaccgaaaaaaggaggagtaagggaagatatataagcaccaattcaccaacattcgcaaagaagaatgaaccaaagaacgtgccttgaaaagctccgtatgggtttaacttctcaacaattagtgtcggtgctggtccatgaatgtctttaatcatctttttaatctaaaaataagtaaacaatgaagatgcttgatattacaagaatattaaggaaacaagggaagaaagcagcattcttcttatacacataccatttcatgtctactagctctcagtatctcattaatacaagctctgatgccttgcgaacatcggaatatttatcctaagaagaactcatcatacattttgttccaagaatatggaacattagaactaattcgataaatggtataaaaaatgaaaaagcagaatgcagagtaaccagatcatactgtcattgcagaagaggaaggcttcagcagttgtgcagcttcagcaaaactacttaacccagaaagttgcctcgataaccaataaaaatttttttacgtccttctgcaccaagtttagagtccatcaaagcaattgcaatatatggaacctacaggaaaaccatgcaaaggacacagataccaagacaaaagaatgaaagaacacaggaccagcacagaacacagaccatttcaaccagatggacagcagccagccaagcgtctaatgtattcagcacacgttctctcatgtgcttcttgttgtcaccaagacatttcaatatatcaaacagaataccctgcaacaaaccatttccagaaatgttcaaacagaaaacaacaccaaatggggggggggggaatacgaaaacagaacagaatccacttaccttgcttgccttctctacagcttgacccattgctgatgcaacattgccaattgctgtcaaggaagccatgacaatgtttttgttgctattaacaagtcgtcccctaagaccctaaacaacttacctggtaataaaacagttaggaaaaattaacaaaataatcagctagaaatctagaataattaccaaaagataccaagcaacttatccatttggggaggaagttgatgaaagaggagagtaaagagaaagagagagagcataaggttaaaaaaattataaaaaaaatgctaatggagtgccatttccagttgcttgaatgcgcttattagcctcttccaatattttgtttacagcatcaacagactccatacgaacctataataagtaatgcacggcaacattagaagcaatagcacaataatacacttcttcaaatactgaaagctaaaagcaaccttaaaatacaaaattaaaagcaaattgctcgctcttatcaaccaaaccttccaatcagggccatgaaactagcctatctgcatctttcacaagttcattcatagcacttccttcaggatcactagtggcctgagctaactcatgacaaacaactttcattccatcaacagactgcacccaacaaaataaattttgaaattcagagttcaacctccatttttgaaaaccaaaaagagaatagggggaatatctcaaacataatatttaaaaccctgcatagaactaccctcatcaaacataatatacctaaaatggattcttctcatactctgtatccggggcactgagcagtgcaggctttaccatcagtaagaagaaaccctttaatgtctgcaaggagaaaaaccttagagccttgaaaacaaaattgagagaaatcaaaatttgaaagttaacgcaaagtgaccttgaccaacaaatctatgtagaacacccaagaacttaattgatgcatttctagtagcagcattacttgactgcagcccaatttctttaagaaaattaattaaatcctgaaataggatttacaataaaccatacaaacttccaacaaaaaacaaaatatccaaaaaaattgtaaattcagataatgcaccttcagctttatatgtgagacaccaaaatcttcaacagcagaaaccatccacaaaattccctcactaagaaccttggggttcttatgctccttcatgatcttgtaaagctacagtaaaattcacagtttttcaaacattatttgataatacttagataaacataaataatgtgatatacggccaaaagttacaacctgcattttatatgaattcccacatatatcttagattcttaaaatgtgagtttaagccttactcataaggtgagggttgtcccccacttatattctctatcttggtactatctttagccgatgtgagatttgggttttctccaataaactttttgtcaagtttcataaaaagaatttttttcccttactaaaatttggtaagaaattatgagactacaatgaaatatacaattttacctgattatctaaatagtcaaaaacttattaaagaaaaatgtatatgctacaatatgtttctcatcaaagccgcacagatttgaggtatgttcccacctcataatcttcagataataagcaatggataatcaaaaacagtgcaaaacaatggcattaaactgcagaaaggcaattcaattatttaaaacagtgacaacaaaaaatgagtagctaaataatcataattttaccaaatgactcttccaacaaaaataaaatatcaagcatgtccttcccagggcatagatttttacgattcacaacacaagctaggatgcactgaggtggttatcccttataattagacaatatgattataaagcgcaaccatgcttactctttcaaaatgaatcctggacaaactgcttcagacaaggtactcagacatttcatagcatgtgcacgtgtcttaatatctgctacacgttcacttagtactaccaatgaaaaacaagatacaaatcagaatagtcattcacaaagtaaacatatcactgatacaagattgcattttacaatagtgcgtattattaccaatagctaaattacccacctgaaaggcaaagtactacgtagtactttggaaatttagttgcagttgaacctatatgagtgataacttcaataacctgctgctgaacctgcacaaggaaattacaagcattaggtcccatttataatatcattcctacatttgactacaaatcattaaaataaataattttaaaatacaaaagaaaatatttttgaacctgaacatttttctcgccccatccaggtaaactgcagactaaacgaatcaaaatttctactgattggtcaaggtcctgtaagccctctacttgctgtttcagtgaagaaatggctgcaaaagtctaacttcagcaaccttacttgtcaagcatgtccaaagacaccacaggaaaatcagaaattaaacagactacatcaagtcatccgtgaatatggcaggaccaatttgaatttactgacccaaaaatgcaacaactataatttacaccaaaatatgaaaattcaatttacaatacaaggaaaaataagagcattttactaaacaaattaaacggcaagaacaaactgacctccatatagattggcacatattccttgtgcaccttcgtaataaaacccttgttacttgtttcagtacaaaaagtcacccaggtcaaggttaacgatcgcacaagatgggactttgtttttggcggctgtcttaacatctgcaacagatccaatgtaatacactcaacaagaagcaaacataaaaaaactaatgagaaacagtgataccttaagtagtgaggttaaaagaacaacaccttcagtagcatttcaagtccatcaacttgcttcttaacatctgtacttaagagtctcccatgtaaatcctctctcaaatacttcatcctatcattctgcaaattgcaggcacatttattataattcaatagttatacatagttcaagttatgcatgattattcctcaacaaacagtcccacctcaagaacttgaattttctcaatgcgtgggtcctcaaacttaaaccttcaaaccaccattctctctcgatcttcatgcttgcaagaaaatccatgacagtccaaccacatatttataagattttaaacaacgtttggtatactccagttcagccaacaataagttttttgaatccttgatatttaacaaggcttgagactggagcgctatatcttgaaaatatattgattcagacttggcaccctctgttgccacaactctcttttgagataatgaaacaaatagttagaaatcaaaacaaatcgaaagtacttaaccaaataaaagtcaacatacagaagatatagctcaatttccatggtttaaaacaccattggcagttgatttaccagcctttgcttttgatgttgcacccactgaaactgctctaccataagttcctcaagtggtcatccattgaaaggggcattgaaatcttgcaatttacacactgatgcaaaaacactaccccattcaacaaaataacacagatttacttttgttttaacaagtttccttttcaaagatgtatatatatatatatatatatatcactaggcacaagtatttttcaagcacattggaaaccagaaagatggagttctacagtgtatggcatacctagaatcttaaaaccagtagctagtgtatttaatgcagcattcctagtttcaccatcccgttctgtagtcaaacttgcaacaatttgcaacgactttagctgcccactaatctgtccacataatgcaaggagtaactatcaaggaaaatactgaataggaaaaagaattcattaaaaagcactagtaacaatacctctgcaccatgatgatcaataataaatccaacaagagtggcacattcaattcgagttcggttattctctgagcaaaaaccctctaatatataagggaaacatttagacacagaatatatggcaacaaattgttttgttagctcccgcatttttcttgtactttttcaatgttatgccctaactgcaacattaaaataagaaatgaattgtgacttcctcatctgtaacacccaaggaagtacactagtcaaactagtatctatgtataccaaaaatttgctgaaatcaaccataccatcagaaagattcactggaataacaacatccttaggtgccacaaatattaaagttgctaatataaaccttctctactaggcacagaagaaacactgccccttcagattcggtcaaagagtacccctgtccttcaaagtgtcaagcagttcaggaagaaattccagcacctaagcaattaagaaaagataagactctatcaactaagtatactcctataaattaaattgaataaagttaagactaacagcagacatctccatgacaaggaaggaaaggaaaagaagaaaactgaaatcacaacaaaaacaaaaataaattgaaatttcaagaatatttatcctaagaagaaatcatcatacattttgttccaagaatattgagccttagaactaattcgataaatggtataaaaaatgaaaaagcagaatgcagagtaaccagatcatactgtcattgcagaagaggcaggcttcagcagttgtgttgcctcgataaccaataaaaaaaaatttacatccttctgcaccaagtttagagtccatcaaagcaattgcaatatatggaacctacaggaaaaccatgcaaaggacacagataccaagacaaaagaatgaaataacacaggaccagcacagaacacagaccatttcaaccagatggacagcaaccagccaagcgtctaatgtattcagcacacattctctcatgtgcttcttgttgtcaccaagacatttcaatatatcagacaaaataccctgcaacaaaccatttccagaaatgttcaaacagaaaacagcaaaacagcaccaaatggggggcaaaatacgaaaacagaacagaatcctcttaccttgcttgccttctctgtatccggggcactgagcagtgcaggctttacatcagtaagaagaaaccctttaatctctgcaaggaggaaaaccttagagccttgaaaacaaaattgagagaacaaatcaacgcagaacacccaagaacttaattgatgcatttctagtagcagcattacttgactgcagcccaatttctttaagaaaatcaatttaagtcctgcaaaataggatttacaataaaccatacaaacttccaagttccaacaacaaataaaatatctaaaaattttgtaaattcagataatgcaccttaagctttatatgtgagaaaccaaaatcttcaacagcagaaaccataagcaaaattccctcactaagaaccttggggttcttatgctccttcattatcttgtaaagctacagtaaaattcacagtttttcaaacattatttgataatacaaaattcccacctcaagatcttgaatttactcaatacgtggttcctcaaacttaaaccttcaaaccaccattcgctctcaatcttcctgcttccaagaaaatccagatgacagtccaaccacatatttataagattttaagcaacgtttggtatactccagttcaacgtttggtacttaacaaggcttgagactggaccgctatatcttgaacagatattgatcagacttggcaccctctgttgccacaactctcttttgagatgatgaaacaaatagttagaaatcaaaacaaatttaaaagtacttaaccaaagaaaaatcaacatgcagaagatacagctctatttccatgttttgaaacaccattggcagttgatttcccagcctttgctttcgatgttgcacccactgaaactgttctacctgactcaaatgactctaaagacaaacaaaaaaaaataatatgtaagcacaaattcaccaacattcgcaaagaagaatgaaccaaagaacgtgccttgaaaagctccatatggtttcaacttctcaacaattagcgtcagtgctggtccatgaatgtctttaaccatcttttcaatctaaaaataagtaaacaattccaagattattgatatttcaagaatattaaggaaacaaggaagaaagcagcatttttgtcatacacataccgttgcatatccactaactctcagtatctcatcaatacaaacctgaaagagtgataggtggtgcccgtggtgggtttcaggggaagaatccaacacctctggagcaattaacacgacaataggggtagaaagaaaacaatacttccttcttgaaaaacaatactttagaacaagtcaccttggtcattttctttaataatttcctgcaatatatcttatcaatgcaatcaagaactctgccataaaagatgaatacataatagataaaaccttaccttcaatatcggtccaagcaattatctaaagagtgcgagaaagaagagaaaacataagagaagaaggaagacgcagagaacatgctttctccatgcatgcatgtcaaaagaaaaatcattattctctcatcttcttccctctattagattttttctcttccttcttgaatagaaatcctgaaccataaagcaatgcagaagtgttttgatgaaagtaggactgtggaagaaccagacacaatagcaatgtatttatagattaataaattgaagcgttgttggaaagaaggaaacggtcatatcaaagatctaagaaagaagcactaaacgtgatatttattttgataataatatgatcattaacagataaaaagaaaattgacaaaattaaatattattcttatgactctattatacatcatgttaaaattgtaattaaaaaaattaattttttatctaaatattagcataaatgtagattacatatcatgaatcattttgtaaaataattaaattaaatttatttgataatatatcatgttatatattatatataataaatttgattgtcgtaatgtaataaaaaaatatgaaaaaacaaagaaccacgctcagataacaattctaatttttaaatttatttgtttaagaaattgaagcgtcataacaaaatgacaccaagataacaatagtaaaagaatgtctctagtaagaataagatagtgtcaattaccttccttaattcatgaatcatattcataatgaattataattaacaacatatgaattgttacaaacttaaacatgatattttgataatttacaactttaacactagctcttataaatagaaaagtctttcctagttaaacttttttaacacttaaatactaatatagtaattcgaagatttaattgacatttagttttgtaaatattgaaagacataaaataaccaaatcacacaaattgatagtgttgtttggttgagaggttcgaggaggaggaggtaaaagaggcaatatgacaatgtggaagtgctaaaagtccaaatgaatctagctttaaattcattaaggctttttggcatatcttgaaggaggacatcatgaggtttatggaagaatttcatagagtttgggtttttccaagaggctcaaattcatcattcataggtctaatccctaaggttgacgacccacaaggccttggggagtttagacctatctccctagtaggatgtatgtacaagatcatggcaaaagtgttacctagaccttgaagaaagtacttaatgatgttattgatcaaatgcaaaagtgtcttctttgacaaagatttcttctacatagtgttttggtggctattgaggtggtgggagaagctaaaaggaaaaacaaaagttgtttggtcttcaaggtggattatcaaaaaacctatgattcagtgaattgggatttcttgctttacatgcttcaaagattgggttttaatgaaaagcggattaggtgttgtttgcaatcttctataatgtcggtattagtgaatgatagcccttcaagagagtttgggatgcaaaggggattgagacaaggcgatccattgacaccatttcttttcacaattgtggcggaaggtcttagtggtcttataagtgaggcggttgcataaaagttctattctagttataaggtgggggtcaattttctacaatatgtggatgatactattttcttaggagaaacatctatgaaaaatatcttgatcataaaaagcattatgagatgctttgaattggtttcgggactcaaagtgaaattccataagagcagttttggagccattagagtggaggagaggatgggattgagatttgctcaaatcttgatttgtagattactatctctaccattcacttatctaggggtacctaatgggggggcaaccctagaagattggagacatggagattggtcatcaacaaattcaaaaagaagttagcctcttggaaacataaggtcctctcttttgcaagaaggttgtgcttactcaatttggtattgacttcattacccttattctttttttaaaaaaataattccaaaggtggtgttacataagttaatttgcttaaaaaaacattctctgggtggagtggatgggagaaaaaaaaatggctttcttgggataaagtgtgttgtcctaagagtgagggagggctaggagttaaaatattgtcatattaacttactttattgaaaaatggagatggaatttatttcataaccaagattcactatggggaagggtggtgttatcaaaatatagggattggagagggttgttaagtgatgtgagtgacaagttggaatctatatggtggagagatctaaaaaaattgtgtggggttgagtgatttaagatggtttgatgaaggagtagattggaaaatggaaaaaagggataaaataaatttttggtgtgatgcataagagggagagcaaaactttgccaatttatatcccaaactattcctcattttattgcaaaaatttgacaaaattggcaatatgggaaggtgggaaggagagacgtggagatggaaatttagttgatgtaggaattgttttgtctaggaagaggacttgctaagaaagtttcaccaacttgtatcaagtatgggcattgatagcgagcagttggatggttggaggtggaaacgaaatgtggattagtcttattcagtaaagacaacatataatctcattattgggaatgacgggaaccaacagacaaacaaaattgttggtgctatatgaaagtaaatattcctccaaaagtgatcttttttttttggagattatttttgaacaggttggccactttggacaacttaaaaagaaaaatgtgagggtagccatgaataattggttatgcctgatatgcactttggaggaggagacaacactcacattcttttctctttcaaattagcagatttggaaaatggtaaattcatgaggaagctatactacctaccattatcacccgaggagaacttttgacaaaaacacgggtctgcaattctgaatgaaatttatgtatgctattatttttggatgtgtaatttttgatttggaaatttaaaataatttaaaccaaataatcaaacaaatgacgttaacataatcaatacagtatgtaacaaaatggataaaaggttttaatgatcaatgatttaacaattgaattgcttaatagagttttaattagcccaaagatatcaaatggtggattttgctatgaccttggtgcttttccggaaaagtagtcaagtcctctagtccaatcagttttgacaatatcagtttttttttttttacagaacaataatactactagttaatgatgtcattattcaaaaatataaagttctaatcagtccaaagatatctattcgtggattttgtatgaagttaataagtacactcctgacatgatttaactctaaaaataagaaaaagtctaagtgagtggttaaatatttttttctttctaaatgacatatattttgagttgaataaaattattatcaacaataaaacaaatttagtaaatatttaacaaaattatatacgaagactcaaacctaaaattactgattaaattatgataattacattttagttcatcaatgcgtttaattagtgataattaatttattttacattattcaagagattctcgaaaatatttttagagttatccctttacgagctacatatgaatagattatatagattacaaattcattattattgtttataatgtcattgagtgcatgttattgcatttaattattgtcattttaataaccatctcaattacatcaataacacaagggcacaattggctgctaacggatactttccttcattgtgtatttatatacagattaaggtgtaccttttaagagaaacattttaattaaacgattaaggcaaaaaatatattatcaccataattattagtagcatgttttttttttcttcctggatttaataaaagctatgatactaatagttattctaatatttctttttaaccaaaaaaactcacttattggtcataacccttttcattggtttacacaaaagaagaaagaaatattttatggaagaaaccaaaaggttaagaatgaaaaaaagggtgattagggtggtggttgcaaagtttgtgtgttggatatgaaaaaatatctctctcccaatggatgaaaggattaattggagagaagtgagaacaaagacagagaagaaaagggtttagtaaacgaaagcgtgagagtgttgtgcgctggaataggtagagagtgatggaaaaagattggtgggtatgcattataaaaaacatgcaccttctatattgcccgcactaacacattaaatgcaccaaagccacattttggatcactacactacaccccagtcgatgtgggacctttccatcttctccccatagccaagccaacacccaactcatcaacatcattgccttctctgaattatctcccactcttcccttttctgtcaccaaaagccatgtccccgttcacatttgataatcataatacttaaccactagattggactcaaaccatgttattttttttcctcctttgcacaacttcttgtttgattttgttgtgtgtatcccttcctcgctcctaaatctaagccatgtttcttgaggagtgagataacaaacacaaaaaatagtaaaagaaaaaaaaaagttttggcttttgtgatggggtgttgatagaggagctagctggtgctgcagggtgtgtttggattttgtataatgggtaattgctggtgtaggtggaatcatcagagtatagagtctcatccaatgtaaagtcaggttggtttactaacaaaaaacttgcctttctctgttttggatgtttttcaattatttatcattgcctggaacgagtaagtgtttttggtttgtgatttgttgagagttttgattagactccttgttttcctccttctggattctgttttcagctcttgaaaatggtttattcatctccttcttttctttttcaatattttgtctttgatgggtgttattctcaaggatttcatgttttggagctttccaatgttccctccttaattgctttcttaatcaccctttcatctggttctttttcattgaagattttctgtttgtgatattatatcatttgaatctagctactggaactttgatatgtaatattattagcttcaaatagctcatccttgtaggcaagttgatattctgcaaatcattgaaagacaaagagaacaaaaaaaacagaaatcttcatataggagttacatgttgtcttcaatcaaatattttttttataacttttctaaagttacttcattgtagaatctgttaatatgacccctaatcaccttttccttatgtgtctgcttcaaaagtgggtcggcttgtaattctcacgtggatagtggaaagcctcttcacaataatgcgttgagtattatcttaactaaatttctaagaaaattagtggtgggtttttaaatataataatccgctgcttcacgattataatatattcccaccatcttatgctttggaaagtgtactatctttcttctctttatccaatacgagagaagaagtttatgtataaatttttttatttatagatagtgaacttattgataattttgtgtataacattccaataaattaactgattaatgcaacatctggttagtttttctgaaaaattggatgaatatatatgaatgggaataattattctcataactttcagagtttcattaaatgtgcatatcatttgttctcatttctcttattgattcaccaaaagaacaaaaccagggaaccaaacaaaggcatgatgatagtaagttaccatcgaatcctgaagaagtagaagatctacggcgtgactcagctgcaaatcctttgatagcattcacttatgatgagttaaagataatcacagcaaattttaggccagatcgtgtgttggggggaggaggattcggaagtgtttacaaagggtttatttctgaggagttaaggcaagggcttcctacccttgctgtagctgttaaagttcatgatggtgacaacagtcatcaagggcacagagaatggctggtacactttttgttgcctttctgtacattttttttatagatgataagtctttctatggaagcgtgctaaatctgcaagacttgagagtgtgtattggatactcttaatttacaaggagatatacaaaaagtatctttttggatggggggaatacccatgtcgcttcaacttctggactgtgaagttccccctccattgtctttctgaacattgtttcgtatgaagttgtctaactgtaaagtcatgatgttgcttcacatgctatgtttattctactatttggcacacataagttaatgtgacaacaaaaatatatcgttggtttaaaaattgttgtaagattaataaaattaaggttttggttgcttcataggcagaagtcatatttttggggcagctttctcatccaaatctagtcaagttaattggatattgctgtgaagacgaacatagggtgctaatatatgagtacatgtcccgaggaagtgtggaacacaacttgttctcaagtaagtatatcttgccacttgttcttgatattgaaattaaagcttaggacaattgctaatgcatgtatccatggctagctaggaatctatttaaagatctcatagcaaaaaatgttaactgttttgctttagtagatgcatatgcatctatatttactttttacttaattacccctttatgttgtctccgacaatgctgacacttaaaagaaaggaatttaagataaagtgattttggttccattttgtagcttcgtggaaaaataccgagttaggaagttttgggcttaagacgttggttctttgtcacttcctaagacatgtgctttagatggatttgataaggacataagtttgacagtaacattacataaggagataacatgtttttgctatactacatacaacctttagtgatcatacttgatgtcaatgttaaaaaagactatgactattaaccctcaacattcctttcacttttgcgatttaatccgtaaaaacgaagaaattacaccggcaactctatgattttttcatattgcatatggtatttttattttttttaatgtttacagcgattttaataaagacacacgatgtaatattttaaaataattatgaaagttagtataatatattgaaaatgtcagtgtgatactttctaaacataagatattagtgtagagattagaaaaaaaatgagacatcaagtgtaatatgaaaatatctcaagaatacacacttttgtggaagatcttggggaaggatctttataagaagatctctttttttcagatccatcattaaaaaaaaaacttatcttcacgtggagatccaggtcttccctaaaaattctagagatctacactaagttcaaaaaaaataattttttatgtgacagggtgaaaaaaataaaataaaatgaaattaaaattaaaataattacttaaaattaattatatgttttattaatattcatatatttttttcttatttattaattaaaattaattatttaattaatattttaaatatttaaaatgtgatccatgtgagattcattaaaattatctaaaattcaatttagaatctatcaataaagaaaaaaaaaatataatctttaatcctaaataacattatagaatctaataaaaaatgatctaaataaaatttcaatttaagataggtcgtgagcaattgagagatttctgaatgtaaattcttggtaggtcctacaccattgtccaatgcaatgagccgaggagtatttttgttctcggaagaccacttactgttttaattttaagccagctactaacttttccagttctagttttaccatgttttccgaactttttcactgtagattaattaatgtttgggttaccattttttgggttactgaggttgacctttaaaacaagggtattcgtgtgggctggaatcccttattttgtataagcccatttagacataaaagtcatgaacttttttgttttgtttttgagaataacaaccatcatcaacttaatattgcccggtgttgaaaaaaaaaacttgctacttatcacatgagtcacctcttatgactagaggatttatatatatatatatatatatatatataattttattttattagagctgctagggcctaacaggtcccactaatcaagtggtgtctaaagaattccaaccagccatgggagaggaaaagatgaatgagaaaaggtttatttacattaaaaaagaatatttctttcatccctcttgtgaagtatgaaatgaattgaatagagatagaaagaaaaacaaggtagaaaaagtaagagatatgcgatatattgaatactgtaataaagaaattaaaagaggaataaaaaattaaaaaataaaatgaaagaaatagtgaaaaaaaaggtttgctaaacccactttatgtgataggttgtcgtatttgcttcacattaattagaccatttttcatgggaatgaaacgcgcttgctggattgatgggtcatttaggagaattcgttaaagcatcattggtaattcctgtaattataatgcatattataaataatttatatctttttatacattactgagttttgtagccaatagttatttccattggaagtttctatagttagtagggtcatgccattaaacatcaaaccagatcaatctcatccacaatatattaaaataccttgagaagaataaaaaaaaaatgattgaggaattactttggacatagcatagtgctagtgtgtgccacacgagttcataaattatcataggttttttcctcacataagttactattccaaatacctaggtgccggggctccacaaggccagccactctatgtcttatacgtgaggagacaagtcagctagacatgtgactaacaatattagttttagctatgttcaaacacaagaacttcttaatcatgcacggttcatcacattatcttttaaataattaaattattatttgatattataaaaccatattttaaaaaaagtgcattttgttataattcttgcaaactaaaatttgcacaagtcaaataacaaataaagtaattacaataaaccgtgtctaataattaaaagttgttctttaataaatggtaagataatattttacattgaacaacacaatgtatgtcatgtcaattatatggatcaccaacctatttaacttccatcttaacctttaaatttcatgttgaatatatttaatatatattaaatattaatatattacgtacaatctaataaattattatataattaatggactcatatagattattaggatttttcctaaattggacataactctattgaacattgcatatttgatacctcatgatgtaatacttaaacatccaacattaaactctttctctctcaaaccccttatctcaacattccaaaagattagcatgagttatgtttaattagtaaatgaaattatgtaaaaatattgtcttctagcaaaaaaaatgtctatctagtttctctgaatcacacccctccactatgaatacactttagtacttcacttttcagtttcacactcacattctctcagaaatttatggatcatctcatctttcacacgtggaacatcactcaatcagaacgaattctaggtagttgaaaaagggagactccttaacccaacaagataaactattttcaggatttgaatccatgacttcagagtcacatagctgcaaccttattattaatatattaagactcactcttaagtctctaattaaataatgaaagttctagatctttgcaaagaatcacagtgaaaatctcccttaatagctaatggaaaaagcattacacgctttatggattctccaaatattaaatgtttttgttttgcatttgatatttttttttaaagtaattgagatattttaagccgattgtttaagagggttcaacaatattagacttggattctttttgtgtcagaggattattctgttggagaaatatagacgcagagttaatgttgcaaggatcctaccacgattaatcataaagtccactagttatattcaaaactgtttgtatttattcaacaaaagaagagactttaatgtttattattgtctttttggttgtatatctaatgtgtctttcttgaatattgcagaaattttgcttcccatgccatggtccataagaatgaagattgcgtttggcgccgcgaagggacttgcatttcttcatgaagcagagaaacctgtcatctatcgagattttaagacatcaaatattttattggaccaggtcagcacacttaaatatgcaactgaaaatgaaaaaaaaaaaaaatgatatatataacgaaaatgtgtagacactagacagatgaggaattaaatttaaccatttaagcatatatagggaggtgaaaaaaaagtgctttccataatttatttgtttagggtctaatttggatgtaggcagattgttggaatcaaacaatcacacaataatcgagatatgagaaaaaaagaaaaaaattatacagagtttacccacacactcataaaatgcactcagtttacaagaaaatatataagtttaaaaattctaagcacaatagttattcatgagtccaagcccaaattacaaaaataataaaatacgagatcaataatagtactgggcctcgaaaaaaattccgagggcctgccccctagcccccgttgaggagactcctgcatatcttgctgacggcacaatataagccatacccaaaacagtatgattctttggagttacacgctgaaagtaaaggacacaaagctattgatgtttgatgctcaatgctcacaagaaatttagctattaaatattgttgttgaggtcatgttgattattgtgttcttcaatttaaaatatttagactttcataacctttggtgtttatgatttattttatactaaacttattgcaaactatagatactgcttgcagttatgttgtcaaattttttatcatagcaaaacgcacatatgctgctgtttaagacacaagactctcgccagctaactatagatatagataagctttactaacaaattgtagttatgttgacaaatactgtttttttcaaagatgaatgtactattaataattggcattgttttagttatttcgtggttcgcttaagcaatcatgcacaacgaaacagtatttgtcacaagaccaaagcacacaaactagtattttgtgatatctctggttagatttcaggtgttgaagcaaacagcaaaatgtaatttttgcattagtttctactcttgtacagcaaagaccacaatgtttccaaaataagccagctttcaactaaccatcttggccttttatgtttcaaaaacaggactacaatgcaaaactttctgactttggcctcgctaaggatggaccagttggagacaatctcatgtttctactcgagtaatgggaacatatggttatgccgcacctgaatacataatgacaggtaaagtatattctgaagctggagttctgtactcatttgtgaatcaaagttcatattttcactaggcataaattaaggccaatgtagagaaattatggttgccccagatttttgatagagtttaatttttatgcatagtctgtgttaagattctttatattatcaactaataaaaaatcacatgaggtataatttttaaggtaacttatataaaagaataaatctatgattggatgatagacgataatataaaaaccctttaaattaaactcttagtatactacaatttgacatcataattatatgttgtgcaggtcatctgactcctagaagtgatgtttacagttttggtgttgttcttcttgaacttctcactggaagaaaatctttagacaagttaagacctgctagagagcagaaccttgcagaatgggctcttcctttgctgaaggaaaagaagaaatttctaaacattatagatccaaggctggacggtgattatccaattaaagcagttcacaaggctgcaatgcttgcatatcattgcttgaaccgcaacccaaaagcaaggcctctaatgcgagatattgtagactcgttggagcctttgcaggcacacacagaggtccctattggaaaaacattgaccataatcagtgaggttcctgaatctggtttgaaaatgaaagatgatgcaaaatgacttaaagagggtgttgttgtaggttatcagtttcacttctcatgttcactgggggagaggttttgccttaacttcttgtgtttattaacatgacatataggcaatttctttctattttatccccttctttgcttttcaacatggttgtcatatatgtacagctggattattgtataaaccgatatcaagttaaacagaaacaaacaagcaatagcagcaatacaggatatgattagacgttcttctgtttcagaaaaaatattttatgcctgagattgtttaagagtttcacactgtttctgaaattgttatgtatggtaaatttattaatttttatataatttaattgaaagtcctatttttttataatttcttatttgacaaagtaatttcttttacagtgcatagaaatgaaactctttctttatttgaatctaatatctttccaatataatgagataaaacagttaatttttttctagccaaaaccttttgaaaatgtccgttatcccaatagttcttgcataaatcagtgaagaacacatgaggctacctagacccgaccagtagaggctaaggaacatgaactgaaacacattttcactgaaatattataaattaaattttgtgtacttttcccactgatatacacttcctaccattttagtttgctgggtaaatttaatcttgaacaatttcttatttttattgttatctgaccaggaatccttgcaaattagactgagtttaacccttaggtcaagtgtgattgtttctgagattaacctcttaattgcggatattgttagcaaaagtcctgtctaaagttgtgttttgggcctatgtctgtggcccatactcaataacaaacatcttggcctagatgggctttgttattcttacccgttcttcgctaacttcacactcttatttacaaatggtgtgacttaacctattttttttttatctttactggaaaaaaaaaagttcatcaatagtaattttgaacaattgctaaaaacatttgttcatgaaattagtaattaaaataatttgttgaattgatattatatttaacaattaattaaaatatcattggttttccaaaacaattttattactattatataaaacaccttttgtcattatttataacatatatagtcaataacttttttgactcttattataagacttgagaagtgttagtaaaacaactttctaacactcatttcatccattatgacttaaaatttattgaaaactataaatgtagagagaaagttattaaataaattgtgagatccatcaaaatttataatttttaataaattttaactaataataaaaatatgctgttagtatttctttataagatttcattttatctctcttatacattaataatttgttgactaaaatatttttatttattttaatctataattaaatgttcatttgaatttttactttctcttttctataaagattaaagaagatgaatagattctgattaatgttaacaataaattttaaaaaatattacagttaaagataaatttaatactaatatctaaattaattaatttttaataaacataatttagacaattatgtagaataaaaagaataagttttattccaatcaagattcttaattattattttttaaaaattttcatctccttaatgaaattgttgatgacttggagttggattgtcatagaggtagtacagccacgtctcaaactcaaactttgcaaaatcgaaaaagtacacgtggcatgatactagtgaactgaatggatgttgcttcttaaatcttaaccacttcagcaatctacgttcacaacctctcatccatgtctttgtggccctaacaaactgttaactatgcacaagcacaacttcaagcaccaaccaagggatgctccactcatagaactcaatatagaaactggaactagaagtagcagtccctaagttttgtgcataaccttaaaccatgtcattgcctaccaccactagtggtcactcatctatttactctgcacttacattgccaagaaccacccaaattcaaccaaccttgttttctcccaccaccaagttcttttcttccagaagcccctcatattcaggtgtttcctattgtttctcaaacacccttttgtcaagacctttgctttttgctgtcaaggcttcatctggggttggctcagaagcatccaaacaggatagtgacaagagtgaagaggaagaggaggaaccgtatgaagagtatgaggtggaaattgagcagccttttggactcaaatttgcaaagggtagagatgggggaacttatattgatgctattgcaccaggaggatcagctgataaggctggagtcttcactgttggggataaagtaattgccaccaggtgtgctattcttgtttttttaatttttctctttctgcaagtttcttatttggagaattagatagaaggtttatagatgtggtataactttgatattcgtggttggatagcatattatgttcaagagagtttattggaggtcttatactcttatttattcttggttggtttatggttgtgaattttgatgagtttaacttttatgcacagttagtgtaaaaattttacaatgttactaattagaaattaagtatgacttttataatatttatcataaaagtcaacaaacttatcatatatatgaatatatcagtttgtgattggatgacccttttcaatatgactttatttagtaacaacaagaagaaaagtctaatcccattaggtgagtgatccatgttttggtatatcaacatgttttacattggctcccaagggcctaacacaaccttcttcctttacttggtcttgggacttgttatgaaaccattagcgtcatttcatactttcagtttaactttggtccttaaaaataattttgacatgtcatagaatcaaggtttctgaatggtctataaattatcctatgtatattatatttggggtggtggtgatggttgggggggggggggggggtcggtctttttatatgtatgaagtgaacttcaaaatccttttgagaagtaaacttgtatactttatgtttgattcataatgtctgagatatgtccaatatcttcaatatctgcagtgcggtttttgggaccgaaatttggccagcagctgaatatggaaggacaatgtacacaattcgccaaagaattggcccattactcatgaaaatgcagaagagatatggtcagttcaatatgtatgcatttttgctatgtttcgagtgctactctagtaagtagtcacttgtgacctttgctcattgatctcagagtcatggttccttattttgacaggaaagagcattgattctggtggtgagttaactgaaaaggaaattatcagagctgagaggaactctgggtttatcagtaacagagtgagagaaattcaagtaagtttcatcatgatgataaaactgcaaaattgtagtccatacattcattctcaaaccattttgtatataatattttctctactatagaaagatgtcactgctgtacttccatgtggggtacaaacatccattatcaattctcaaacttgcaaaattttcagatgctaaatgctttgaggaaaagggaacagaaagagaacagggaaaaggatttgagggaaggattacaactatataagtaagacttagcaactcaaaatcattttctttttgaccctctatgatgtgcccagtattcatttcattgtccaactttgcaattatattcttccgaagggagtagtaggtgaggtatgagaagagttaatcttgattcttgaccatggaactatatttagctataatcagatataagtaaaaccaatatttgatcagcaacgcatgattggttatatggtcaagattagcttcttttacctttcacactctcacttgatacaccttatatatatatatatatatatatatatatatataatcttcaaggttgtgctagatttattaaatttttcctttaggctaattactcacgtggtttcttaattttattttaggttgcgatttggtcccttatttactaaaactaacactagtcgtttttcaattttggggcatcattttgtagttttttttattgattcaagacgtgaaacttatctcattagattcacttacgtgaaaactatgggtcattcagaccaaaaaggacataaataagatgaaattgcatgaaaagtgtgtcttatgaggatctggaaaactgaaaatctccaaagatcaaccagaagattgctcatgagacataaacataatgaaaatcacatgaaaaaatttcaaaatcgtgtcccaaaattgaaaatgataagtgtgctacaacattatttgaaaaggataaatgttgatccctccattatttgaaaaggagggatcaacttactccaagagtaactctttccttatcctcaccattcattttcagtcatttgtctaactgattgaaaccatccatgcttatggccaaaaactggttaaagaaaatacttgcttcactttccaagcatccaatttgcatcatatctaaattaaaagactgactagaattgatgctatctcactactgataagtgataatactactgtgcactctgttcctggattaaatgctgaaggaatggcaaatatgatgaagcactagagaaatttgagtctattttaggatcaaagccagaacctgaggaagcagcagttgcaagttacaatgttgcttgttgttactctaagctaaaccaggtatttgtttccttccgttcgctacttggaacatgtaatttgatcttggattagttccttattatccttgcggaatagatataatccctttacatctgaatgtaactaatttagtccagtaaataaataaaaggtttattagtccttattagaactagctaaatttttcctataacatccaatatctagttttacacctgctaggttaggtgatacaccgaagtcctatagcattgaccaatcccaaacaaaacctgtgaaaattaagtctcctgtttatcttacatttccccatgtagagattagtagctttcttgtagtcattggattttcaacaacaagcatctgattcctcaattttattttttgattcaaagggaggagtggaactctggtaccaagagatttataataactcacacacattgctcaaccaataagctaaaccaccattggttatttttattaattttaaagcattgaaattggtatgagtattatatgcccatatttatattaataaggacaatatacttcttaattaatccattagtcttgccaacaaatgattctataatttatctatctattaatatactaatagagtaataaatatctcttaacagattcaagctgcactttcttcactagaagaagctctgaatgctggttttgaagacttcacggtaatcaacctacttcaagttattccattatcatattggctaagcatctaacattcttgcaattttaacagagaataagaactgatcctgacctggctaacgcaagggcgtcagaggaatttgatcctttattgaaaagatttgatgaatctttcatcaatgagaatgccatcaatgccattaaatctctttttggatttggtaagaaataacccattgtgtggacaaaagcatacagtttggctgactaaggagttggttgagcaatatgataattatttcccatgtataactttatagtttaactacacagtccctcattttttgtcccttaagcgggatcttgttttatgtactagtataatcaagcaaaattataagaaacttatttatgatcaataaaattgtccatttccatcacctcctactttgttgcatgttgtttcccacaaatggccccctaaagaacctgatttgttttgaagcaaccaggtatatatgagaggcttgaatcaagaggatttgcttgttacatgtcatggacattgtcctcttagttcatatagttgcgatttacgaagcaatcctgggcatgacttgagttaaagataatgcagcttgtgattctcaaaatctttaacatctatcttgatgaaatggcactaactccctctttcttttgatgaaactactcatttttttatgatgtttcatgtagctgtttttcaaccatcaatagatacctttctataaattgcaattttttatatttttttactgttttcaacttttaattcgttcacaaaatttcctttgtttctaaaattttacataaacattttcatattttataaatggattgcaattaaatctctatagtgcaaaaatttaaaattattaaatatttatactacaaatttttttgaaataatatgggagtaacaccaaagataaactaacataacaaagttgtaggttttaccaattggattattttctcttatttgattttggacttgaatttcaatgtctcgtttctctatcgcaatgacgattagctccataacagtgattattgaaaccaatacttcgttgaactcatggaagcagatacaaaaagctggggctaatcaatggagcataaagtttattttctaatgctaatatagtaatataagatgactacttagaaaacttctaaacaatatattatgcgtatgaaggtatttgactagaaatgggaaggatgaagtcgaattcaagtccttttactggttctagcaagggatcatacttaaacttctcatcaggaatcaccaaatcccacttgaaccgtttcacgatattatgcatgaacacaagaatctctagttagcaaactcttgccccaaacacattcgggggccacctccaaatggaacatatgaaaatggtgtaggccctgccccttcaaaccttgaagcatcaaaagtttcgggatttgagaagagtgtcatatcctcgtgtgaagaaccggtgttccaatgcaactgcgagaacagatcaacatgagacaaggttctctccttgtagcgaacatgcacttgttttactggtcttatatttgtaaaaagagaaattatcaccaacaattagtattgttgagtctcaaaaaaacaaggaagttttggtctatttaacaaagaaacctcgagtagttcatggaaacaagaacagcaaaaaaagatataaaaaagatttcaaagattgaaataaggttaaattaaacatcaactgaattagtggcctaatttaaaaatattgttggctgatgtaagaaaagaatattaataattgacagcaagaagacaagttttaaaagtacactatagactgtaactagtctctttagctttgatgttccattgtgtgacagtaatatcttaatggtacatatgaaaatacaaatttgaagcgtgagtatgaagtaaagttaaagatggggtagcatttggctatctgcaatcataaacgagatattcccaagtccaaggtatgatatgaaaacacttcatgaccaaggtgtgatttcaatgaatgcagagtgaagaaagcatgataatagtataaaagcattacaaaagaaatgaaacataccttccaccctttagggatgttataatcagcatatgtgaaatcctttgtagcttctctgtaagcaccactaacaggtggggacagcctcatgcttcagatgcaacattccaagagtatttcatttctgaacatcttcccattgcaacaattgctctgcctctttcccttgactaatttcaagttgttctgtcataaagataacttcaacatttaccctgatcaagttttaggtaagagcatatggctgaaaattaaaggatttattactaacctttcaagacatgttcataaacttgaggtaatgtccaagatacttcatgaccaatgataacactgatctagaactatcgtggccggcaaaaagtagaagaagtatgttatcaataacctccatttcggtcataaaccttccattgggatcagatgtaacaagcatgtgtgatagaaggtcttgagtaggtgatgccctcttctcctccaaatccactttccttttctttaaaatcattttaatttccttccttattacatctgcagctttcattgcacgatgaaaccttgtccaggaatgttgaggggcaggccaatgatccctttcagaaattcatcaaattttaacgaaagctttgatatatggtcagagtcttcaatgcttaaaaataagcaacaagccaattcaaacgtgtatagctgtacgacgggatagacaaacacctgctcctttccttcaaaattgcaaagtaagaaaatagtattcaactttgagaaaataggctatgcattgacattgtaaagtaatcacaatccatcatatatgacaagtttgtgatttttataataactaccttaaaatcataccaacagtgatttcatattggttgatcatgctatttttttttcatttctgatgaataaccagttttattagtcaaaacaaaataatatactcaatcaacactgtttaatcatcagaaaacatgtaaaacaggtgtccctcttaggactacttctgatctaagaggttataaatctaataatttatttctttatttcaggatgaatatgaaaagcagaattgagtataaggcccttctgtaactatttgctaatgctaaatcattatgtacctaccgactaacccttaatcatatatacagttgcaagtgttggatttaacccaaatttcattgaagattgttattgatagttttctataatatcgatacatatgtaagatttgtgtaacagataaatatatgtgagatttgatagatatgtaaaaggtatgggatatattagaaagatatgagagatttgaaaaatatgtaagagtctattagagatttattttaataggaaattgggtaagttttgataataaatttgactcttctcatctatggcaataggcaagttgggcttgaccactataaattgtttatgatttgtttgtgatgcttttacccactcactagtagttatgtaagcatatgaaaagaggatatgatatttcccaaggatatggtattccccaccaccaaggatggaagaagggccacaaagaacaaggtattatttaagtaccattagtaaatagaatttagctgttatataacatttcttaccttcccaatatgtgtctatatgacgctgagcaatgctatccatttttggcaagtagtttctgagtgtttctgcattaagaaagctcatgagcaaccttctcaccatctttgcctcatcaccaaccttattaaccaaggacaaccttcacaacctcctcaccgaactaggccaccacacttggacattcttgttctcattgctgaataggaacttgttcccagctggcccgcaaaacacaacaacaggatctccaaacattgaagtcttgaacaccctggagtcatatttcttcactctttcttgtatgaaccttaacacgtttccctcattcattgtacgcagaaactccaaggtttctccaacaacaggccatcctaatcttccaggaggaagattgaggtttggatgtttcctgagtctgtcagctttagtgatgaaatgaagagaaaggacaaagaatgccgaaactgctggcaagactacaaggttggtcacctccataagatttagtgcccttaagaccttaactattgatgaaggacacaagacaacggagagtatgaaagactattctgggaaccagggaaactaaggtgtaagatggatgacagagagattgctctttggggactgaatgaaccagataagatatataaatggaatttaattttcatatagtatctatgtaaaattgtaaatgtaacactggaataaatagaaatcatttttaattgtttgagtaattataataaaagttaataaacttttttttcttggaaaaaagtttcacatatccgaaagttataacactaataccagaaaagtagaatattagttaagaaataatttttctctccacaaatattactctatttacattgtaaaatataagtcaataaatttactaacttagcatacatatgactttgtcataagaatctatatagtgatgatatttgtctcctgtttttataatttgacccacctcaattttaagttgtcataattttttttatcttttattgactagtttcttttttatattttgtttcttttatgctttatttgattgaacattttattttatagaatgagatatgttttttgttctttaaaattttagaaattcaattttaatcttttaaaaaaaatatccattttgcattcttttaattttgaaatacatcactatttttctttaaactggtttagatatatagcgctttgaagataaaaaatattttaaaatagaaagacgagacaaattcttttagaaaatctaaaatagaacttttagacaaattataagaaacttatttatgataaataaaattctgcatatccatcactttctactttgttgcgtattgtttccttcagatggccccaagaagatcgaacctgatttgtttttcgatgaaggggattgtccttattgcatgtcatggactattgtccttagtccccatcgttacgaagcaatcctgggcatgacttgagttatatttatgcagcttgtatttattatttctaggttgtgattcccaaaatctttacttatcttgatgaaatcgctctagcttcccctttcttttgatgaaactaaatttttttattatgtttttcacgtagctgtttttcaaccatcaacagttacctttttataaatttgtcaaaaatatttttttattgaatacaacttttaattcgtcatacaaaattccctttgtttctaataaaaaacattttcatattttgaatggatttcaattaaatctctattagagcaaaaatttaaaattataaaatatttagactacaatttttttaaaataatattggagtaacaccaaaaaaatagcataacaaagttataacttttattaattggattatttcaaattagggctctcttagcattcaacttgagcacaatttggatttgaaagcaagaccaacagtaactcctgttttaaaaaaaaaaaaatcccatgacaaacaagaaaatatatttgtctcctttgcgtaaaactcttctatacttggttctaagattcaattgtgtgaattggtttgtctaggttgtgcaacgtgcaattttggtcttttatcagtttttcgttaactatttaatgtttttttttttttgttgaggactgatatagcagatgatatcacatgtgaaaggaaaataatttgtcaaagcactaaagtagagatggagttttacaataaaaatagacatgaagaggggggaaataacataaaaaagcattacgttttcctggtgtagttttgcagacaaaagtattgcctcatattctttaggaattcatctgattttcttattgattttgtacttgaattttaatatctcgtctcgcaaccacgattaactccaaaaaactagcatcaagaaagcatagacatttgttcaaaaaaaaaaaaagaaaaaagaaagaaagcatagacatgaactatgtaagctgtacataacagaataatcaaaggtttattgaaaccaacacatatcatagaattcatggaagcagttacaaaatgctgctaatcgatgtagcagaaagttttattcaaatactaataatattgcaatataagatgactacttagaaagcttctaatcaaatgttatataagataactacttagaaaacttctaatctatgtattatgcgtatgatgaaggtgtttgactagaaatgggaaggatgaagtcgaattgcaagtccttttactggttctagcatgggatcatacttgaacttctcatcaggaataaccaaatcccacttgaaccgtttcacgatattatgcatgaacacaagtatctctagtctagcaaactcttgccccaaacacattcgggggccacctccaaatggaacatatgaaaagggtgtaggccctgccccttcaaaccttgaagaatcaaaagtttcgggattcgagaagagtgttgggtccttgtgtgatgaaccagtgttccaatgcagctgtcaaaaaagatcatatatgacatgatcaactcgagacaaggttctctcctaggatactagcacctcttttacccttttactgtatattatatttgtaaagaagcaatgcttttcagaattttgtcaccaacaatcgttacttacttcagtattttttagcctcaaaagaatgaaggctggtttcggtctagtgtaacataagaaacatcaaatagttcatagaaacaacaactgaaaaagaagaaaaaaaagataacagagacttaaaagattgaaacaacagttaaattaaacatcaactgaatttgttgcttgatttaaaatattgttggtcgatataagaacagaatactaacaatcgaaagtaatatgacaagttttaaaagtatagactgtaatgtaactagtccctttagccttgatgttgttacagtaagatcttaacgatacatgaaaatacaaatttgaagcgtgtgtatgaagttaaaaaggggtagcatttggctatttgaaatcataaacgagatattttcctaagtccaaggtgtgatatgaaaatacttcatgaccatggtgtgattccaatgaatgcagagtgaaaaaagcaagatagtagtaaaaaagcataacaaaagatatgaaacataccttccaccctttagggatgttataatcagcatagttgaaatcctttatagcttctctgtaagcaccactcacaggtggggacagcctcatgacttcagatgcaacattccaagagtatttcattttctgaacatcttcccattgcaacaattgccctgcctctttcccttgactaatttcaagttgttctgtcataaagataacttcaacatttatcctgatctagttttaggtaagagtatattgctgaaaattaaaggcgtgaaaatagttgtcagcaatagcttgctacaacaattttctttatactacaacaaagtaaacaaacatgttcaaggattttattactaaccttccaagacatgttcataaacttgaggcaattgtccaagatattcatgaccaatgataacactgatctagaagtatcgtgaccggcaaaaagtagaagaagaatgttatcaacaatctccatttcagtcataaaccttccactggggtcagatgtaacaatcatatgtgatagaaggtcctgagtaggtgtaccctcttctcctccaaatccactttccttttctttagaatagttttaatttctttccttattacatctgcagctttcattgcccgataaaaccttgttccaggaacgttgaggggaaaaccaatgatccctttcagaaattcatcaaattttaacgaaagctttgatatatggtcagagtcttcaatgcttaaaaataagcaacaagccaattcaaacgtgtatagttgtactattggataacaaacacctgctcctgtccttcaaaattgcaaagtaacaaaagtattaattattaaactattgatcacaagtattctttttctttttcatttctaatttataaccagtgctattaatcaaaacaaaataatatagttaatcaacaatgtttaatcatcagaaaacttgtcaaacaggtggccctcttaattctttaagactattctgagctcagagaacataaatttaatgattttttatttcaggatgaatgtgaaacaaaagtttctagttgtataagaaccttatgtacctgcccgctagtattggatttaacccaaatttcgttgaagattgttattgatagtttgctatactatcgatacatatgtaagatttgtttcacagactgaatatatgtgagatttgagagatatgaaaaagtatgggagatatttgaaatatatgagagatttgaaaatatgcaggagtcctattagatgagagcagttgggaaaaagatatcaatttcccttccagacctgttatgaatggtcttgtacaagcaaaatgctttatacacaaacagtaattatgcaagcaacacaacacaattttaacgtggaaaaccttctccatgtgagaaataaaaatcacgggaccgatctcggtgtccacccaaattcttcactatcaataaagtgagattacaaaatggttccaacaaccattacaatcaacagacaacttcaacaaaagttgtaccaaaccgtcacaagaggcaaacatacaaaataggcttttgtacgaaattaatttctcctaccagaacaacaacaaacaaatcccaacggtcaaactgacatattgcaagagaggaacacactgatcaaatttgaggacaatccaacggttaatgtgagagaaatgtcccttacaataaaactgcccgcttcagaaaacggtttcataaccgcttcggtttgggaatttccggttatactacaagcctttattcacgaaaccaaccgttagatgttaatattggtgagtcacgaacctgtttaaaaaatttcaccaagatccaacggttaaccaaggagatagagaagattgaaggatgacagtttctacccttctccatatgcgaatttggtggtttctttctcctctcttttctctctttggtttcaaattaactgtcaacatttgaaagaagtaactgttgacctattaaataaggaactccaatctttccttattggctggacttgattgcaacaaatttctttgaagattgttattgatagtttgctatactatcatacatatgtaagatttgtttcacagatgaatatatgtgagatttgagagatatgaaaaaggtatgagagatatttgaaatatatgagagatttgaaaaatatgcaggagtcctattagagatttgttttaataggaaattaggcaagttttgtaaggatgggtcatgagaatgaaaataagagtgagggagagattgcattgcaataaattctacaagctagatttgtttggattatagcagttttctgctccacacttgactacccagcgtttaccgtgggcaccataagtggcaaaccagaggtgtgtccttccctgtcctctcaatgctctaatgcccacaccagatatggacctgactcaatttgattcttctcatctatggaagtaggcaagttgggctggagcactataaattgtttatgatttgtttgtgatgcttttacccacccactagtagttatgtaaccatgtgaagcaaggataaaatatttcccaataatgttgaagaggatgtggtattccccaccaagattgaagaagggccacttagagtaagttacctctatctctatcaatcttttgcttgatcattgattcataaatttaatcaacaaggtgttatttaaccatcatttagtattgatctaattggaagtcgttggtagcacaattctcatatgacctacccaacacagtttagctgttatgtaacatttcttaccttcccaatatgtatctatatggcgctgagcaatgctatccatttttggcaaatagtttctgagtgtttctgcattaagaaagctcatgagcaaccttctcaccatctttgcctcatcaccaaccttattaaccagggacaaccttaatagcttccttactgaattaggccaccagacttgaacattcttgttctcattgctaaatagaaacttgttcccaactggcccgcaaaacacaacaacaggatctccaaacattgaagttttgaacaccctggagtcatatttctcctttctctcttgtatgaaccttaacacgttgccctcattcattgtacgcagaaactccaaggtttctccaacaacaggccatcctaatcttccaggaggaagattgaggtttggatgtttcctgagtctgaaaactttagtgatgaaatacagacaaaggacaaagaatgccaaaactgctggcaagactacaaggttggtcccctccataagatttagtgtccttaagaccttaactattgatgaagagcacaagacaccagagagtatgaaagacaactctgggaaccaggaaaactgtggtgtaagatggatgaaagacagaaagagtttgctctttggaataggactgaaccagagaagttcaagttatataacttaaaagcacttgaactgtgaactacaattcagtttatgttcatctggtttttgttttaaagcaaaatagttggtcctccaattacaaaacatgaaagtgacacttcaatattaatgtatctttccctgttgctccaatgaaaattagtccttgatggcatcactataacgaccattaaggactaaattgaatatttacttaacattttgtatcgtacccttttgctccaatgaaaatcaatcaagaggaataaagcttaagaaagtaaacattgtattaccgaagttgtacatatggatacaactagtgaaccgacgaatggaagcactaaaataaatgggaggaaaggcttagtgggatacatgataaaccatggcatcgtcaaagatactaatctctttgttgggacgatatttagccttgtaccataacatttgtgacctgcggcattgccattattagacacttggtcagatgaaagctatgccataagtccataacaaaccttgtggctgttaaatagccacttcagtgtttgtggccttttgagattattttctcgttttgaaatgacaaaatgataatgtttttgtctatcacttcccctctcttctgttccgctgatgaagttctgtcatgtcatgtggaatggttaacttctatctatactgatgataagataatatttttgtgattaaaaagaaaagtaaaaaataaaatcagagagtttttattaaatagtaaatgaaggcttagaaacaagaaattattaggtggttcataccatcacctcatccatgatttcaaccaataatcatgtgacactagataattgattaagattctttaaattaagggatagtacaattaattcttgttaggtaattaatgagtatatctttaatttatttaatatattttttattgtccatatgtcacatgattattaattagaaccatggacgacatgatggtcctgaaccacttaataatttttcgaaactagaatacatcttgagtatattgacgataataacctaacttgtcttgtcatgctagtatttgcaagttacatacgtagaataaatattgcaagatgataattgtcgaaaaaggacacatgacattgctggattggtttctttattttttttgtcataactcttcgatttactagggaaaatggatcccgactattccagtcagtcaataattattttcgccaaaaattgaattcgaatactacttgaaagattcaaccttaactttaccacattaaccacttatgtttaatcacttcattaattgatttctttgtttgataaaaaataaagaaatagaatggatgaaaataaaaagggaaaaaaaaggtgaaatataaagtaaatttgattaaacaaaaataaagaaaagatcgagataaacatgagtatatatatatattagattatgtcttacaaggtacaacaatgataattttaataaatagatgataataatattattttaaatttaacttaagtttgtatacattgaaccctaaaaaagttatgttgtgtgttcaaaattttaaacaaattcataattatgtttttaaatatgttaaattttaaatcttaagtgtacaaacttagagattatgaattatttatatttttaatacggataatgagaatcaactagtgatttatgagtcagtttttaacccgttaatttagaaatctcatcaaatcaaatgattcattcgagtctcataacattgacagtaattatacatggtatgtttataggtgcgtgctataacatgtaaatgagtgcacaacaacgtacccttgagctgaatatcctttaattttacgtggtgacccaagatgaatgccttaatcgcatgaaagtgcataacccacccacacgtacagaaaatgggaaggagattttgtgattcatgataaccccacccacgtgtcccatttattaaaggaaatatccttgtccatactgaacctatggaagcgtaagtgacgaacccaggtcagattgattggtagagtaaagatacgttggctagattgtgttggctctatcctcgtttggctagaattttaattcaatcatccatcatggttgtttaatacgataaatgaagtggatgacaaatgtttcaatccacaaattattttatgatctcgttttttctcgaacgcattgatcgagttacaacatactagtacttacattttagtctctagtgtcacgttcaatctcatctacttctattaattcaaagtccatttaactaataagtcactacataaatgttatttcacgttcccttatgactttatagttgtcaaatatcttataaaaccatcagcgtgaattcaagtctggcataaaaaaactatatataaatattaatgtttgcttttagtcgttcatgatcatttttgcttgtctttattcgagtatctttatattttcaaattgaaatattccatctctttgaagatattgaaattgctctaaatagagctatttttattttaataatcaaattagagtctttggactttttagtaatattctaaaatatttctacaaaattctattgtttagattaattatgcgactaattttcaaaactttgttatgcttaaaacttttaatgatatcttacatgaaaattgaatctaaatctctttcataaaactcagcttatattattaacggagtcatattcatttggtagtgttattatagttttagtatataaatatgagacagacaaatacatgtacaccttaacaagtgaagttttctacaacgtgaatttaatttaattctgaaacaacggattcttatcaataaaatgtttgcccaataaaatcatattcccagaagttatggacctcagcctcatacagttggctctgataagagattagtggaaggactaatggacgaatcaagtggtgacaaagttgatggtttcgttttgaaaacatgtactgttgaacatttgaaacttctgtggttgagattatccaagacaaattgtatcgcatttgtctactcctacatcatcattgtgaggacacatgacgttcacaattggagaagctttagtgaactctctctaatttagaaatatgccatttttagcaacaattctgtgcagactcactattcaaggcctccatcgtttgagttttatttcttgccaaaacactaattttataaccaatgtatttaaaaataattattgtttgagttttataaccaaaacactattcaaggcctcgatcgtttgagttttattttgttaaagtattctagagtgagaggtcatggaaaataaattatttaagagggagtaaattggtatacaagctcctacaagattacttcaaaagaagaaaacctgggaacaagatctaaaaaaatcttataatttgtgtatacatataaatggatttgaagataaccaacgaaagttttcacaagcagccataattttttataacaaaaaaatgctgggcagagatgtttatgagtttctttgggtatgcataattaagcatgattcaattaacacaagcgggaatcaattgttctgcctctcactatatataaagcgtgcaaatggaattatttaaaatttcaggaaatttaaaatttagaaaattaaaatgcatcaattaaaattttttattttcaaattctgtgtttggataaaaattaaatttcttcatttcaaaattttgtttgcataaagaaattgatttttttcgttttaaattttgaatctcattcacgaaaaacacgtaaaatagtgtcatgagagtagagaggtcggagtattcgtccgagatcaagatgaacaaaagtggtgcagttagagctttagagaattcaatttctcacctttagaaggaaattcaaatttcacattttagttgtttaaaattctatttaaaattccaaaaatttaaattctcgtataaaatattaaacaatgaatttatattaaaaatttcaaattccctgataaattactttttccaattaaattctctatccaaacatactgtaagaaaagaagtaaatcattttgaatcgaggattgtgtcaatgattaaaaagatgcaacaacaaaaatccataatattcaagattgcaaacacaatatcatataaggaaattcaaatagaagcaatacatgttaatcggggagctatatatatctatgaatgattagtactattcaatttgtttttgaggtctatagaatatggaacctttgccttgcaattgtttgcatcccatacggcatgcattttggcactctgaatctgctgcaaatttaatcttcatgcatatcttcatgcatttaccgaaacatgtcgttacgggtatcttgccacgttcaacttcgtgacctgttgctgaatctactaccaccaccaccaatggcatgtatagaaccaagataaccgccaaacctaaggatttgtaaaccattgtattgtatttgcggtgtgccaaagaaatgcaaatgtatcgaaatgtatgtaaaatggaaatttccttggaatgttgcgtgtgtgtggtgaaaaatcgatcaattggttgactttgttctaaattgggtttaggaatttgttttccaaaattaaaaattataggaatttggaatcacgagcacggtaaagaagttgtatagtactcaaagaagattaatcatcgccactccaaataataataataatttattattattataagaagataaaccattaacttggtaaaaaaaacaaataatatagaattcaatacaataatttatttaattacatatgagagaatatattgaacgacatacagttgttaaacataaccaccacatagcaatgaaacagttaaataaaaaaactcgtcattctaaaaggttctattttaattaacaattaaaacaatggataaataattaaatttttctaagcagcactcataaattaattcctgaaaaaatgacaaattcaaagttagtattcgaacatataaaaaatacaataaattagttttgcagataatctaataataaagtggtttctaaaattataacttaatatcaaattaatcctcaaaaaatataattatttatcaaattgatcgttaaacattataatctaataaaaaattgtttcacaaatttaacaatagaactaatttatcacattttttcacattcagggactaaatttgtatttttatcttgcagtaaccaatttatcattacatcacactttgagaactaatttcaacatttacccttaaaacattcataatattcttattgattaattatataagtatttaatagcatcaaatttggaatcaaggaaaagaagattataagtgacatttattgggatgaataatagggtgctcatgaattgaattgaatcgattttaaagagaaaaatcattcaatttaaataatttagttttgttaatttatcatttaattagtttaatttaaacttttaattagatctaatttaaagcaatttggattagaacaattttttattttaatcctttttctaattttttcagaaagtactaaataaaatgtgagatatatatttaaaatggcaaatattttatgtaactaataataaagtatttatgtattttaactcaaataattagtaaaaaaatctttaattaaatacattttttataaatagatataaattatataataattttataaatttatgagatataaaaataagtgatattataaatttacgaataaaaacatataaattttaattaattgcggtgaacgtggatgaaacacgtgaccttcagatcttcagtctcaaactatcccaactgagctatacccacttttaaaatattatttggttaagagttaatataactataataattcataaatcatcttacaaccataaagattatccaaaaatataaaaaaataacataaacaaaaacgtaagttgcgagattcatttcgtccacgggagaagtaagtggagttatccaccctttcatttctctctttacaatatattgacccttttttagttttagttacttatatataataatagtataaacagtaaaacttaaatgggtacgcctttaaaatttgaaaaagtcttgctttgacatattaaaacaaactattatgtataatcatttttttataataattatattaaaatttatacctgtgttgattttttattagtgtatagtggtcaatttcaaaataaaaaattgttacgtaagtattagagtgttcataaaacattcaaattaacacattgttagtttgagtataactgaatttaatttttttaaatgagattttaagtttaagtcttatgaactaaataaaaaattgatttaaagaaggatgttgctaaggatggttactcaagttttctgataaaaattagttatcaattttaatttgaattgacttggatgaaatttaaatgttaaattaaacaaattagataatgaattaaagaaaattgatatgactatataattggtttattttcttagaaaaattgattctatctatttcagagacttccctatcggtaaatcctatccataacaagagaattggagtgaaaagagaaaataataattatgacaagtgatgcgatgaaaattgaagagataaaaaaaaatgaatttgggtagaatgagatggaagaaaaatatgttgatttacgctattaaaatatacatgcaagtaaaagatttaaattaataatttttatagttattaaaaaattcaaatatacatactcatacattttgtttatctcatgttatattaaagaggttttttattttatttttgttacaatatttgataattatttatgactatttttacatttagacaaatcataccaaacaaataacataaattaaatagtacacttcaattttattatgtataaatcatgttgtaattgtgtatatttcattattaataaatattacacaaatgttcatttccattaaataaagacaacaacattcaatataaaattgtgacattagatggacactaaaaaaaattcaagtaaaatttgttactttttgtaattgtttatatctattttctcacatggacaaatcacaagttaaatattatgcttgatatattaattttgttataattttacatatttcaaatgcattctaagtaaatattgttcaatagttcattttcattaaataaaaacaacctcatttgtgataaaattgtgtcattaattgatattaaaaaaaagtgaaatttttcactctttaacaattgtttatatttattttcacacttaggttaatcattttaagtgaataacacaggtaaaataaacagttcgattttattatgaatgtttatgcacttaaatattatatttaatgtattaattctattatgattttgcatatttcaaatatgtttttagtaaatattatccaattttattaaataaataaatatatttaaaataaaattattacattagttaaataaataaaaagtataagttgttatattatttgacagacgtctatatttattttacagtttaatgaaaaataaaattcaaataaaaaggcacaaatcatatgattaaaaaatctatttattgaattgtttgagagataattataatcacttcatcaaaactaaatcatcaatcatcaattgttttccaacccctagagatgttgaagccaggccatcctcaatgtcatcctttgaccgcagaacctacaaatcacaaatatcatcagagaacaggattgtatagtctttatagataattttaactcttatattatagatagttttattttcgtgtaattatgaataaatatagtcaacaattctcttcttttaccgattctgaaataaattttatcaagaaataaactaatcttataactcataacttaacaatcaagattttactctttttattacatctcatacattatttcaaaaaaattgaatgaaatatataattatgttttctttaaaaaaatatatagttattaatcaacaattatatgtacatttttaaccctaacgtgcggccattgagactggtcaagtccatggagaagaaagaaatgcgaagagtaaacccggaggaggagataagaagtgagtaggtaggtcaaattttgcacatgttgagatgatagagagaagggaaagaggaataatcgagaatcgagatggtgttgagagtggcacgtgtctctgctcaagcgtggcagtgccttgcggagcctgagcctctgagcagtgagcagatattggatctgctttgctgtttccctctccatcaactcgctttctctctctactcctttttctgcgctcctcactccaattattcctatttcccttctcactccgactccgactctcaccgcgatcattcttccgatttcgattactattaccaatcctattcagactgaaaccaaaccatattaggtactattgcccattcaaatttctccaacaatgcttttattcaaattccatccttattgttaaattatgttgaaactcttttctaagcctgatcttcttgtcatttatgatttatgctgtaagaggaatcattttactagagaggaaggaacatctacatatttatgacttttatttttgctggagtgagttacaaatgtttctattaataattacggaaacgaattgctcattgtcttgagagtatcattcctcatctcagaataagggaataccaaacataataagaggagtgagactttcattcatttttccattactattcccatcaagcaaagccattccaatgaaccaaaagttagctaattggttcgtacagaaattcacagaatgccatttccacactagtgttgtcatcacaagagttgctatggttcgaaatgttatccaataacctgcattatgtattcaccttgattcattactcaatagatctaagttcttgtgactactcctgcagttaaacaaattttgacaagttgccagaaattttgagtttatatattaggaaatcctgcttaaatttcttcaatgaaatgttgtgttcttttgggaatttagattataagaaggattttttgctttgtatttgtccaaattctgggataatttgctgcgagttattgtcgttagactctttattatgtctctgctgactatgctttatgcccttttgacaggaatttgcctgctgaagtgatgtattgatagactttgggtggtaagaacgagatcctcaattgcagtctctggtttctcagtcagttccttatctgaggatgaaagcttttttcttttttttttcgaggactttagtagtgttcaagctgcctccattgtataaaagcatcttttatacttagattttgtggttgattgattgatctcttcacattttatacccttgtaaagagtgatttgtgagtggtaatatataattttaaactgcccttgaaagggagttttgtgatataagttacttcaaaactgaactttgtatagtatatagtatataccttcaatcatcacatatttctgaaatttttttttatacttttttctttcctttaacatgaggtcgttggagctcatttgctcatgaaggtaaataatcaatggtagcagtaccagaattcaaaactaggatgtgcagtattcctctcaagtgtttttggtccgaagaaagatgactattattctcaagattttgaatggaaggaaaaatgagagggcaagattttcttcctttcatttttgtctcctctccaatattagtatcaggataatctggaggatgttgacaaaattattctcaagattttagtaaaaaattatgtcttttaagattttagtaaaaaaattattctcctacttacatacaatattgtggtcatataacgtaagatctccatatataccagatcggggaaatgagatagtaaatgatgtgaattttattaatcacatcaccacttatgagaaattgaacaattttttttagaaagaacaaaacaaaatagatactatattatatagggataaaaaaaacttattaagagtattgaatttgactatgtaaaaagttattgactttgtcttataaataagattagtgtaaataattttttgtctagaccacaagtatttttcgttagagacaatgctatttaagtcaggtgtttaatatggacgtaaaattttctctctaattatttaacacaactgcattcctttcattagataaattaatttatttaatgaaattatttttgatacatatagttatatatctaaatctgaatagttaaaatatatggaatttgtattgattaattataatgataagttatttagatgatatgaaaatattttttttatcggtttgagtcttttagaagatgtaaaattggaaagtggaagatttaggatacaaatatttaattttatgttctgattttttggttgaatattaaatatattataaagattatatcttttggtaaaagtatattataatcatgaaatttccttcaaacaatatatattaatatgacatataatcagttttatttggtaacgtcaaatcatgatgaattggtaagtcataacatcgagaaaactcaaatggttgaaatacatatcttaatataataatgaggacataaattattggctaaattactgtccataatctgcaaattccagggcccaaaaggataaattaatgttgttcttgattgaggctcttactactatttgatttagtcattaatatcattattatttctgattacatttttcctccaatagtgcatgtactcttatagaatatataaattctcatcctttgtccacttttcacttcacaagcaccttctagctagctccatttagattatttgataactaaagtatagtagtatcatttttttttttttatctcaaagatgaaggtcatacttgccgtccttctaaactttgttattacttcatctaacttgtgtactagagtaaggcctgaggcaagtcccagcttcaatgttgttagctacggtgccaagggggatggcaaaagtgatgattcacaggtatatttttcctagtttcatataattgtctttataaatgaggctatatatatatatatatatatatatatatatatatatgatgctacattaaacctatttggcaatacttgtaaaggcttttgtgaaagcatggcaagacgtgtgtggtgcaactcaggagactgcaacacttgacataccgggggaaaaacattcatgttgcaacctgtgttgtttcagggtccttgcaaaccagcaaccattaacattgaggtaaatcatagtaaatgaattacttacagtacatataaatctgtgaatatatgcatatgccttaattcagccatatatatgcttattaaagtttttaattagcacatcttcaatggtgcaattatggtaaaattgcttaattcacttttaatgtgtcttacaatgttaggccttaattgatcagccaatatatatatgcttattaaagtcattaattagcacatcttcagacttcaatggtgcaattatggtaaaattaattgcttatctcatgcactcttagtgtgtcttacaatgttatttaagagctttcaacatccaatggtacaagaacataaaatgaattctacagttattaatttcacagttgtttgtataagaacttttacatcaatgttacttaaattctattggaaacggtttcataatatatatatatatatatatatgtatatgaatatatgatattctttattaattaatcctcatttgaatcgcagcttgaggggactatcattgccccagaaagcgttggcgcttggaaatggccaaatggcgataggaaatggatccaattctcgaacataaatggccttgtaatcaatggaggacaaggaggacaatttgatggccaaggtgatgcatggtggaatgatgtctctaataggcccactgtacgttgaaaattagtaaaatcatgacttaattactcttcttcaaattcttcataccccaaaatcgaatattaatttcattcattcaaatacatatgtgcatgcaggctcttcaattccataactgtggaaatctaagtcttagcgccacgactcacatcaacagcccaagaaatcatataagcttagatatgtgcaatggcgtaatcatttccaatattcgtatcattgcaccaatgcagagtccaaacaccgacgggatagatatctcagcatcatccaacatcttaatacagaattccaccattaaaaccggtgatgactgcattgccattatttccggttcgtccttgatcaacataagtcgtattttttgtggacctggtcatggcataaggtgggtttagttcaagtcaatttccagcttattatcaagtatatataacatgaattaagaaatttagtttaattgattaaatagagtatgtgagtgttatattctttgatatttcctttaatgataaatccaacagatttttttttcaataggggcaaaaaaaattataatttttacaaaatacataatatgataacaaaaaaatctaaaatatcaatatttttacaaattataattattctttaatattttcatattttaaaatttttgtatgattttttattgataatactataaaaaatagaaacataaaatataaaattaacaccaatttatctcttataaatatttacgttcatcttaaaaatatcttatgggggtaacttcaattttttatgagggcaaaataaaatttattatacatagacaaataaaaaaaattattatgcgtgggaataattgcccgaataaactactatatggatccgtggttcagtatcttctgttccttcttataagaaaaaaaaaagcgtatatagcatgacctttaactcgtggttaatttggtgaatcctagtgttgggagcctcggacgtaatggagattatgctagagttgaagaggtacgtgtgagtaattgcaccttcagaggaactgaaaatggagtcagaatcaagacatggacggtaacgatatgattgattaattggctctctatctctctctctagctaattgatactactattaatcacaattaatgcatattatgtgttatgtgttagggaggatccggttatgctaggaatatcacatttgaagatattgtagttgtaggggttaagaaccctctgattattaaccaaaattattttgggcttgaagcagaaagtagtggagaaggaaaagcagtgcaaataagccatgttacttaccgaaatgtgaagggaacttctagtgtgaaggatgcagttgtactgaattgtgatcccactgtagggtgcaccgacattgtattggatgatatttgcataaccactgaagatggcatgaaaacacaaggatcatgcaccaatgcacaagggatgtgctctgactgtgatccaattgtctcatgtctttccaacaaagattaatttgtaataaacttccactagtgtcacgtggagatcatccaaatttcttgtctttcaaactattgaaatggcatactgaattttgttgttttttaaaaatttaaaaggctatattataaattaagttcttcctttcttttgaatatataatattcttttctttagttgttgattttttttattcatttatttttataactactataaaagtaatgaaatatatatatatatatatacacacacctgattccatcttttaagaattagaccaaaggttccttatgtaactggtggcatcctccttgggttgcatggatgtatataacagtatgaaaagattgcgtttgttttcttttgttttttttttttttttggaaatcttatactttgcaaatatttgttgctcacttcgtacatcgcaaggaagtgttattctattgtacacggaaaaataatttcatgaaaaaggtatgattggaaattagtaaaaaatcactcacatggatggtgaaaatagcaattgctgatataagaatagcagcgcattagttgggctacttctgtaagtactaataagtccatttatggatgtgactggactcagtccaaccaatgagtaatatttgttttcattgtaggttttttttttttttttttgttctattttagaagttatgtatcttaatttcattttatgaattcatcttcttacttttttatataatgacaaaataaatattactgtaaaattttgtaattttatatttcactattgagcttattttaagttgagagctagtcaggaaaactaaaagaaaaatattaatcgtcctaggaaatgacatacaacgttattcgataatcaacatttaataatattagggcgatgtagagaaccagtgcatgcttcactaaatctaaactaaaccttattaccttcgagttagacagcaaacagataccactaatggcaatggcatgattttaatttttaaataatctaatgaattctgagtttggtttcattctgaggcaatgcaaggaaaggctacgttggattcaaaactctactaggaaatttgttggacaacttgcctattctttcgttagggtgtccagattatatgttggtcaacattgttttcagtttattctaaattgtatttgtgtcattattatgattggaatgataattttgcagtaaaaagaaaatttaaataatatttattcgttatatttatatagacgacagatatttaaataatactactttgttgctgtggatttcctctattttttaagtctactctcttcttcctaactatgagttgtttatttttttacttatttattaaatatatatttctctttaaaaaattaaatatttttctggcaatcatttttacttttaatgtttatgttcaaattttatccaaattacaaaataccttaataatgtttgatatatctaccagtgttattgaaataattttactttatattgaagtttttttttttgcaatgataacaataaagataaaatctaatatttcatgcatattacttaaacttcttttcactaggctggctcactaaaaaatttaaaaaccaataaatcgaaaataggttattattggttcaacacaaaatgtaccatcaaagataaaataaagtattaaccaaaatgattaaaatctaattgaaatttatataatcgatacccaaaacagaacatggaacatgtatgcctgtattcaatgttcatttcgttctctctctttttcatttatattttgtctttttcaactgtttaaactccttttttttgtttacttttatatatgctcttctctttgtaaattttgtttatttgttatttttcagaatttaaaaatgaattggggcaaaatatggaatttagcaaacgctaccatttttcaaagctccattgaccttgattctaaagcagggataatctttgcctgtgatatgggtgagtgatgcaaacgtttccaagggtttagaaccagatccacactcatatagttttatattcttgattaactttatgttggtgatcaagtcgtctatacaaccatatttcgtcaatttgttcacatgaaaagactgatgaaaattgaaaaatgctaatatatatcagtagcgttttgagtgggtaatcttttaaaaatgaagtgatgaaaacgctaatagtattaacgtttttatacacgtagtgtacattgttaatctctgaaatccacgtgttgtccatttgagatatcacaaattaacaatatcctacgtgaacaacatatggtgcagtttatatttagaaaaaaggaaatagataatttctggaaacactccattgactagcgtattctaccgttaatttccaacgtactttaataatacgtttcaaaaaacaatcctaatctgattaaatgtttgtaaagtgaaactataccttactatgatgaaatgatcaatcaaccaaaaacaaaagaaatggaacatactaaaaataaaggcccaattataatagtaatatcacatcccaatgatgcacctcattttctttgttttagttgctattttcagaaattgggtgcgtatttaattcagaatatctttaatttttagaacttcaaagaaaaacatttcagactttatttttttaattacctacatgcttggagagcttttctttgtttttgctctggagtaagaattttttgcgttggtggagtgtgttgtcccaatgtgtgtggatgtgagctaccacaaaaactcccttaaattacggtccaatatccaaattgattcagagaagaaagtaatcctagccaccgcagaaccttcaaaaagcatttggtatcttctatgccttttcaaattcaatgatacaccattaggggaaaaaagtaacgtttaagtcaatcaatcataaaatttatgagtaaatagtttattgtaaaaaaataatattatcattcaattgttaattgtcatatagaattaatggtagtgtatttggtttgcggtttagacgtccatatgagttttacttctcataaaaatcattttatagttgaattaaaatcttaaacgtaatttctattcaaattgaagttaagtttaagttattcttctattattttttcattaaacgtaaaagtttcaaacataaatcaagttatattaaacttttttttactaaattttacaaagttggatcaatcaaatttgggtttctcaattataatccaaacacatactattttaacttttgtgccttgtaatgcatgttttttcaattagttgcactcaactcaactggcgttgaaaaaactattactctcacattgctttggtttttgtgccataaaatgtgttttttcattgaatatgaatttaaacaattaactaaacacacactaagttattgatcttaatcgaaatgagttggaatgcttaagtaaaatttaaatttgagtatagtaaataaaaaaatatggttgaaaagttcaaatttttttaataattttggttatgaaagcaataataatttatcgcaaaacaaaaaagttcatgactttttaacaagtaattcaaataactcataagaaaaatcctacggcaattcaagacatatatatcttcaattaattagaatgtcactctttcaatcattgaagtaactgtgagcataagatttccctcttatccatgataacccgaacatatatctatcgaagtacacattaaaaaatattacaaaattaccaacttatgatagctaatagcttacttatttaatagtacgatagatatatgtcatataaaattattccattgtgcaaagtactgctttaaataacattaacgcaaatagcatatgaggaataaattgtcaacatccaatgtcaagactcaagaacaagaatattgttttcattctctttcgttatgttttcgatagttcattcatttccaaccaaacctaccatatttgctaataatcaagtgatatcccaccttgttgaaatgctttgctactttctcagatctatctaatctatagtacatataaaagaagacaatgcattttgtagtcatcatatagagctgacccattaagcactatgatcacgattccttataaacttttttttttcgacgggtaaaagtaaaacaatagtttgcaaacttaaaaagatgaaaatatgtagaccccaaagaattgttttgatcaaaatttccagcttgtattccttcccttttttcatatggaacatatatactatattcttctctaatactataagttatttcatcctacctttaagctttctaggaccatttgcaaaagtctctcacttgcccaccattataggatcctaaaagcgcaataattcgataaaaaaaaagtcgattttctatcaaaacctttacggccttgctttagtttttatttatttataacatttgtttttgtggttcacattaatattgggatatttgaacgagacataattcatatgaatctgattttactatggagttgtgcaatggaaatgcgtccttcagaagaagaacacgacactgacacgagaacatgctctgtttgcacattctagatgatgctggaaaatcaacgctgcaaatatagttggctatgcataattttaggtttattcattgaaaggcctatctttatatgtgcaataacaaataaagcagatttatatatagaggaatggtgtaaaggaaaatgatgagagttattttaagatagaaataaaaaagagaaaaaagcttaaagaagaaaaggagaaagatagagaaggaaaaatgagcaatcttttgtgtcatagttgtaagaatcaaatccaaccaagattgcatccttattaagtgtgttttgatggtgtagaagaaaaaataataaagaaataaagaaaaaatatttaaattaaaatagaaagaggtgaagaattcacgctatttttaaaaattattcttaaataataattttctcttttcaaccaaatcattcctaaatgaataattcattcgacagcagcataatttaactgatttgtaaggttaggtcagttttaattgttgctagcaaattagtactttatactaaaacaaattagtactactttttatttttaaaaatagcaaaatactacttttcataataagacattcttatgtttgtttgtttttacatgctaaaattatctatagaaaagataatcttatttaagttgaatatcataattataattagtaaatatctctttttaaatgttgctctaaatattttttaattcttgtaatttagttttttttatttttagttcttgtaatattttttttttaattctcataaattatgtttttttcatcattattacattttagataatatgttttcagtgtttaaagcattacttaaaaagaggactaaaaataaaataatataatttataaaaacaaaaaattacaaaaacaaaaaataaaaaacactaaataacaatgaacaaaaatatatttaaatcttaaatattgattaatgtatttgtatattcaggaatcaagcttaaaattatattgactaaaatagaatcattcatgttaattaatttacacgttagatggcaagaattctatttcagatataatttttccaaaaaaacttttaaacattatttactcttaaataggatgagtttactatgacactttctacgacagcaatgaaaatttgttaccagaagttaaaaaaatgttgcctagaatacaacaccgatttttccacatatataaagtgacaatgtggatgtatcaagagaagatatgaataacacttattgaaatttaaataacagtaagtttaagcaacgagtttataacatagacttccatccaatttaataaataacaagttcaagtttgtttcgccagaggattcaagtttttcttcatgtatttcaacaaacaataaaaataaaaatactaagttgctaacccgtcagagttccaataataagatgttttctgttttttataaatagaaatatctagctgaatatttagtatgttaattttgaatcaataactttttttaaggtaattatgaaagaaatatatttagattaaacaaaagagaaaataaatatatatatatgagtatatctcttatttacaataatattacctttagattaatctttaattgttggactaggatatttatttatttagatctcgttaattattatgcacgtggttgagattttctcaattaaaattctaaattaataaatctttaataaaatattttattagattcatatattaggtcaaatatattattaatatatgaaatatgtatcttacaattcaaacgaatgtaatgaaaaacaatatatatatatatgcattatttatctttaattcattcttatttatagctattgtaattttgtaatattaattgattacatctttacatcatattaataattatgccatggacaattttaagccatatgctatattttaacatatagttaaagtgtctcattttttattttatattaatagaggtagtaaaatgaaagtatgtaaaataaataacatgaaagaaaatttcattatcattaaattaataaattaatattttattcataaatttcatacgatataaaaaaattataataattcacccaattaacaaaaattagaacttgttagttcataaaataaatttgatgtattatgctatttttttatatcagagaatggacgttaaggatatttaaaaataaagttctcaatggtggaaaaaatgttctaaataaaatattaaacacgcataacactaatgtttttatcttcccaggacaatcctgtgtcaggtcaaagaccaacattggattccttttaaagattcgaagatccaaccgttgcgtaattcccatttttggattatttttaaaaatttaccattcaataccgtacagaaatggattcagttctgtgatggtcacgggcgcgcctctgagtgtgatgatgagtcgctgtacacgtgtagggtcagtgatgcactttgggtgaatgtgaatgggtctaatcaccctggacatgacgaaatctctctcacttacccttgctactacttctgcactggattatcatatctcaaattttccatgatcttatgttaaattcactttactttttttggattaaaacttcattgactatgattcattcatatcaatattattacattgttctagaccaaattgatcttaaactcattaaataagatcatgagttcaaatttaataaacgttattataaaaatagtcttcattataattagtaagaaaaattctctaactgttattaatattttttatcctatatcaatgatagcggaagtttcttaattcattaaattagagatctatttcaatctagatacataatttttgttgggccaacactttttgtacacataaaaatcaaacataatctgctaaataaatcatttactaattgtggtggaagtgtgtaaccttacaccactaccgaagctctatgggttttaaaatattagtataatgtataataaaaaaatgagaatgacttaataaaaattagtataagttaaaaaaataattgatatttgattaattaattatgttataacatataatatgtttatgtatagttagatgtcaactataaatatttattaataactaatatataaaaaaattaatgtacaattatagataatatatataatagttaaattatattcataaaaaaattgtagatgtctacaagtctttatatacggttatgactatatataaaaagatatgccataaagtttatgtgggttttatcttgttgtctggttctctctctcgagttctgttctgcttattgtgagaaatgttactgttagtgaataagagaaaaatgtttttgtttacaattaaaatagggaaattttaatgttctctttcattttgaaagagattttttttagaagtgtatataaaagaaataaaaggtaaaaataattatatataatgttaaacgtcatataattaattgattttgaaataatagaattattacttggcatgctaaatattcgaggagatttgttcttttatgtttttcctcttaaaaaaataataaaatataatatttttatcctatcatttatatctccttccttctctcttctttttaaaacaacaaagggattagtccttgtcatttttttttacaaaatagattaataacgttttttttccaaaaaatataaaaagattaaaatttcatatatatatatatattataaacataaaaagagatatattgttgtgtatatatatgcatgagggatatgtgccaaaaaaaaatatataaataaatgatcaaattatatcattattattttgactaactattatatcattcattaatttttaattaatatattttagattaaaagttttctatagatcatatatgtaaatttatgtattaatccaaattatttactattttattatgtagattaaaataatttaatatatttttttaaatatattaaaatataataatttgattattttattgattttttttataaattattatgtttaatttaaataaaatttgaacaaaataatatataaatataattcaataattgaatgaataaaatttatattttatatcaagttataaaataatgtaataattatttaagttatattaatataatttaattttttctctcgtgttgtatagtaatatattagtttttaatactcactcttcaaataatataacactgtattgtttactttttgtgtgtttatttttttctttttcccttctcccaaaattttcctacccaaacatagctaaggcatctattatgtcattgaaatagattttgtcgaaacaagcttaaacaaagctgaggcatttattatgtcaatgaaatggattttgtcaaaacaaactaaagtcaattctcgatgctttaatgccagctaaagctgtagtacacacaggacatcgttagtcagttgataaagagcgatgaattcgcgagtgtttggtatatataacttatttttacaaatttatcgacattgttttaaacaatgattgtttcccaaaacaaattaaaaaaatgtgtttttttcagatcattttttttttttctttttaaatttttagataaaatatgttttttgtttattaaatatttcaaaattcaacttaatcatataaaaaattaatgtttcttcagctttacatttcagttcccaataaagtacatggttttagtttatgataagagactaaaactacaccacattttataaatgtagaagttaaaaacttatgaccttaaaattggaatttttttagggataacaacatatttgatcatatttcctaaacaataaaaatatttaacataacaaattactcaaatgagtaatctatagcatttcgtgtttactaattgaagctatatttactattatacttgtgaaggtgtaccggatttcaaaactgaaagaaaaaaaatgttaaatgaaaatgaacccgagtcatattctattcataaagctagtaagtactcagtactcaccacataggttgttagaaagaaattgtgctaaagttatttgagattatgaaactgatttactttattacaagctttaattttattttaacatattttttaatgaaaaatattaaatttataaacaaagtttcatataaccaggggcaaaattagaagaaaaatgttagggggccaaaaaaattaccataggccaaagactaacgaacttaatgcttagggtcaaggtttgtggggacgaatttttattttaattaactataaatgttggaggctttttgatatttgaagaacgactgtccctgtacccttaccctagttctatccctcaatatacagttttttttttttcatttttttttatggaattggtgtttacttaaatagttaatcaaagtgtagaataagtgtggaaatggatcttttacatttcaaaaattaactacacctaatggtattcttatcctattgttttctttatacttataactttttatgatagctgattttgatgattgtagttatttgtagtttaaattttgggatatacatgttataatatgaagtattaataactttaccagtaactaatttttattaaaaaaattgattgattatttttagtaatttttttttcatctttgattatgggattttaattaaatgatatgaacttagtttcatttgaactcatgacatgtttggtttgaaattttgaataattataaaactgcagttgtctgctacaaaattaagttccttcaatagacagatatttaatatttttttaataagtactttcaaaagttcctttaaagattattattttatttaatattataatttaagcacgcgtcaagcctcgattattaatacagtaaatttatatcaatttaaagttaacaatacagtaaataaataaataaaaactttatttataaacctacattctataggacagtggtctgcggatctagaaactagtgctttcgtttgcatagaatatattatcacctgtttaattgtgatcgacttctaagctgaatgaaaatgtaacaaaaattaattaaaaatatttattatataaaaatatataataattatattttttaattatttaaaatcaaccctaaaaactgatgtgtattcctatcatcgcaactattttcttgagatgttatgtctattgggtgatggagaattgcatacaattccttaaaaaatcgaatacgattcaaaaggaaatcatattttagaattggaataaaggaatcattgtctttagattaacactaagataaataaatgaaacacatggccgtggatgcgacgccaagttacacgtgattgtctcagagaattgtgtaattaatatgtgcatacaatatctgcaaaatatttttccatcggattcccttgtgaatgattaaatataacactttttttttttgctgagaaatggacccacttattcatttatcaaatgatgaattgttgattgacattatcctttttgttagagtggaagaataagagtgggtactaattgcagtaatgagccaaaaatataaaatactaattattattttctttaaaactgagcacagcgagaattaagtgacctaaggtgataaaatactgtgataaattaagtcatttaactcattaatttattttaagttttcaacccaccaatttattggattgaaggtgggacaagacgagttattctattcagcctattaacattaataacatattaaaataactttataattttatataattaaaaaagaatgaattataccctaaaaataatggtaatatcatgaaaatgtataaataacatctattgtcttattttcctcataaaaataattgatttagtatcatcataaattaacataaattcactctctattaatccactcttcactaatgggttaacccacctcgcacttatgataagttgaatgtgagtttttttttttttaggaataaataggcttgtgttattcagaacaaataacagaacagtgtacatcttgcactaaacctcttcaagccaataattatctctgggagttttttatagttgtgaatttaagcttaatttaattaaaattggtttataaactaaaattgttttttatttatatattttatcttgatgttattctataatgattttgatatcattttagaattataaattttatttaactcaattttataaaattattttttaaataaaatttattctaacttatatattctattttgattttcagtgtggttaacgtgggatttgagttttatttcactaggttaatttgttttgccaatcataagataatcggacatgtaaataataaaaatagcaattaaatttttaataagtgattttttttcaatgaatgaatctaataataatggaagagtaacggatagtcacggtcagaacttgggacaaaagttgctcctccttttacgcataaaaaggaaatttccagtccttttgttgctaaagaagggaaaaaaaaaaaaagaaaaaatttcatctcaggttgcctgaaaagtgaaacccgtttaaagcaacaagaagtatactgaaaaaaaactcttcggttaaattttataaattaaaaaatcaattaaaaatttaagttaaatattacattatcttattttttattatcaacattttcattatttttatatattcacgcattttaaaagccttttcctttttatttttatttttgaaatgcataggataaaacggtaaaagcggattgggtctggcacagtgccacggacacaaacactgaaacacgattcacagttcacaaattcgcatcagtatctatgtaaacgacaaaattaacacaaatataatatgataggaatgttagataaatcttattttttaagtatgtgattataaatttaattaaattatgtatataaaaatatttattaaaatagattaattttgaatatattattatctccaagattaattcttaatttttggacaatgatatcattcaaaagaaaaaaaataaattaagtatgattattgcttaaaaataacaagaagagtgttcactgtattcatgaaaattataaagcatattcacactcaatctgtctaattttttttttatttttttttttttttttttttttttttattttttttttttttattattataaaaaattacaaaaaataacatttaaaaaaaaaggaaagaagaaggagatgatgatattgttaatttgaaagtgagaggaaaatgacaagaaagagggagctagaaagtgacggtttttgtttaattatttaatgaatcaattattcaatataatatgatgatggaaagtggaagggcgagagagaaaaaaaaagtttttttttaagaaagagggaataaaacaaaagagggttagcttagtatgactgtttggtgtttagtggctgcccttgctttcataggaagtgagaaactaggctagttagtcccattggattttttttttgtggctgaagaaggtgaaaggggggcaagtttcactcttcaagggttttgaaggtgtcaacttgcgttttgagactctgaggttgttgaggttgaggttcaagctgcattttttttgaagggtggggatgggctctagttgtggttgtggtgtgactcttgttcttgttttctgcttatggggcatgttgatctccctctcttctgctgctaggctcagtgctacaaggcagaagcttgaggttgctaagcatttgaatcgcttgaacaagcctcctgttaagaccattcaggtctctctctctctcgttctttctctctctttacttttaactttatgtttgtatgtgtgttttggggtgttcttcatccacccctattttggtgtttcttcttgttttaatctgtttggcacccaatgaaatggtctagttttgtgaagaaaaaaaaagattactttttttttgttttgcccttgtttgctggatgggagatgctactgaaatggttatgtacctttcaaacattttcacttaaaataatccatcttgcaagctgctgctaccgattttttttttttgtaagtattaggtgatttcttttcttctctttgttttataaaatgtagatcttttatgtggatgtgctgatttctcaagccaactaaaatttccctttaattttttttctcctacttacacccctataaaaaaaatatatagcccatttgatgggaactattgattgaattttgaagcagtaagtcagtaactagaaatactgtaagaaagaagtaggcaatgatttgccttttttgtttatttattttccctttctaatcagctactgggttttgagtaatagaaagatattggtttcaatttggtacatagtatttcaaatgttaacaatattatgatgtgattttgtcaatgttgcagagtccagatggggatacaatagactgtgtgcctgtttcgaagcagccagcatttgaccatcctttcctcaaagatcacaagattcaggtccattttcctcactcaagatctatttttctgttctttgtttttcttcatttttatgtaattttttactaacaccatgctttgatttaatagacaaggcctagtttccaccctgaagggctttttgaagagaacaagttatctgaaaagcctaagcaaaaactcatacccccatcactcagctgtggcatgcgaatggtagatgtcctgaggacacaatacccgtcaggagaaccaaggaagaggatgttctgagagcaagttcagtcaaaaggtatggtaggaagaagcacagagcaatccctaagcctaggtcagctgagcctgatctaattaaccaaagtggtcatcaggtaagaactgttttgagtgccttgtattttattaggttttcttgtttcctcttttaagtagtaaccttggtctaatctcctgatggtgtttttgtggggggttgtaatcatcagcatgcaatagcgtatgttgaaggggacaagtattatggagcaaaagccactataaatgtgtgggaacccaagattctgcagcctaatgagttcagcttgtctcagctttggatattaggaggctcatttggtcaagatcttaacagcattgaagctggctggcaggttctaagaaataagaatcactattcatttataccaagtgtgcaatctaagtactgcccttgactctgaattataatgtaaattgtaatgactgttgtgcatgataacaggttagtccagatttatatggtgataacaatacgcggctattcacctactggacggtaagcttgatgtatttttttatgcatggctttgattttttattttaatgtttgtgttatccaatttattattattattttttttatcaaactcacttgctgcattttgcagagtgatgcatatcaagctactggctgctacaatcttctttgctccggatttattcaagttaacagtgaaatagcaatgggtgcaaccatttccccagtttctgcataccgaaactcccagttcgatatcagtatacttatctggaaggtaaaatcccaggaatttcctggtttttaatctgcaaatggaaaccacccgttaagcatcttggggtctcatctcattaatcttccaactaggtgtttggcatgtggaccatggtaatgtcccccctagtgtttggattcttggacacctctatcatctttcaagcatttgtatgaaacatgatatgtggagatccaagcctatgtttgctaattcatagctaatatgggaatcttgagtttttaccgtgttcacttattaactggccagtaaaagctttttttttacctagtatcaatagcattcttcgtggtagtggcaccctagttagaatcatctttatagcacagatccctggtatctcctcccagtttcttttgatcaggatatggaccccaattttaattgatgatggggacactgttaacaattcagccatcaggaactttgaaaagtcatgaattgcttatactcattctataaatgcacagaacacatgttgtattttcaaccttcataccctttttaatttacacacaatgctcttttctgttggtgagctaaacaatatacttttaagtcattaactttgttactggtactaattagttatcttttttctatttttcctccttgtaggatcctaaagagggacactggtggatgcaatttgggaatgaccatgtattgggatattggccttctttcctgttctcatatttggctgacagtgcttccatgatcgagtggggaggtgaagttgtaaattctgagcctgatggtcagcacacatcaactcaaatgggaagtggtcatttccctgaagagggttttggcaaagcaagctacttcaagaacattcaagtggttgatagctccaataatctcaaggctcccaaaggcattggcaccttcactgagcaatcaaactgctatgatgtccaaacaggcagtaatggggattggggccattacttttactatggaggccctggtaaaaatcctaattgtcaatgagtaatgatgagaggaaagttaaaaaaaaaaaaaaaaaaaaatgcaacctctcttgtatcattgaatgctagtgttaaagcccttccttctcttccatcttgtatacccttttttctgtagtggaaagttttgactttttttcttctaatattgaaagattctccatgtaagctagtggagaagtgtggccaagtttctcaaaagcctaaagaccttttataacatctttgtattttatttgtttgtccactcctcctccctctataagagtgtttgtcaatggcaatggagctggtcttttgtgattaccaaaactagaacttattacttactctcaaaatgagtcactaatgttgttccattaattttaactgattattatatggtacctatggctatggccatgctttgaatgaaaaatgagtcaaataaaaaagtgaaaagtactgtgagaccagtgaaagaaaaaatgaaattgtattattattaaactttggacttaaagatgcttgaaaagggttgcatgtcagtggctgacagtatatttgtttgcatttcaacttttttcgtgaaaagtgggcccacttcttccaccctatattttcaatcgctttctccattctgcaaaccatcgttgtattaccattaaagcttgtgaacaagcggtgctaaaagtcgtaggtccagctcctttatatggatttagttttcttgctcgataacaaaaattataattattaattaagagtcactaatattatgtcttaaactaaaaatagaaattttaaactctgaaggattggtttagcagtaaactgatactagcaagttatgcaatggattatgtggagacactttttaaagcttttagttatgtaagttagttggtgttaaattgatactaggtgggtgttaaattgggtattcctgcctcctattttttttttttttgtaaatgttaaattttattaatctaatcagattattacacttactaacttatataaagtgtaatatttataacttgtaaagaattaattactaagttataacaaaaaattatagaagtatgttatgaaaataattaaatatttttttccatgaaacttagtatttttttttttttgtttgttttacaaaatatttttttatttttcgttcttaaacgttttagataatgttttgaataataaaaaaattttaaacagtaaaaaatgttatgtaaaaaatttaagaacaaaaataaaacaaaatattttgtaatgataaaatgaaaaaaattacaatatgaaaatgaaaaaaaatgctaaattgcatagatgaaaaatatacttaaaccaaaaatataatacaaaaaaagtttaatttctagacaatctttgtcattaattttttacataaaattatttaaaaattgaatatgataaatcatcatgttattttttttgaaatagcaggcaattcacatttgtgtcatcatgtatcatgtataggttaaaatataagtatggtccttaattttttttcttcaattgttccttaactttcaaaagttctaaatggtcgtaacttatttaatgaagactctttagtcattctattccttacttctcattttttattttcaaacatgttttgaatcctttattaatttgattcaaaatgtgaatttgttccattagattcatctgcacgaaaactataaaattaactaatgtttaaaaaaagaatcataaacatagtgaaaatcatatgaaaagtgagtcttgtgaacaataaaaaaagaatatgatattaaatttcttctgtttgatacttatgaaactcacttttcatgcaatctttaccttgtttatgtcccttttggttcgcacatgaattgattctcatagttttcatgttaataaataatgaggcaaactttatgccttgaatcaatcaaaaaaaggttcaaaattgtgtccaaaaattgaaaatggtaaattttaaaaagactaacatgtcattaattaaataagtaaggtgatatttttaaaaatttaaaagtttggaaactaatttagcaaaataaataaattaagggagcatttgtatattttatcctcaagtatattaaacaataggttctcagtgactcattggattttcaggtgagttagctctcttttgaagataccaatctgtctcacactcttacatagacttaatacattggttctctccatcttacggccaaatgaactagtatgcgggcttagtttttaaaaaaattacaatctcaaaataaatatttttttctctttaaaaattaattacactcaattatatatatatatattttttttaaaactctcaataaatctttaataaattctaattataaagttttaacacaaccaataaattttcaacataaatgtaaagaaattttgaattgagtttttaggattaattgggtttgattcaacttggtggctgcaagtttgcagtccaactcgcggatcttatggtccaaattcttaaagttcgtgaattatgaaggacggatctaaaattctgcataaccattaattttttaaaaaaatggtccatgactcatgcataccctgagctccacaaaccgattcatagacttgaacctgtttacccatccgcaatggtaacatgcaagctgtagggcgttggcagtaatgagcatggctgcgacccatatcgttcctggcatatatgcttcgctaatctatagaaacacgttgattggacaatgttctgatttctgaccaaagctagtccccaaatctgcacgagacaatgagttaggttacgacctaatctactactcttcaaataataattgatgtaccatatcaagaatgtacccactactagtattaatttgtgaggtattgtatgacttctttgtaaatattcaataaatttgattatgaaatttattttactccacactgttttataagaatccaaaagaattgtcttaactatttgatcgagcgttgcattgagtcaattacatttaattatgagtcaatccttgcaacatgcaaaattttgatcttaactttttcacttttttcgttgtcattttttaatccgtatacatcaaagacatctactagtgattagttaatcaagtgagatactccccaaataaaattagctactttatctctttaaatcttgtacacttttgaggatttgttgcttatttgatatgttttatagagatttgtttaatagtttaacactttgaattagaacatattatacaaattatattaacttatatatatatatatatatatatatattataacatgttatttccatacccatgtaaccggagcagagcctagcctggcagtgacagtggtaggtttacatgtcggtgatggcaagcacaaaactcattgcaaacccagtgatttgtcagcggctcaatttggtgtatggtttaggcattgtttagtgttattggttaatattctgcacaaattttggaaaggggcactgcaatattttctcaatgtgtcaaacaaatgcaatgaaattgaatacgatcagaatcaacattaaaaaaacgtaggatataatttcaaaaacgaaattgctttccagttctgtgttttttttttttttttcctgttacatatgtgcacacagcatgtattggagtgccattaaaacgtatatagatctatagagtatatacaatcttctatcattttccatattttgatgaatagtatggttctgagatggaacctatgtttggaacttgagaaagagagtggaaagaaaaaaaaattaaattgaaatgaaagaaaaaaaattggattcttatttctataagttaactttctttttctttttaatttttcttaattaaaaaaattatatcattattcatgtttttttctctattttttttcttcttatcaaacatattaatagattttctaatatttctaataattaaatttaacagattttgagcgggaatgaaaggttgaagattggacaaaaagttaacaataataaactttaacattgtgactacaaggattaagagtgttcacgggtatggtcaccgtgaatctgaactaatctgaatcgattcgaacagtttgagttggtcatttatgtatttgagtcaaaatcgaatcgagccgaccaaaatcattcatgtacgagttgggtcatggatttagatttatagatcgtgaatccgtaataaaaatataaattttattatatatatatattaaaatttaaaagctaaaattattttgacaataaaaaaaaagtgtggtactgtaaatgtctaggtcgaatgaagggctacccataatctctcatctcatctcatctttactgtgaaggtgtggtactataaatgtgacatgtttaggtttttttttcttttgcgcttatgtgttctgtctcatctcatctcttctttgcagttctgcaccagctccttctctattatctctcatctcatctccttctctattatctctcatctcatctcatcagattgatcaaacatcaagttttattctacgctttctttttcttttctaagctctttaacttctcgtgatttttctggtttgtattcattgagattttgatggaaacagggatgagaagaaaataaataacttcattgttgaatgttgactcgaatttttggttatagcaaagtttattacaagaaattaatttgtaagaaatagttgtgattcagactattataataaattttgttcaaaaatcttttgttttaatttatattataagtctattttagaacattatgttgattgtattaaatgaatcatttttactattttcatacatttgataatattgtgttaattgtattggatatttgaaaaatcatgatataaaataatagtttaaaggaaaaatttaaatgcataacccgttgacccgaaccgttcatgaatgggttggattgaatttaaaaaaaatcctgaaaatcgaatagatcaaatttaattagattagatcttaaatttaactaaaactaatctgaactaatccgcagacaccctatgaatgtttagcctaatctttgtgacaagggaatattctagccgaacacgagaaatttaggtaatgtttacgtaaagattttaatattcaactcagtgcatacattacatgatacaagagataaaagttagacaacacctccattcctatggaatctatttatattatttctccttcgcctattgtggcatttcctcatcaataatggtgtgacaattgcctcactaagcaaatagtacaaagatttattaattggatttggatcatgataaattatttacattatattgtaattcgtccatgatccaaaaggttcttaatgaggtgcataggaggtttgattatcaatcctagtttattgggtcaactaaaaaaaaacaattatcatttgtcaataattaaaacaatcctaaatttattggatcaactcattggctcattttttgtatgtgatgtgtccacctcttcaaatagggatcaagaacaattatccccaaatcaatgggcttggttataatcgttcttctaataagtttaaggttttttcttagatttcatcttattttagataagatagactcttctgttttttcgactctagacttctaaaagtttttttgtttttttgtttgttttaggatttgacagtgtgaatgtgcatttgttttgatggttgctttctcttaacgtttttggtttttgtccaggtttcttctttttatattgcctatctttctttctatcattcttgttttcaattttttttagttgagctgggttttgatcatccttttcattttgctagcttttactctgcttctatgtttggttaataaaagaaagtgaaaggaaataaaatgagaagagaagagagtgaaaaaaaaagatatttacccattcaacatctttagttataacttaaatttagattttttttcaaatcaaactatcattaattaaaaataacaatctattaaaacataaattattcatcataaatctagaatataatttacgtgttaaaatatttatttactataaaattaattataatgtaatttatatatttagaaatatttatttattataaattaaaaaattcatttcataaattaaatatttattatgttattctgtgctctggttgcttataaacaacatgtggtgagacccatgaacctagctatatctcagctcattgttcaaatttcatttctacttgcatattttggatcaaaagtactacaaccatatttcactaacttagtctcaacttcaaggctacctccttgtggtttaaagtttccttgaactcacgtttcttatttacaatacgacatcattgtattgactaggacttttccatgctctttttgggtaaatttaatgattttaaacgtttttgtatttaattgtgtatatgattaaaattaaaactattttgaataacttctcatcaaatcattaattttactttaaatgtattttttttttctgattgatggtaaacaaaccaaagtaaatcagtaagtaagaacccaaaatgactcgagaaaaaaaaatatatcgacaaaaagtataaaaaaaagtcataaaaaatgtaaaaacaaaatgatcataataaaataaaacttattttcgaatttcgacagcaatgtaaagcagcatagtactccattattagaaccttgtaaagcaccaactatagagactcttcatcagtaaacatcaaaatgagtttctaataaatttccgacaggactcgtattgagaatcaatagtagtatttttcttctttttttttttttttgctgaatagaagtcaattagttgttgtaaaaaggaaaagaaaaacgaaaagagaaaaaaaaaaaccatgaagtagatgtacaaaatgctacacattaacaagtaaaaaaactgtacaaaaagcaaaaatcttagaaagaatgtaatgaaataaagcaatcataaagagggaaactcaccttcaatgtatattaactaaaaggattccaaattaataatgaaaaacttcatattgaaatagcacaactaatcaatatgagataaagaacattagataataataaaaaataaaaaatatgactgatctgtttagggaaagtggaagcctggagaatataaaacattagctagagatataatctaaaaaagaagaaaaaaatgcgattatataaagctgtagtaggatatgaattaatgacagagaaagagaaagaagacaagaatgttttacaataatgttttggaacagtggaatacaataaaatgaaagtaaaagaaaaataaaaatcataagtataaaggaaggttaaacattttgtagaaaatcaaatgcacgagaagagaacatgtgctatttcttaacaaagcataaactatatttgatagaagttttttttgcggaagatattttatagaagttatggatagttaaataaatctgtggtttaaataaaattgaatgtttgatcagataatatttctttggcagcggattagataatattgaaagcttaatactccatttattatttttgaaggagaaagcttaatactcctaacaaataacaatagatttttttttttttttttttataaatcgacgttgacaaattctagtcaaatcataatttttttttgaggatctagtcaaatcataatcaataccagtgtatttaaagaaataattaattatagcatccttaaaaataaaacctaggacaggagcatctttaaataaacaaaaaaaaattcttcgattaatatctataataatagaatgataaagaaataggaatctgggagtctcaatgattaagaagagttggatttaaaaaatcaacgagttagaaaaaaaaaaaaaaagcatatgaattaagaattactgttgacggccaccctcttgatttcgtgggcaaacatttgtttttcctttttaattttcatcttctatctcagtgtttgtttgtttgtttaattttttgatttttaaatgttccaagagaccaagacacaatcacgggaagtaaatgaatgcatagccaccaagaatgtaaagaatttcatttaaaatgtcaaattccaaacttttaatcaagtcactattatattattgactttctcagccaatatcttagcttattttttaaggaagcaacaacgtttaaaaaatattaaaacttttattataataataacacaagaattatttagcaaggagtacctttttttatgttaatgatattcaatattttaatcaatatttttagaagaattaactaaaatacattaaaagcataaaaagaaagtaccattatagtaaatttgttattctataataataaatatcttaaatattatacttaggatgatttttgataagatataatgcaatttttttatattaacagtatatgaagattaacattttctttaaatattcgctaaaaattcttattttatttaatataagttgacaatatatttcttaatccattatttctaacatatttttattattaataaataaaatttaagtacattatttaaatgtcatgctcttattttccatataatgaattttatctattttaaaaaaaaatataaatgccgaaaaagagttgaaaagtgagtcgctgctggtccagaaaaaactgttaaaataaataaaaagtctcaaaccggtaatataaaaacgttaaagcaattctttctgcacattatttgtctttactttctctctcatacgtagaggagagagaaaaagagagaatttaattttatgtttacttgatatagttgacagaggctgagccaagagaagaagaagggtgggtgtagtagggtttcaatcttcattcttcactaatccttttatacaatccgagtgtgtgtaagaaagagagacccgaacaaattcacaaacccttcttctctctttttttcttctttcaatttcaattttcttgttactattactaaccctagcttccttgaacactcactttgaaaccctagctgcttcagccatggctcatttcagctgaattcgccactatgttgctgccatttcaattcacaacagcgaggtaagttcaaaacccgttcgttccgtttcggcattctcatgcaccgtcgcaattaacgctgttttgtttttctttggctgtaatcaggtgcatgcgcgttgtttgagtggaggagggacaggcatggaccgtgcgcttctcctcgcgtgcgtgatttgcgggatcctcttctcggtgttgggcttggcgtcgttcttcatcctttgggctgtgaattggaggccctggcgaatttataggtatctcgtcaagattctgtgtttctgtttacctgtttttcacttggtgctttgggtttgtttgtagttttaagattaaattgccatgctgcaatgttaatgctgttgattttttgtggcgcatatggattctgttgctaaaaattagtagttgttttaaagtattttataatttgatatttactggcattggctgctgtgtactgtcgctgaattgcataactaattagctacatttgtttaacaacttgggaattaagtgtgaaccattcgggtgctttttctgtttttatgatggtctgctaagtatggtggttttgtgccgtttttgaactgtgtgagccggtaacttgggaattctgtacacgaggttgatgcttcctagtcctgagtgctttgctttcttttactttgcactccttttttaagtaatttggtcggaattcacatgatgatgcatttcagtaacgccttaagggctagtgtttttagtgaatgtatcacacataggatggtgccaaatgtaagatgagaagtctaacatttaaacattcaatgtgatgtacttatggacattgtaggaaataaccttttttttttatctattaatcaatgtgtttgttttaaacttaaaaaaagaaactttataataagtgcttttttaagaagcagataggatttgcctcttaaaaaaagcagaaaactgcttattttaagtacaagcagtttatacaattacatcagaaaaacagaaatctacttattttaattgaatttcctttgtttccttaaacctaaaccctaaacctaacctaaccctaaacctaaacctaaacctaacctaaacctaaaccctaaaccctagaaaaaaggacgatttggatagagttgtggaaattctcatgaaacttgtagtcatatatattaggtttacaatttagtatatctgttggaatcttaattaacagtggtctgaatttgaagaaatgattacctggtttaatgaatataaatataaaaaaattgagattacacatctgtatggttcatatatgtgatttgtattaattgagttgctaatcaaggagataatagattcataatcttcagtaggcctttgattatttcattgagttgctcctatgataaaactgtatcaccaattgcatttagatcgtcaattagggattggattcaaaggtgatactaaaaaatagttcaatcttaaagcattgtgcttggaagttctgtgtgaagtttctgacctccacattcttgtgaaattgaaaggagtgaattttatcccataattgcccagagctttttcatctgattactcaagcaatcatattgtcagaaatagacgattgtaaccaagagagaagcaactggtcttgttactctgatgtgatatagatttcagaaatgtgatttgccccacattcttcatgtgtgcggaattatgatggaattactgtattggcgagaaagtggtgaagatgacagccttggattattggttcaacttgctggcactgaagtagataatttttcaaatcattttctaggaaacagagtgacaaaatataactgcggatgatgccagagaagatcccatggaggagagaggtgttgatggaggatgcaatctcagtggcaagcatgaattggttgttcagaggccatcttgggttcgagcaaagctctcgaagtcatgataaagttgtgaggaagagaaaatgaacactgaaccataaatttataattctgtaaaatgaaaggctatacatagcaccctgggctggcttcagctcatcaagatatcctataggaatgggtacaatcatattacagagagtgagagagttacattactctaatatagatacacctttaaagaagaaacctttgaagctaataagaaaaggatgtctcataaaagttgagttggaattatgttctagcagatagcaccagatttcttttgtgtgtatattatttgttctattattaaaaagaatttcttagctctttagtgttattatactattattattggatagaaagaaagaaatatgaatttattattgtcttgcaggacaaggctagaataggtaaacagagcaaaaataaaagtaaaaattgacatctaggatttttcctactttgtttcacatgagtctctaatctctatatacatgttctgaaaattgggtaatttcacttcttgtgttgatgtggtctgttgtgattaattttaaaatatttgatgaatccacagtgatagaaactgcattcttgaacataacacataatgttgctctgggcctcttgactgtatttcaggaacaaataagttcaagttttgctacataactttctatgttatctcatatgttttgagaagaaatacaagttgtttttatgctgctttgtcatgctgataaaaaatgctgctttgtcatgctgataaaaaatgctgctttgtcatgcatttaaagtactctgaattttggaacattgttttgggcttcttgcatctatttttatttatttgtttctatttcagttggatctttgctcggaaatggccaaatatcttgcaaggtcctcaactccatttgctctgtggtttcctgaatctttctgcatggatagttgttatttctccaattctggtgcttatcatttggggctcttggttgattgtaatattgggtcgagacctgattggtttggctgtaataatggctggcactgctcttctattggcattttattcaattatgctgtggtggagaactcagtggcaaagctcaagtatgtattttccggcctattttttatttaacaaaacatattttgtgtcgtgttcacagttattaagcttatatattctattaatctattcaatatgaaacccaaatttctaaatactgtatcttaggtagagactgtttctggtattattactgttgtggattgttttctgtcgatgatcttccatcatttgagcaattgacagcctttggatgtgatgattatgtcttctgtttcatgaaaaagtgaacagaagagagaagaactgtaactgctgtcatgtatgactcttccattgttaaaattatgatattctcattataaaaatggaacaaattgcgcaggctttactggattcagtgcaaacctggttcccaaaaaaaatggtcaaaaaggttgctggacatgttggttagtggtcataaagttgccaaaaaattgagaacaactgggaactacagcagggtgaaagtattggatgccaaacaaagaagttcctcagttgagaaattgactaaaaataataacttgatcatgtttataggagatggtattgccttggttagtgaaaagaagtaaaatagaacaagattgattgaataatatataagattagattgatatggcgtgttttacttctaacacaaaaatggcgctaatattgtaaaacttactaacaacactcatagcaaatcagaaggtaaacagttggattatcaataggtctaggtctagcattcaacatgcatgtttcctttatatgtctaaggcgtactggcagtggcggatctaggaccttggaccagtggggcaatttatttaaaaataaaaattgataattgtcattattatatggaatagttggattcaaatacgaagataagagaaacaaaatatgaagttttaagataaatatttgcattttattaaaaagagggtgcatttatttactcttacatgtaaactggtaaggagattcaaatacataaaattaagggttcaaatataaaattatgggtgcaaaatatgatatttttttgcattttattaaaataagatgtgtatttacttatttttacatgtgaacaggtaaggagtttcaaatacataaaattagagggtacaaaatataaaattatgggtgtaaaatataatattttaggacaaatactagttattttattgaaatgaggggtgcatctgccacctcaaatacatgtaggtccgccggtgcgtactggttgatgaatagtaatgttgaccttagattgagcaacatcaattctttagaagtaccagagttttccctaattttggtccaaaattgataaattataattatattttctaataaaatgaatgctatggtgatcgtcatctgtaataacaatttcattagcatatacaaccaaatatattgtaaccgagaagtacaacgacttcaacataaagatctgcttctttataaggcagaacagcctgttgcataacaacgctatcaagcttaaggaggctgtttgaggccataaaggcatctttgtaatcaacacactggttgtaaagattccccctctgcaacaaagcccggcagttgctctgtatgttgttccttcaattgtccttgttgaaaggctctgtatgtgtgtacaaattgttgacggttgtgtgcacatattggatccaaattttgctatgttgttaaaagagaaaagtttaaaattagatctaaatgtcctggcatttttgcttcttagtacaaacagaaataccgaattgacttcgaagcagagctaaattttttaaaaatggaatttttgttccttttttgttaagaattacttggttcaatgagaatatcattgataaaattgtaacaaaatattgaaatctctaggttgaaacaatatgatatagaccccatatgtagtatgctctagatatgactttgaaattactattgtgtcccaatcatttgtgaatgagattgggagaaaacaagcatcaggtgaggttaaaagttgataggagccatgtgaatcatgctttctgctgattatccttttcttactgtggttttgcggaagaaatgctcttttgtttatgctcctgctttggagaatgatctggagctagcaatttaataaaatcaaatagtgaaggccgtacagctgaaagctcaaataatttgacatatgttcctcaactgtgagctagtctcatgggattgtgcttgagagttattactctgtccagaatgcctagggcatttagagtttttgccgtctaagctgatatcatattacatttcttcttgtccaacctatgtaaggcgtttgttcctatttctatgttttccaacagcagtgaaataagttgcttgtaaataggtattttgttatgagtacaacaaacaacaggaaatgttctttgattaggtcttcagtcaaagctattgacggaaaattttgtccttgtcagctgcacatctttttttcttttgttctctatgctgcttttcttccaatgcctaagtttagtatgaataggcgaatgatgtggccaagaagcagtgttgtacaaatattagacatgaaaagtattttacctggttttataaagatatagtatgtttgggcatcttatatgattgatttagtttcgttttcatgttgggcgatgttatagttgtaatacccaatatcttcatttttcttttgacaggggctgttgcaatcctgcttcttttggctgttgctcttctttgtgcatatgaactttgtgcagtatatgttacaactgggtcacgagcatctgaccgctattgtccttctggtttcttttttggagtctctgcaattgctttagcaatcaacatgctatttatttgcagaatggtgtttaatggtatgcttttgaatcacttagttcatttacaaattgctattcctgattattattaaaaggttaagatatttttttggttgttgtacaagataatcattttcaacgtagtccttatgtgacgaaacttttcaattagctcctaatccttttcaatgttgtctgtactgtttattgtcataatattgtgatattgaagttgagttaccctaaaatatatggatcaaatttaataatgactgtgatgtagtgacaaaaatatagtattttagtccctacatacacaacactcatctttagtttggtacacttcattgtgttataactccagtagatagtagtattataatagtagtagatgacattcctttttgatgtacatggtgtcccttcgtacgtatactgcttttggcttgattctatttgtttttttgtttttcgttatttgcatatcttattaccattattcattgtagggaatggcttggatgtggatgaatacgtgcgaagggcatacaaatttgcttattctgattgtattgaagtaggtccagtggcatgtttacctgaacctccagaccctaatgaattgtatcctcggcaatctagaaggtatgttctaatgcttgttctcattgttgactatcctattggagacaaataattttaaggtatttttatagcattcattactagcttagacagacatttattttgctattgcttctcaaatatttatttggattagacatatagtactatttcattaagctttcttcctccaagttcttattgtttttgtttgtctttgtagggcttcccatcttgtactgctctatcttggctcactatgtgttctgttagtatactccatcttgtatggtctaacagcaaaggaggagaattggcttggagcaattacatcagttgctgttattattcttggtaatttaattagctcttggtatttattatattatttttttaatgttaacagaaaattcttgtgcacttttcgtctctggttatttgatttgctctttttctgtgcacttcttgttttgtagactggaatttgggcgcttgcctgtatggttttcaacttcttgatagtcgtgttgcagcactgtttattgctggaacatctcgtgtgtttcttatctgttttggagtgcaatactggttagtttcttaaatgaaaaaagacctttttctcagcgccactgcatgtattattggtttgttctttgttgacttttctctactttcaccactcacaggtatttaggccactgtatcagctatgctgttatggcatctgtactgctaggagcggctgtttctcgccatttatcagccacaaacccattggctgctaggagggatgccttacaaagcactgtagttcgtctgagagaaggattccgtagaaaggagcacaacagttcatctagcttttctgaaggctgtggctcaagtatgaaacgaagtagtagtgttgaagccggtaatcttggtaatgtattgaagctggcagggctatgctgcaggtgatgggagcaattggaataatgtcctgtctcaaactactagtttgccagatggaatcattagtgataaaagcatagatagtggaaggtcaagtttagcattacatagcagctcctgtcgctcagctgttcatgagccagaagttggaacatcatctgatgatagaaatttggatcacaataattctttggtggtttgttctagtagtggtcttgatagtcaagggaatgagtctagtgcatcaaactctgcaaatcaacaaacactggatttgaatttggctcttgcattccaggaaaggttgaatgaccctaggattgcaactattctgaaaagaaggacaagacaaggtgatcgagaattgagcagtttattacaggataaaggattggatccaaattttgcaatgatgttaaaagaaaaagtttagaattagatccaactatactggcattgttgcaaaggagtagcatggatgcagatagagatcataatgaaaatactgataacaccagtgttgacaatgccatgcctaatcaaatttcattatctgaagaattgaggctacaggggcttgaaaagtggcttcagttgtgcagacttgtattgcatcacattacgggtactccagaacgagcatgggttctgtttagttttattttcatacttgaaaccatcattgttgccatatttcgtccaaaaacgatcaaaattattaatgcaacacaccagcaggtgagtgctgagtccctccctatatatttctgtttgttttgggggactgaaagatacacacacacacacctatctctagaagcttgttatccgtatttcatttgtttgatcttggggttgtaactgtttaaaccttacaatgctcattttgatatttttgaacctttattgcttgtagtttgagtttggtttggcagtgctcctgttatctcctgtgatatgttcaattatggctttccttcgatcacttacgacagaagaaatgtccatgacatcaaaaccaaggaaggtactagattggctgttttttgattaaaatgcaaagttcatctactgaaatggatgaatttaatttttaactgtttatcttgttgagctgactaatgtttggctacttgactacttgttgtaaatttgtaatataggaagtgcttctgttgccgtataatgtttttggttttgatgcggcagttttagtcttttaaggtttatacattcttatagtgcacatatattagttttagatgagagggctaactttactggtgctatcatgataccattctcttgcccatataagctcttggggtgggattattgggaaactctttggaaaagtgggattgtcctagtttgttgaactgggtttgcctgtctgtgatgggctgagctgggcagcctgtgatccaaacatgcaatttgaaaacctgaaatccctaaatccccattgtctcagcctctttgaatcacttgacctccctcttctctcagaattaaccccctctctcttggatgtggccccgaaccactataactctactctcaaatcactttggtatggcgagtgttgaagctttatttatttatttgtttgtttgtttgtttttgtttcttaaacccataatttgagcttatgctgggtctataaaaggtctcatgattctttgacttctcattacttttctgtgttccttctttcctttccataattgctgtaaaatatcaaatagacattgaattattaaataatataactattaaacaaatatataaattcttccttgaaatttgctggtgggattgtacatcttatgtcacacaatttatgagcatcccaatttattttagctaataatagaagatatgtattaatataacatgatataattaacagatgattatgtttttaaaacatgtgattagatatccaatcttatacaacacatttattaagagatatcagtttttaataaatttcaatacttcagggaaataatatctatttcgcagtgaaagaccatgttttcccctcattcctaagtaggatctcgattttgacaaccttgcatcttgatttccacttggacttaagttacaatgttgttttcttagcctgtcagaggtgtgcagtcatgtagctcatgaaaattaatggttccttgaagttcattcccccaatttatccgaacaacttgctatcgtctgttaaatcgggattgtatatcttaatggaaattgtagaatcaaacaatcctactagtaaaattgtgattttgaccaggggtggagctagcatttttatgtaaggggggccaatataaaaaaaaatcatgacttataaaagaatatttaaaatttttcatgcatgatatttatagaacttttaagatataactaaatgtattttaggagcaaaataaataaataaataattgtgttaagcatgagagagatactaattaccaagtgcgattaacatacaagggccaaagaccagtatcaaaagaagaagaaactaaaaaaatcaattaaattaagtgaaaataatttttcatagtcaaagcatattattaaaaaaaaataaattcaaaagtaaataattgtgtcacatgaaaaatacgtagaaaatacttggataaatgaatcacacttgataaatacttacataagttaactaagtataaatgtatcattaacaaaaatagaaactataaattagaaatgaagagaatttgactttttaggtaaagtgttttaataaaaaaatattgaagagaacttagaaaagtaaaataattttatatgatgagagttttttttagcagcaaagaaagattatattatagttataattatattataaataaatggattggaatttgtcacaagatgtgggcaaatcaccaaccacagaaaattacaccaagaaattacacaaacacgactcataaatataacatagcagcactgagaatccaacgactaacaatacataaaactcagtaaaaacacccaggctcattgaacccattacaaaacaaaaccgtaacatactaataccggctaaaccaaactaaaagaaagtatgacaaattccctgtatattgtgtccaataagaaatagccgattaaactgctgctattaacctcccctataacgtgttacgacatcccctaatattttttccatatacaacatctcctaatattatgagagtttgaaaatcttgggtgggccatggcccctgtaggcccctgtgcctccgcctctgattttgtcatccttccttggaggggtagctacagcctatgggtactgattgccttgggaggtttttaactcactgattgtaatgttaactagaattagggatttcatttagccatgtgttttctttttaatttattcaatttattatgtttggcctggctatgtatgtctgttgttgcttattcttttaagagactcttgttttagtgcatgcatacaataacatgaataactaataacatattctctctttctctctctctaattcaccgtcttcagtatggttttattgcttggctactcagcacttgtgttggattgttgctctcctttttaaggtaagccctactattcctgaaagttgttcatacttttaaattttgacctcatttcaattgaatgtgaataccttttttgtatcagcataactgcctatgcctttgtttgcattttattaattattcatcatataatttatgcagcaaatcatctgttctcctcggtatatccttgactgtgccactaatggtggcatgcctttctgttgccattcccatatggatttgtaatggttaccgattttgggttccccgcatgaattgtactggaagtgctggaaatgatcgaattcctcgaacaaaggaggttagttcttatgcctttcctacttactatcagggtgtctataatttgatgttttctgatgtctcttagctttatctcctgatatgtgatttctcgtagtcttagctttatctcccgatagatcactttgtttttcattctaggatatgacatattaattattttaattcatgaattcattgcatagggtgtgttatgcatttgttactttttgctctgtcaagttaaatttcttgtcaatgcataagcttgtcttgttcccttttacagggtattattcttcttatcagtatgtcagtatttgttgggtctgtactggctttgggagcaatagtttctgcgaagcctttagacgatttaagatacaagggatggaatggtgatccaaaaatcttgggttccccttacacatcatctgtttttcttggctgggcaatggcatctgcaattggtttagttgttacgagcgtgcttccaataatttcatggtttgcgacatatcggttttccctttcctctgctatatttattggactttttgcaggtattttctcattttgtatttacaaatacctacccccccccccaaaaaaaattgtttttgttgttgctgatatctaattatctatgtttctgaaactattgctgcagttattcttgtggcattttgtggggtgtcttatttagaagttatcaaaaccagggatgaccaagttccaacaaacggtgatttcttagctgctttacttcctttagtctgcattccagcagtgctgtcgctttgctgtggattgctcaagtggtaggtgacactttcttgtatttgtcgatttatctatggtaaattgacaaatgacagctattattttgctttttgatatatgtctgatcttttttaaaatgtctatttgcaggaaggatgatgattggaaactttctcgtggtgtatatatttttgttataattggtcttttgcttctgcttggtgctatttcagctttgatagttgttgtcaagccttggactgtaagtgtgttgaattcattgtctctttaactcccccttccccaaggtcaaaattctttggctgaacctcttccttcatattactgcagataggagtagcatttcttttggttcttctccttatggtattagcaattggtgccattcaccactgggcatcaaacaatttttatttgagccggacacagatggtctttgtttgcttccttgcttttctgttggctttggcagcatttcttgttggatggtttgaaggttctagtcaagtccattatattggcattgatatgcatatcttaagtagaaagtggctgatctgtaagtgctaacatgatcttttttgctctttttttctccaggtaaaccatttgttggagcatcagttggttatttttcatttctttttcttcttgctggacgggcattgacagtgagttactgattctaattttcaatcttataatatcagcatgttatcgtatcccaaatgcttttatgcttcaatcagttcatctttgttttgctcagagttttattcctttgtgatttttttcttctattccataggttctgctttcaaatcccattgttgtatattctcctcgagttttgccagtgtatgtatatgatgctcatgcagattgtggaaagaatgtcaggtttacccccactctaaattttgtttttaaatacgttggttaattttttgtttgattttacttgttatgtgatttattactttatgtatccactgcttgtattgttatttacagtgtggcctttctcatgctatatgggattgccctggcaaccgaaggctggggggttgttgcaagtttaaagatatatccaccctttgctggtgcagctgtatcagcaattaccctagttgtttcatttgggtttgctgtatctcgtccttgcctaactcttaaggtctgtgaagtcattgtgatcaacactgacttttaagctacttcaaaatttaaatgattggatttattatatacactgaaatgtctgatgaaactggcttattataatgtgctaacttctttcttcagaaaataccttctaattgaagttctaacctttgtaaaattgtacagatgatggaagatgctgtgcatttcctcggtaaggaaactgttattcaagcaattgctagatcagcaacaaaggtaagtagatttgccaacgagattgcaggaccctattgggccaatatctatattttattcttgtcctcctagcattgtttggactctggagtagtaggtagtaggcattctagccttctctacaactgctatgtatgtctgtctatgttggcaaaatttttcttcctttacagaaacaatgttcttgctaaaatttggtttactgctctgcagttaatacttctgcaaatgtagtgagaaatttttccactgattataaagtactctgtaaatgtggctgtatttattttataaagtactttattctcaatcatcctgagttttggaaatcttttatgcttttgaattaatttgtttttatcttttgcattatcattgagctcagtaattcatgctttttcttttttaacagatagtccatgttttatcggaatctttgccaaagtattctagtttagttttgaaaagtgcttcatagtgaattgattctatttgaggaaattgatatgttattctcatacattgaccatgtttcaagcatgttatttcctattaaattgttgctttttgaaataatttctcattggaatccaatctttattgtgaacaattgcctgaatgccttagtgtcagagacaatgtgccaaacgtttgacaaaaagttacaacagattaacggctaattttgtcacaccagacttgataacaagtagcaactctaggttctgaatttcaactgtttctataaatatgagaagtctattcagagtttgttcagtgaattgaattacataatatacagaaaaactttccaagcttctcttttttatgtcattttctaactcaaactgcatctctatctctgaaaatgtttacatttgaatcagaaaacttgttaatgaaataaaatttcatcaaccaatcagtctatgtttgtgtttcttgtgcatgcattgctttgaaaatagtttatgataatctctttcagtaccctgaattaatataactaaccttaaaccaatggaaatgtgttaattgcttgaataattctctttaatcttgatacttacataaatattttctaacgaatatgttctcctttatctgtttgttgattattgaatgttattgtcggaaaagaactcctgcatttgtcaatgcaattcaactgtgaattaatgatatatacttgcactgcagaccagaaatgcattatctggaacctactcagcaccacagaggtcggctagttctgctgcacttttgattggagaccctaccattatgcgtgatagggcaggaaattttgtgcttcccagagctgatgtgatgaaattgagagaccgcttgagaaatgaagaattagttgcaggttcattctttagtagattaagatatcataggacattccgccatgagccaaccagcgatgtagatcatagaagagtcatgtgtgctcatgctcgaattctggcactagaagaggccattgatactgagtgggtgtatatgtgggacaagtttggtggttatttgcttttgttgcttggtttgacatctaaggcagaacaagcacaggtaatggatatctagttttgcatatagtggatgatatcttgtttttatttttattcttgtgacaatgataatccatttctctggtaggatgaggttcgtctgagactctttcttgatagcattggattttctgatttaagtgctaagaaaataaagaagtggatgccagaagatcgcaggcaatttgaaatcattcaggagaggtactatcctgagtatctgatattaatatgtatagtatctttaccatgttttttctatctaaatattttgttgtgaattttctagttacataagagaaaaggagatggaagaggaagtcttcatgcagaggcgtgaagaggagggcagagggaaagaaaggaggaaggcgctacttgaaaaagaggaacggaaatggaaggagatagaagcttctctgctctcctccattcctaatgctagcagcagagaggctgctgccatggcagcggcagtacgtgcagttggaggcgattctgttctagatgattcctttgctcgagagagggtttcaagcattgcacgtaggattcgtgcttcacagttgtctcggcgtgcacttcaggttcattaactgtctttgatatttattctgaattctgatagcaattgataggatctttttcagttttttttttttttttttaacagtctgtttaatttgttggagggatttcaatgggaatagaaaaataattggatggaatgatttgtggaaacaattggcaggatcttttttcagtttttctaacagtctgtttaatttattggagggatttcaatgggaatagaaaaataattggatggaatgatcatcctctttatgtataatctgtgatgtagttaatagtggaatggtttccgttcccattttggttttcaagaattagcaggattgtggaggaaaagtattacaaaagtaaatgtttttttttaaattatgttatttgccatatttttttgtgaaataatgtaaaaaaatagtgctctgtagccttaaaaagtagtaaaatattttttgaaatattttaatttatgatttttatttaaaaaattaaatgttaaatctgatgttattttatttaaaatatcttttaaacaaaacaaatccatctgataaatataaaagcttataaatatagctttttaagtcaaatatatattgtttgaagtgtgtgtataaaaaacaagattacaagagtcttaattttataatatattattcatttgttcttcagatctatgtttctcagtagattaattttgttaattaaaccaaatttatttgataggtaccagcaagcaagaaagactaaaaggaagaaattaagtatgaaaatatttgtattgcagtaactggtctgaatcgagggaattcagatcctggaatattctgtattgtgtacaatggtacaaaaatgaaaagacacctagacagttctcaagagtgtctaatctctcccagcccaagcctacatctacacacctttccctggcttgtattttctctctctctccccctctcccccttacatgcacttccctcatgctctggtgccaggttggcagttagctctctcgctttctcttccccctctcctataacaaatttgatacattgcaccttttgcctctcttttcatacaccttcagtgatcttgggccttggcgctatattactattcctttccaaagtattcagtaaacttctgattcattgcatacttgttccattcccgccagctcatttcagctaactggattttctttatgataatcatctatttaaaatttctgcatgcgctcacctttattttgactgatggattactcactgaaaaaaggatgatggaaaattatttttaagaatttaactagaataatgcattgacactgtatatgttttttactgtctgattgttgtcagatcctaaattgtcatgtgtagtaaatttgttgatttttttaataattaccttaaaattcatatttaaggttatttttaattgaatgacagtatacaaatatttacactgacatgaagattatacccatttttttattggtatttatataacaatccattacgaaagtctaattttgtttatctccacttgtggtatcataatttaaataattaggatgactcttctggagattacttaatttacattgaaattttgatatctttgcagacaggagtggcaggtgccatatgtgttcttgatgatgagccaacagccagtggcagacattgtggtgcaattgattccagtctatgtcaaagtcaaaaagttagcttctccattgcattgatgattcaacctgaatctggtcctgtttgtcttttgggcactgagtttcagaagaagatttgctgggaaattcttgtggctggatctgaacaaggtattgaggctggacaagttgggcttagattgattactaaaggtgataggcaaacaacggttgcaaaggagtggagtattagtgcaacaagtattgcagacggaaggtttggtctttctctttattttatgtatcatatatttgttttttaaagttcaggttcagttacccagttctcttgttatatatgtttaccttttgttgcaggttatcttcacatgtgtgtcagtaatcttcttagtataataacattttgttattctaattttaatccaaatgcattttgggaattatatggtttcagtatttcttattaattgttttacaattctctccagatgaagtttcacaattttttcaataattaagaattcaaaagtcaaatttcaatctctgccagctttcttgagatgcaaaagatagctagttttacctttaaagactgttaggactgacttttactattttggcatggtaaacttgcaactgaacaaaatttatactgcatgagtctattttaaaatacaggagatttttatagagcaaaatacttatattatttgctcaattgcttgagtttgtcattatatatttggatggttctgtctaggccatgttatttcaatgcacaataaattgttgtagtttcttacgtttctgtgtgggtaatatattgcaggtggcatattgtaacaatgtcgattgatgctgatttaggtgaagcaacatgttatttggatggtggatttgatggctaccagaatggattaccattgtgtgtgggtagcagcatttgggagcaggggacagaagtgtgggttggtgttagaccaccaacagatattgatgcatttggtaggtcagatagtgaaggggttgaatctaagatgcatattatggatgcttttctttggggaagatgcttaactgatgatgaggtttcttctatttataactcaatggcttcggcagacttcagtgcacttgttttccctgaagataattggcagtgggctgattcaccttcgagggtatgctgcttcttccttcgctgcctctcccttcttgtagagaattgaaattttaaaaacaacatatataaattatagaaacaaaataaattgtcctcctaatactgctaaatgctccaacatgtagaaaatgttcttatcatgctttactaaacatcatcctgttgtctgctttattattaaaaaataaaaatagtataacaagtggtgttttagccatcatgtttactttgtctaatcttattaacacattttgtgtctaggttgatggttgggacagtgatcctgctgatgtagatttatatgacagagatgatgtagattgggatggacagtattctagtgggaggaaaagaaggtcagaacgtgatggcatggtggtggatattgattccttttcgaggaagtatagaaaacctagaatagaaacacaagaagagattaatcaacggatgttatctgtagaattagccatcaaagaagctctctatgctagaggagagagacgttttactgatcaggaatttcctcccaatgatcactcattgtttgtggaccctgcaaacccccctgcaaagttacaggtacttctctttattattatcttttagtttactgtatttacccccccttacaaattttatattgtttcatgtacaggttgtttctgagtggttgaggccaggtgagataggcagacagaaccatcttgactgtcgtccgtgcttattttcaggagctccaaatccttcagatgtttgtcaggtctcatgttttacacctcacttgcaagaattttgaaataaatgtttgttctcattatgttttgttagtatttagattttgcaatgtgttaatagttatgtatattgaacagggccgtttaggtgattgttggttcttgagtgctgttgctgttctggcagaggtttcacgtatatcagaggtaataatcactcctgattacaacgaggagggaatttacactgttcgcttttgtgttcaggtaataagcatatagagtcagattttagtttctttttattttctctttttcatgctgtgactggatagataacattttccaaataaatggcatctaagttcttttcatattttggttcatgatatctagggtgaatggatccctgttgttgttgatgattggattccttgtgaattaccgggtaaacctgcatttgctactagtaagaagggctatgaactttgggtctccatattggagaaggcatatgccaagttgcatggctcttatgaagcactagaaggtgggcttgttcaagatgctctggtggatcttacagggggtgctggggaggaaattgacatgaggagtggtgaagcccagattgaccttgcaagtggtagattgtggtctcaactgttgcgcttcaagcaagaaggttttctcctaggtgcaggaagtccgtcaggttcagatgtgcacatctcttctagtggcattgtgcaaggacatgcatactcaatactgcaggtaatgggataatgttttatatttttatattcacgatcattgttagatgtaaaaccagtaataatccttcacctaaataacttggtaagtttttaagagagttggtccttgacatggaaacaaagccttttatgttgagttagtcaggagtttatccttgttactttgttctatttttttaagttgaatttgagcatgaagtagagtggagttgtgtatgattcatgctttaagcccaaaaggttctcttatttgaggagtgtgtttggtatatagtcattcatggcaactcatgagccttcacccaacaactcaagccttatggagagttactctgacaatcctaatgatttttaatgatctctgctgtcatacaattttaggtaagagacgtggatggtcataaacttgttcagatccgaaatccatgggccaatgaagtggagtggaatggtccctggtctgactcatcgcctgagtggacagataggataaagcacaagctgaagcatgttccacaggtagttctttatgcttttctgttgtggattagtcatatgcttgacttcttagcatctctttatgattgagccgactatttgctcttacccaatgttattatcatttgctgacgtcaattaaccattttatttgttacttttttcaacagtcaaaagatggcatattctggatgtcctggcaagattttcagattcattttcgatcaatatatatttgccgtatttacccatcagagatgcgtcattctgttcatggtcaatggcgtggttacagtgctggggggtgtcaggattatgatacatggaatcaaaatccacagttcagactgactgcaactgggcaagatgcatcatttccaattcatgtattcattaccttaactcaggtactactgatatttccatacttagtactgcaatttctgaaaagaacctttcccttgaatttctttaaaacttcatttcatgatatttatagggtgtgggattttcaagaacaacagctggttttagaaattaccaatccagccatgattcacagatgttctacattggaatgaggatactcaaaactcgtggcagacgtgctgctttcaatatatacctacatgaatcagttggtgggacagactatgttaattctcgagaaatatcctgtgaaatggttttggaacctgagccaaagggatatactatagttcctactactatacaccccggtgaagaagcaccgtttgtactttctgttttcaccaaggcatcgataactctggaagctttgtagtgcctaggatagtttttacatgtatcttgtcctcttgataagtttctctgcctgggttctcggtggatcatgtacttgcactgccagaggccgtcttagaacaattgggtaattttctcttccccctctcccaacaattttcttttcatatatatgtcatctaacatttatggtttgtattttctcttcacagcattgagacactattcctggggaaacgacatggcatctgttcgagagatggatgaggtttagctgcacataaactcttggtctttgaatctgatgattcatcatcttgaacaatgcttctgccagcattgaagagggctctcgggtgtttattgtgtacataaaaaagtggtactataggggtatacttgtaaccatgtaagcaaagttgaaaaagaaatagctgcaaataagtaggaaattactaacacctggttcaaatggaggtaaggacagtgtggggaggtatagtaacaagcattgagtgactgattgtaaattcagttgccgttttgacaattgcaaaaaattgtacaaacattaacaattatcagttcctatcatttattggcatttgggaaaattttgtacaaatgtctttctaatctaatttgatttcaaaataaaggagcattcactagttgtagttttttcttggttgaaatacaaaatgatgaaactatgaaacggcgagaaatgttcctatcttacagtatttagtcttgcagtccttatatgtctatagagttccaatcgtttatataacttgaaaggtcaaaaagcgtttcagagttttttatactttctaaatgttaatttctatagactccaattttaaaattacaaatttctaatagtaactgtagatactagctattttttatatcagcaaggtgttgtcaatttagcataatttttttaaaatgtagggagcaaactaaataaaagatttgtaaagctaaacaaaaatttgacgaaatcatgtctgtggagggaacgataagggcaatgtcaacataacctcgttttgtctgctatgacacgtttctctaagcttttctcttcgaatataaataaaataatgtaattttttttaaaaaaggttgagaatagaaaataattgttatactaggcaattgtatgggcatgcagaggaaaagtacaaaaaggggaaagaaattcgaaaatgaagatttaattaaaagaaaaattctaataacattttttaatatatacttttaaacattttttattattaattgaaatctatatatccattaaataatgtgagttttatttgtcgtacttttaataaatttgagttaataataaagaatgtattgcaaaagatattatataaaatgattgttttcgttaaataaaatatatacatagcctaaaagtgaatgaaaaaatagatatttacatagccaaacctttacgataccaagagagagatataaggtgcaaaacagagatagtgttgaggtgaaaccgtgaaaatttgacatgtagtattaaatttacgcgtgtatacacttgtgtattgataagaacccctcttattttggaaaaacaaaaaaaaaaaaaaaaaaaaacaaaaattggaaaaaaaaaaaaaaaacgatgagatttggatgtacgatgttggcggattgcagaagacacgcgagtttccattttattttgataggcaactatttagtggctcaacaaattttgcgggaaagtgagaggttttatcaagtcaaaactaatgtgcttcacgttcataatatcgtttgattgttatttacttcttgtaatataggaatctgatgagttaatgatgaaatggtttgtgttattggtgtgcagagttgtgagtatatgtgtgctgtgttgccttatccatagtgtcactgtaagagggaaaataataaatcttgaaaaaaatatgaaaagagatataaagaaataatgtaatactacatgatttgatgaaaagaaataaaaagggtatatataatatgttagcatttcttatgtttataataagaatttaacggatacgtatttttaatataaaatgtttactgttagttaattaaaaatcatattttgtatgatttttaaaataattattataaaattaacaaactttattatacataatataacttgtgagtttgaaattgaataaggtcttatatatttttcttataataaatcaaatctaatgaattttggattatagacttgtatacgaaacaagtagggttgtgttacatgacaatgttccctccgagtgatttgagagaagaaaataacaattaacaagtgatcctgcaaataatttcaacaagttaagatattttattatcacctctattgccaattctccttgatagcttatgtgagtgtaggaacgaaagatggaagaaagagtgagtggatgtaaccatgtcttaatggttccatacccaagtcagggtcacataaacccaatgctccaattcagcaagcgcttgagcaccaaaggagtgagagttactttggtcacaaccattttcatttccaagtccatgcatcttgaatcttcttccttacgaggcagtgttcaatttgatttcatatcagatgattatgatcaaggtggttttaatcaagctggtaatgtaccaaactatctttctcgcattcaagaagtaggttccaataacttgagggaactcatcaaaaaacacaactcttcagatcaccctatggtgatatgggtattggatgtagccaaataatttgggttattcggagctgcttatttcactcaaatgttgcagtcaattacatatattataatgtttaccatggacttcttaaggtccccatttcatcaccaccaatctctattccagggcttcctttgcttgatctaaaagacaaaaccagcctttgtttatgatcctagattctatcctgcttactttgacttggttattaatcaattttctaacatccacaaagcagatatcattcttgtcaattccttctacaaggtagaggagcaggtatatttcttgtaaacttgcacagtatttcaattcctttccaagaatatgtttaatttactattcatttgatatcaattcttatgtcaatggtttcaaaaaaaaaaaaaaaaaataattatgtctatgattgcgtaccaacatgtttaaaatttatcatgagccatgtattggggtattgcagagctagtcaaaacaataatttcatccctattcatgaaaatgactaaactattggtggtatgcatgttaattgaagcggttgaatagtaacagtaatgattaggaaaggtaaccagaagggagtagtagagcaagataagatcttatatcttatgggttacaagttcgagtttccacttgcctttctgtttttttgagccattagttggctcaaacaaaagcctgcagggtcagttattttcatatcatttggcagcatggtgtgcttcagctcacagaagatggaagaaatgcattgggcctaatggcaactaccttcaacttggtcatcctgattagagaaagaatcttccaaaagcgttgggagaggaaattaatgcgcgtggaaggggtttgatagttaactggtgcccacaattggaagtgctatcaaaccatgctgttggttgctttttcacacactgtggatggaattcaacacttgaagcattgtgcttagggtgcgaatggttgcactgccacagtgaactgaccagcccacaaatgcaaaattgttgaggatgtatggaagggattcagagtcaaagaatataatggattgtaatagagaagaggttgagaattgcatcagggtagtaatggaaaaggacttaggaagagaaatgagaattaatgctaagaaatggaaggaattggctatagaagagtgagtgagggtggcacctcagacaacaaaatcaatgaatttataaataatctgaaaagatcctaaactaaatatccatattggtttcaattaatatttattatggttttccctaaaaaaagtattgaattgtatgagaatttatttccttctgtctgtttagttgatattatatgtttatttgattgtatgttaaattattatatatacaagcaatcacagactaaactattggtatatctttcattgattctgtattctaaatttgaactagatgtaaatatgagactgagttatacacgagagaaacgtagtaacacgtttttttttttttaatcaacaacgtaataacacgttcttttaaaattctgctaaaactacatggctctcacttgataacaacattatgtaattgcaccagatagcaattcagtgcaatacatatcgagtaattagtcatctgtctatgaatgaagagtataaaagagttttataaagacatctaataacaaattgttatagatggtaattccttttacaataattactttaaaatttatatttattgtaatttttatttgttgatgatatgattttttttcctacattaacacattgatttgcccaattattaaatcatatttgaatgatcaataaaaaataaaatacacatgacttttttaaatagcatgtgatcactaattaactaataatcttatagctcttctttcttgcaataaaatatatatcaaaaacttgctaatggatgtgctagtgaaataatcttttaaagaaaacaagattccgattgtcaaatcaccacgattcaaagtcatttaataaaaaaggtttatttcctaaattttcaacatatttttagtccctgaattaatatttttttttttttacttttagtccctcaaagaaattaaagtaaggataaaaaatgaaggttaagagggacattgatcagtaaaaaaaacgttcaggactagaaacaaaaatctttaaaatttaggaactaaaaagataatgaacccattaaaaaattataacacacaattcaagcgtgttaaacaaatttaattaagtagtgagaaagaaaattatatttgcaaaggaatcaacagtgcatgcataaatgatattcatcatatgtctcaagacaaaataaccacactcacggatgtgctaacttgtttaatgtaataattttttttgcagataatacaattttgattgaagaatccagtgaagcaattaaccttaaacttgaactttggacactcacggatgtgctaacttgtttaaagtaatcttggatgtacttaccaaaaatgtataaaaattatccctaatttttttttttgcagataatataattttgattgaagaatcaagtgaagcaattaaccttaaacttgaactttggagattggatttggatagagtttaagaataagtaggaacaagacaaaagacaaagtatatatatatatatatatatatatatatataatatatatatatatatatatatatataacacacttagctagaggcaaaggtttccaagtttaaatatctaacactattaatacaaaatgacaaaaaatgaatgaagatgtcatatacggaatacaagcaaaatggctacatgaaggcatcgacagttatccgtgatcacatttttttgtgtgaatattatctgtgatcacatgttacctaccaaagtcgggcaagttttactatatgtcctagtgacctactatatgatattaaatgttgaaattttgaggaaagaaagattcacagaaatgataatgttaagatgaaatatgtaatcacacaagaaagaacatgacataaaataatagtatacaagaagatattaatgtatcaccaattgagagaaaaaaaatgacaaacaattatgatgattttgacacaataaaaagaaccagtgaagaaaataaattatatggtttttaggcgtgtagaaagggagacaaaggacattaagaaaagttgttaagatacatctcagtaaatatcaaatgaaaagttttgattttctacatactaaaggattagttttcatttaataataatttttttatttcttaacgtgtatttaagctattagttaacaaattattaaatggtattgtgtttcacttatatttcaattttagtacagtaatgcaccccaatagccaataaggcctaagtgtcgtatcatgtataaattaaagtatatttgtgtgctcagctgtcaaaaatttacagagcttgctcacacttcattttcgtctgtctgactgctacaattgaactatttgttaatacgaatacaaaaatcaatgactggaaaattcgaatggcctagagtacatttgcgcaacatattttgtggcatggaactcaaataggatgtctctggaagtcaaatgatgggatcataccctctacctgctctcatcttcaggtgcattaccatctttcctccaactgcccaacttaacaatgtcctcaactagaattttcccatctatagcaacaaaatgatatccgtaaattattgttttcatgaactaatcttcataaagaatagataagtttgataaatagtcactggatatattattcagataaacattacaagtattcaacatcagtccttgatgaaactctttagaagttgataacttcgtagggtaaacattaatttggagaccaatttttttaggcgcatactttgaaaagtaaatagtaacactatatttaaaaagaagcggcaaaatactggtttagtaacatctcaaaaccagtcattttaaaagtaatttttaaataattttgataacccactgaataatactttaatggcataaccatcccgccaatattcatagatgaatacttttggttgatctgtctgtgatactgttcagttacctattgctctacacgtgaatttccatgaaaatttcactggaatttattttatgtgaataaagaacaaaactatttctgaatgcactacattgcaaacaaaatcaagaattaataagattaaaaaaaaattagcatcatgtgcgagagaaatgacagacctctatctttggaaagactgctgacaagttcttggataccctccttgcccaatgtatcctttaagtacattgcagcagaggctacctcctcaggagttactttcccatcataatctctgcaaaaaggcccaaaaatatctctgaaatcttatgcacagaagtcattacatatatagattgtcctaatgaagtaaggcatgtataagtggcaaacaagaagaaattgtgcacaagactaatcaaatttatcgtgaaataataatcacattgacatcccaaacaatattcaacttttagaacaaatgtggaaatgtattcttcccatttagagttgattgataagcttgcaacttggaaaatgagttcagacttatacctctgtcattcaaatgccagcaacttataatcaatattattattaacagaatgaaatatattcacatctttctcttgtggtagtggaacttaaattgtaaacaacacaaatcctttgtagattatgaagcacaacaaagtagtgcccttggtgaaatttataattgttaaaagccttaagggaaattgaaaacagcctcacttggcggttatatatgaacaaagaagcaggagaaagttaagcatggtatctttggtggtaagtcattgacttctatctatgcttattttactgactatatatgcaataacatttattcttactataatatcaggttcagaccccagaaaggtcccttctcatacaattacaatatcttgattaattgaacagtaatcacagtctgtggcttaatctacccgtcactctccttgggtaagaattcaattacaaaagagaacattttatgacatcaaatcatttatagaaaatacgaagtaagaatcccaaccaataaccaaatgtgagcaatagcaactacagaaatgccaacacacgccgacaccttttgagttttgaacatatttttttattattggttgaaatttattccaacaacaaaatttgtgggtctcacttttatttaatgagcactactcatgattttatagttttcaataaattttaaccaataatagagtgtgttgaaaggagcgtaagtcaaatgattcctattcagcaaacttgaagcagtatgatatattcaagcatgcagtggcaatcacagattcacagtttaactttcactaaactaaatttatgcaaatgcattatgaaaccacatacttcactttaatgagatctgataaggttagacaaagcatgaccaatgaaaattgaaatgtcaaagagccttagctcaaaagcaccatgtccctttagggactgcttgatcatacaatccatctcagcccggccactttgcctaaactttatcgtacctccccccgcccaaataacaatgttgaagagctagtgcaaacctgtccagcagcctccaacggtcaccaattttcgcatcaacgtcatctatttccttctcaagattttgaagcatagcatcaacctgacagattttcaaataattacaaattcagaagtgcaaaattagtttctaggttttccctaaactagataaaatgaaatgggtcttactctcccaatgagtgctgatgacaccttatccccttcacctgactcagtagcgtgttcatgttcctctcgggcagctttatatgccttaaaggcatcttttttaccatttgaaccctcttcctctaccatgctgttatagagttctatctggacacatacaaaacagcaatgataagaatggcaaatggattaaatatatgtgcacaatcacacagagggtggggatcaatttaagtgtaacaattgtcatacaaagacaaatgcaacttatagggcaaggggcatgtaccccacacttagaattcatcctcactatcactacttgttaaaaatgctacatgttaacaatgtcacagatgaattgtttgtttgattacattaatagagagaaacatttgaaagtggtagcaataataatattattattaataataatatcaagcatatgaaattgtgtattaaacaattgtagacttatctttaattaggttatattattgtatttttctctataaataaatatttaaaaaaatatttcatgtgttcattataatctttgaccatgccccagctaccaaaactgcctaggtttgccagaacaacaaaataggatttgatacattacagttagttacaacacacaacaacttcctacaagaaaacaatgactacttgaaatatcaccaatggttccgtatatctttcaagccaatcatttgaaaattgaaacaaaaataaatctgtaataaaaaggttaatgtttcacttatttgcaaagcatattaaagataaattctaatatttttcaatgaagtctaaaatgctcttaggcaaatataaaattttatgagaatatgagcatgatacagactttcaatccaaaataagacttttctgaaaattcatcttatagaaagtaattcattatagacacacactactctttctttctgtctttgttgatggatgttagcactccatctttttttttggaccaaaacaaattcctccgttttctttttcaaacaacttaatcttattggtatttggtcttctaataatttatatatatatatatatataaaaacaatctttctctttctttccccctctcttttgtatctctgaacctctttcccttaccttttccctctcccacacctctctctgaaaacctgacccccctccctttcagctttttaacctgtctatcctctgatgatgaaattggatgaatctggtgcagaggagaacaagggaaaaaataataacgtatattgtagacatggtgattctcacagcagaagagagacattaacccgagaaaaaaaaggataactaatgaattttaaatttaaaaacaccaccttaataaaatgtgttaaagacctctacgtgtttgtattgattaaaactcaaagacatattgttagcacacttgcatgcacaacaaatatttaatgcaatctatagaagatgtaaaagcaaatgatgaattttgaaagttcacacatacctctttgttaaccagtctaagaaaatcttcacgctctgaacttacagactgccaccagagtaaaagacaaaaccacacattaaacagcttaatgttaaatagtatagattatgcaaaataaaagaagcaattcaccaaattaaaggaattgaatgttttagatatcaaattctcaccgatgcagaagctaaaacagctaatgcacgactaagttcacacagttgttctttgttttcaaatgctctgtctctagcaagttggtgagcctcttttgtgttgaaatattcatctctttcagggccttatcatcttgactagaactactctccatccttgcttgcaccacctcctctctctcttcctcctcctgcatttatttataatactatgttatgcattgtgttttttgataacatggaatcttagatcaatagaaagctacttaattttcatcaatagttatttaaaatcagaaaatgaactttatggtgaactctagcatatcaacacccaatacttcatttgttaaacttactgatcagactcccaatgaattctgtcaaacaaaatattgaaatgattctttttatgtcactgatcatttagtattttttagtagattcttctcatatgaaccagagcaaatatcaaacactatcaaacagaaaaccttgtcaatgtcatcctaatacaacaaagataccttttaacgggataactatctagagcaatgcaattccatagtttaccttaataagttcttcttgcatttcaaggaactccaatttcctcctcctctctgagacagaatcctcagagggcaaagatgtaacctgtatagtatctacaacctcatcagggagagaagaaagtgtagcctgtacagcttcttctggtttcaatctcccagacacagtaaatgacctataaaggatatcaagtgagatttcaaaatgcatatccagcgcattttttctttaacttactatttggccccatcaagggactgagggaggaagccatgctaaaattaccttgaaagtatcaaaagagatgatggaacagagtgattcagagataagtccaaccaatctcgaagctgcacaggcaggttcacaaattttagaatagaaacaccaaagcaacatttgatattcaagaaaactgaggttttaatatcctcatcaagatccagtactcaaatagaatacaaatcatgaattgtttccaacacaaaacctgttggcgcatttcttcaacagaaagcaacccaagcatgcctcgctctctacaatcttcccgaagttcatcttctgaaagagaatccacaccttctgcttgaatcaatttatcatcttccttaatcctaaaaaagggggacatgttgcaagtaacacaattacgaggttcatcaagttatatggtaaattgaagtaaataatctgaaaaggtgaaaaagaaaactattttgtgaagtttttgtcaccaatgaggctaattatagtcataacagaaaatgaatgcagtagcatataatagcagtttgaagcaatatattaatgagagattaataaggaacaaggcctacatttcaaacctaaatttgtaccaaatcttttaggcctacatttttgtctccaattttttctttttttaaataaaattcctctctaaatgatccaaccttaaataaatggaaagaaagtattcttgtaataatttaatcatgcatgatgataccaattttcaaaagttaacatagcattaaactccaacccaaacttaggaccaattccaatccaatttgggcaccaaagttgcatcaatggatttatcgggaatttgatatttgattgagcccaatgacattatttgtttcatgaagtcaaacctatctatcaagatgaggctttggttgttgttgtagccacaagatataggagtactctggttgtgttcaatcttttgatatttatatttgaataatacaattcacagagattatttgttctcttattttgtaccctaatgacatagtatggggaggtaatattttctaataacaaggtatctttttttaattagagattttttttttcattttcctaattgtattacaaacagtttagataaaaccccaacttgcaattaaaattagtaaagaaaaaagttacaaaaacatgcattataaaatgcatcctacctccgtaaatgttttcttagcatataacgcaagtatgcatcagtgccaaaagggctgattcccatgtacttgcacatattgactaatcgtggcctacgagcagtaaagacaaaatataagtcataataccacctcacaactgagaaaaacgcatattgaagtcaaacaggattaagaaacaaacctgcttatattatctagagtaagttcatcattaaacaacttagcaaagcccaaaatttcctcattagagacagttgcacctcttctaatctgcagaaagtaaataaagcataaaaatgacaaactaaggaaaacattcagaaagaaagattgataaacaattctttgaactgaagttttaaccgtgtttaaaaattcatcaagatcttcagctgttttctttagttctccactgcgggagttctgaacttcttttgccatttctttgactgtatcctgaaggaaccttgcatactctattcttgccttgagtctccttttcaatgcttcctacacattgagcaactgagtcacccaaagaccctacaatgggcaatcaaatcacaaattcatggtaactgaaaagataaaaaataatgcacactacaaatacagagacacaaaaatggtttctaatgaggatatttgttaccagtggctgctagagaacatagaacatatattggtgcaagctcatatacaattttcaaccaaagatgctgattattagggtattttggaagtttggttttagaagagaagggaaggaagaacaaatttttatttcaaaaaaatttctctaattcaataaaaaaattaaaataaaagaaataaaatgatagatcagcatcaattaatatgttaatcttttataaacattatacagctctcttaatttaaaaataaaatatttgtcctcccctcccttcccctccaaaacctaattcccaaacatatcctggtaaaaaatggacattatgttgatgttaatccttgggagctatactttacataggaccttcaacaaaggctaggacaagccttgcagttgcttagttatagaatttctatttcccctggtattattagaatgaagaatccggctttttaaagtgagtgatttcagttgttgataagaaaattaacggttacgtgcacatgcataataaatcaaggatgtgttgaaatatacaccattgattttctcatcaacaattaaaaatacttaatttatccttactcacttttgagaagccaaatcctagatggaatgggacaaagaattcaaacagtttatgtacagtttattttaaactagcaaagataacagcaaacagccaaaaaaattcttggcaattacctgttctttcatcttgtcttgaaatgttgacggcaacatgttagggaataactttagaaacacaggcaggaggaactccataaagggaacaataatgaaaacagcaaaaggaactagcctaaagatatcggcagtagtccgcgtcagttgctgcctttcccttctggagagactcttcccacccgcaagcttcaacaacaacctggaactgatcctcacatcagcccacagcagcttagaacccaaccaataatgctgcaacgtcgacacaaattcccctttccagtgaaccagtttttttgcccagtcctccctgcagcagcagcagcagcaacaattagcaaaccaaaacaccaaataaccaaccattaacgaataaacatttcactgcttcaaatttctatctaataaattcaaaagcccgagctgcgatttctatactctaaacacaactataacctcaatttaaaatcaaatgcactctcaaccgtaaatgcaacaattagcaaacctaaacgccaaatcaccaacgaacaaacatttcactgtttcaaatttcaatctgaaacagcaaatagcaattgcagccacaacactacaatttcaaaagcctcaccgtaattgctataatccaaacacaaccgtaacttcaatctaaaatctaaaatcacatacaaatatcaacagtaaatgcaatttcgcgtaatttatgaaaccgtaactgcggacctactcatagacgcgacagctctcaacgcaggaccgattcccaaaaacgcagtccacactctccgcaacacgctttgtaggtctttctgcgcctcttcttgcgcccgtttcgccatggctttggccttcgcagtggtcaagccttcgacggcttgatcgcactcctccggtgacgcttctttccgcttctgcgccaccgtctcatcgttctcatccggttcatgacgtttcgccgccgaggccgacgactgcgacaaccaccgcacacctatcggcgcgttcagtgtcgaaaaagcgtcacacggaaccgcgctcccgaatcctcgaacaacttgcaccaatccgaaacgattgaacaagtcgtctctgtacggcgtcgttccgtgcttacaaggaaacagaggtgacgtcgtagctatagcgcgttccagagagcgattactcggagacggagaagaagcaaaacagttattcaagtattgatggattaaacttctccttctcaaaattgctcgtgatgccattctcgaaggaactaaccttggaaaagtcacagtaagagatgagaaaaaaagaatgaagaatttgtggtactacacgtacgaattgcttagatcttatttttggttctattgttagtgagaattcggttagaggttgaagatgagatggtgattgaacttacttatgcggagcgtagaaaacggaggaggagaatacgaagaaggaatgaagaaacaaagtgtggtgagagttagggtgttaggaaagtagagcggagaggtttaaggagtttttgttgtgcagcgtggggaggggtcatcgggttttcttacactttgtccttcctacttacgtcttattcattttataccctttcaattcgtgctgcttgactcgttatttaggttggtgggtaaggcaaattattttgttggtttaaagtattttataaggcaattgcttcttgcatcccatgtttgcttcttgcatccataagaaacttaaaacatgcaaaaacatactaaaatatgcttctcctttgtctaaccctaacacacctctcccttttcccctaattgcacatcacttcctttccttgacatcaatgttgtttaaggtagatccgttgcagtggttgatggaaagggtttatcttggacggcggtggcaatgacctcttgcacgaagaggcatgtgagacaggtatcgtgggagtagtggaggtcaacgtactcgttagtgatggagagtggagtaggagatgttggcactggtctagtcgatgtagagggtgacggcgtatcaccagttggagacaaatcgggagggtgcgacatggtggttggaggctagataaagtgttgtagttagggccaacaattgcagctaagcaactaacgaaaactccacttgaactccactttgaatagtcataaatttgccaatcgaaatagggtcttcaaagaatacacaagtattgtggactctatcttgaatgtgtacacggttgaatgacaccaaacaccatagtgttcccttttgtgtttttgtttggagaacataatttggaatagtttttggtgtccaaattatgtaatttgaaagaatatgggtaacctgaaaaacttatacttttatggaatacctattttggaatatgattttcattttagaaggaccattatgtaataagtgaagggtgatttgaggatttaaaaacctttaggggtggaggaagcaaaaaatcggtgcaggaagcaatggcgtctttagaattgatatattgttttaatctggcccaaatatatgaaactcttaaatccatttgattcattttactatccccaccttaatgttttgcatgtttgaggttgagaagttgctattggcttcaaccccatttgttattggcctctacaaacgtgagaaaataccttcttatccctctatcttcctcttcacttcttctcaccccacccaacccatcacaaccacaccaacgctgcgcgccaccaccttcgcctagatccaaaatcgcagcacatcaccacagtcttttcgaccacctcaccacgtgaccacctcaccaactagatctgaacgcaccactaccatcgtcgcacatcgctcccaactttagatttgcatgcacgacctctcaccagcccagccaccgtcgcgcgtcctcaccattgtgtccaaacaccattgcatcgccgcaactccttcccttggtttgtgcgcccccaccaactccagatcacatgaaaacatgcttctgttaaggaggaaaaaatatatatacacaacaaaaatgtgatttcgttttacactatacaatagaatcatatttccgttgtatatatttttcacccctacttaatccaatgaaattgtgttttttggcacccccattacataatgaaaagtcgaaaacccaatttcgttgtacaaatagaatcatgtttccacgaaaagggcatttttggaagaaaaaaggtgtcagtcccttagtaggggccattagcaatggcagcagggccaatagcaaccaccctaaggttgaagtgtctcatgtaaattgaaattgtaacatgaatagttttgagaatgtggacttcttgttcattaaaaaaaaaaaaaaaaaaaaaaaaaacagaatgtggacttcttagtgaacttgccccatgtaatatgggaagagaaattcaaagaagacacaagtgattctaatcctgtaaaattatctagatgcaatcctgcaggagttgaggaaggcaatcaaggcatagtgtaatgcttttcctttgggtaaagcctccacagtaaagatgattaatcatgattgcatggtacattgtaagggttcctgtcctgtcaatacgaactacaaagtatatccctgcaacattaaaaaatgtaaatacatagaaaaagtatttgctagaaagattcatatttcgaacagaacaagcctcttaatcttatattccttgcagtattttctggacctgatgttttcattcatggataatgatgttgtattgctgttgcatcctttctttcttttaacttgtgtgcatttttgtgttcttttgggtatttaggggtgggttcaattattgatatactgaagtcccgtgtatacatagcacaattgattaaaactcagaaatcaaaaaataatttagaccaagcatcatgacaacgaagagagaagaattaattattaatttatctgttactgcaagttcatatttatttattgtgtttctaatatatataactcctatatttaagccttggtaattgaagattttcacattctgattttccccaccttaatctgcaaaaattaaaatgcatgctagtctaactcttcaatcattaattgtctgttccaattctcttttccccatgctatgattttgatggtagggacaggggaaaggtgtagctaatgatgggtcagaatggaaacttgaattcaaattttaagataacatggttgagttggttcaaatgtgtgcagctacacatgaatttagtgtccaagtcttcaatcagttgatcttaatgtgaatttatacttatattgatgataccatctcacgtatagatgtctttgccatagcaagtgccccttttgcaaggcatgtactgggggaagcatctgaggattgagggcagatgcaacctgagatggcaaaacgaacgctttagctcaaattgagagatgtaaggtaatttacacaaacatcatggtaacaattgttagcatgacagaaattacaaaattgagagatacaactaatcatttctaagcaaaattcttcattcaatttgacaatcttaaagataaaagatataggaaattacaaaattctggcattggtaaataatgagtttagacacagatttgtatcctcgtgacttaagtacagcaatattagtatattactgtgatcgggtttcttaatgcaaagacaagatacaaattactcaacatatcaccataacaagatagcctggttatggatgtatataaggtccagcgaaaattatctttttcaaagaagagaaataaacttactattttttaacttacagattaataatgttcactgaacctttatcatccaaacagaattgagaaccacctccttactgtcaatcatccatcctgaatcaaaccataaaatttccaacttactgaaaacgtcagccaatctttagcttactgtcatcaacttatcatcaaagtgacaactattaatcagattatcaatactcttccttcaattttttaataagaaagatatattttcatttttcttcaaaaagaaaaacttggccataattaagtgaaagactgatcaccatgcatgcaacacgttgttaatgagagaaaggaacactgaaactttatttaaaagataaagttacacttcaccgttgaaactttattgtttcacgctgttgaaatataaatgtgggttgaaatccacattggttagaaatgaaaaaaattaaataatatataaatgaagaaaaaatttatgtactttaactttaaagttttaggttaaagtaggatgtgagtgaaatttatttatttgagactctaatgtaaatctccccatgtttcgaaagtcttgtgagcccaagtttttgtgtgaatctatcaatcttatcatcaaagtaacaactagtaagcaaattaccaatggccctccttcaattattttaacgagatatatcttttcctattcttaaaaaaaattctcaattattaaaaaactacattcaattttatatcattttccaaagtaacaaaatgtaaaaatgataacattttacattgataatcaatataatcatgtaaaaatatatatttacaagtttattttaataaatgcataattattaaactctaatttttattcaatgtttacaaactttaattcaaaccaaacatacatttagtgagctgcattttttaatattattgctttttgttttttttcttgctatctgtctttttttcaaccttacatacactccagttgatattttttcctaatataaggtgccgaatgtacttgaagccaatgcgcataacacattattccaaactgataaactatcatcccatatatatatatagaagaagcatcgatcttgcagtctaaagtatttgaagatggtgtgttataagcaggcagaatctcataccttgcttgttttcacatactcgtggttgtggtgggctacttgtcttgctgctgcaaataacagtttaaagccggagatacactgaatacaacaagccggctatgttcagaaaagaataaatactgcatgggtttttccccattaataaatccaaattctccagtctacacttctcacttgagaatcactgacaccgtaaacggtgatgatggcaacacagtgtgggttgcaaatagaaatcaaggtgttgaaaaggattctgcagttcttatgctgaaccactccggtgtactcaaaatagaatccaaagatgcaaaacccatcatcctttactcttcacctcagccactgaacaacaccgaagccacgctgttggacacaggcaacttcgtgctgcaacaacttcacccaaatggaacaaacactgtgttgtggcaaagttttgattaccctactgatgttttactccctgggatgaagttaggggtcaatcacaaaactggtcataactggtcacttgtttcgtggttggctgaaaacgacttaagactcgggcattcagtctcgagtgggaacccataagaagagaattgatcatcaaggaacgaggaacattgtgctggaccagtggagaactgagaaacaacaatggattcatgcacaaaacaaactacttggttgtctcaaacgacgatgaaagctacttcacaattacaacttcgaatgaagagcatacgttttggacgctattagaaactgggcagatgataacttcgaatggagaagaggctgcaagggctgatctgtgttatggttacaacacagatggagggtgccaaaagtgggaggagatacccacatgcaggaatcctggtgacactttcgaagtcaaggaactttacttcaattttaaacacataagcaatctagctaatcggagttatggtcccagtgattgccgggctatttgctggaaaaattgcacttgtgatggatacacaaattattatgaagatgcaggaactggttgttcgttcttgcatttgaattcaacggaaggtgatacttttgcaattgggggcgagaagtttttgatattggtaaagaacacccatcacaaaggtaagtccatatgatttcatgacttcctacttcacattttttatactctttccgtttttaattataattatttttttataaattttttttttataaaattatttttaatttttagatgtattaattatttttctcctatatatttttaattattcttttttcaaattcaaaatatatttcacttgtaaatttaatatgattaattaaattaattattttttaagaagcataaattaatttaaaattcttataattagaacggagacattaatttttttaagaagaaaaatgtgtattttaattcttatgttttcatttaaatttgattttggttcctatattttcaaactaatgaatctaatcctctaattctttaaaatatgtgagcttaatctttttcgtgtttaacttaacatttagtaaggggttttaccgccataaagttagaaacaaaattaatttaactcctcctataatatcgcaagaaggttattgatgtttagaattatgcttttgtgaacacatattagtctgcaaagagagaaagaaaattagaagaacgaaaagtgataattgatgtgacatgtgataatgtgatagaaaaaagagctgaaaaaagattagttgttaaataaatatttatactgagtattcatgcatgtatcattgttgtaatattttactttaagtcacatctgtggtaaacgttatagatctggaatcacacttacatgtcttcttacatgtaaacactatgcaggtaaaaaaaagtggatatggataactattgtaacagtagctgctctattatttgtgatatgtgctaatttcattctatttttcgccttgaagagaagaaaaaatctgcttgaaggttagctatatctttccagtaaacgttgttccaatattttatatattgagcataatccttcattcactatttctatttctatatatcattcaaaattttatgtaaattaatagagaagaaaagaaatagaatgaagatgaagacgctagattcagccgttaaagatcttgaagatgagttcaagaagagacaagatctaaaagtatttaactttaccttaattttgtcggcaaccaacaatttttcaccagaaaacaagctaggacaaggaggatttggacccgtttataaggtgacgtgaaactattgactttgtgttgtaagctgtaacaagttatgacaaggaggatttggaccagtttataaggactaataattttttgttgtttagggaatcctaccaacagggcgagaagctgccataaaaagactttcaaaaacatctggacaaggaattgtggaattcaaaaatgaactaacgctcatatgtgaacttcaacacatgaatcttgtacaactacttggatgttgcattcatgaagaagagaggattctagtttatgagtatatgccaaacaaaagcttggatctctatctattcggtatgaaatatgttggagtttatttaattataggtgatgctttaatttggaagacaaattaagatgatatttttttaatcatcaagcaataattccaatgccatcgtgtagagaaacattaagttttcaacggaaattttcattaatgagaaatattagtaacacattttctaatatattttttaaaacacatatttattcatcgattgaaatttattgaaaatcataaaatttggtaatttaatataataactttttctcttaatttcatattttttaataaattttaactaagtaaaaaggatgtgttaaaagagtatgttcttctttcatgttatgggcgattcattgacttatgctttcctttcttgaacatataactgtgtaaatgtcatgctttgtttaacttttttccatcttgaacataattaattaactataactaaactataccaatgataaatattgctaacatattccaattaaaaataagtttgtataatctaacaaatgtttccgagatttagtaacgtacacatttatttttttagttggagtatgttaacaagttataattagatattatcttaaatacatcaattaaatatgtaattgttaacatatatacaataagtatgtatacattaaattctataatatatactcacaaagattgctttatttttaacacttgctttatttccattgagaagatagcactaaaagcaagtttttagactggaagaagcgtttcaacataatagaaggaatttctcaaggattactctatcttcataaatactcgagactcaaagtcattcatagagacttaaaagctagtaacatacttcttgatgagaatatgaatccaaaaatttctgattttggattggcaagaatgtttgcagatcatgattccgcaagtacgagtaggataattggaacatagtaagcttgcaaaactctatcatcggtttcaagtgtagttgaagaaacataaataggtttgttttgccaagttataattaaactctttttttcagtggttacatgtctcctgaatatgccatggaaggaattttttctataaagtctgatgtctatagctttggagtgttggtccttgaaattatcagtggaagaagaaatactagcttccatgaggatcaccctataaatttggtaggacatgtaagtgaaattagtctcaacgacttcttttaatttgattttttaatactattttctttatctaatttgactaaaatgctaataggcgtgggagttatggaatcaaagtgtttctttacaattaatcgatccatcacttaatgatgattgtttgatcctgatgaagtgaaaagatgcattcaaattggtctcttatgcgtagaacaagacgcaggtgatcgacccacatgtctcataactttcaatgctaacaaatgacagtgcagtaattgccatgcctcaaagaccagcattctatgtggaaagaaattgttttgacagtaaaacatcttccaagagttatatacagcttctacttaaaaattactacttccttgtaaatatataagtttgtggcacgagatatctattccttatttttgtttttataaaaaaattattttagaattatttcctgtaaatttttccataatttacttatatgttaggacaacaaaacaatatatatatatatatatatatattaattattgactattagatattaaactttccacctttaccaaaagatgttaaattttccaattgtgttatgtgctggtgggggagcatgcactgaatgacaaatattttaaccaaattaaaaagatttgtacctctttgcaaggctaagcacttgagaaacattggtaacaaaagatcagttctaaattaagcattcctagagctttgaagcccttgatcagaaaagatctaacagctaggataaatgcattaccacctagctagcgttcttgttggaaagaaattctattatgcttccctttaaaacaattatcacacttatgcaaatgtggacacctcatgccagacatcagacaacacatccattttggttagttcaactatgcctttctcacatgtaacacaacctttgatgtcataacttaactttttcaactagctagttccattgcatgaacaacatcaataaacatttttgcttgtgtcacgtaaaggttggaatatttcatacgtttagaaacaaccatagaacactttggtgagtttccaagtatcccgattgtcataagcttcatcacataccctagcccccaaaagatcctctttttgtgtttctaatttgtttcccttttttttctccataggacatgagtttgtgtggtttttgcaagtggaattctataatatttttatctaacaaatgttagtggttaatttattattttttgttaatagaattgtatagtggttggttgtcatggcagtttgcatgattctcttctcgatctttttttttccttaaagacatgagattattttgatttagatcatagatattttttattaagacaatctgacttcaatcttgtgaaattattatgatcaacaaatttttctctaaatatttaacacttatatacccaagacttgaatttgagtagatctttctcatggtgaaagagtttatgtttaggttaaaaaaattataaaaatgtttattatattattaataatattttaaattttctataaataatattatttaaaatatttcattttaaaaaatattttgttatgcatctttgttttttttaaaatattagaaacataaaaaaattatatttattatttaaattaaaagataaatatttataaataatgattattttatattatattataagattatgtcaatatattatttccggaaaatggtcatcctttttattttaacaaataaaatataattttattattgaaattttattattaggttatattatattattaaaatatatttttaaatagttatattaatttaattatattttaaatagtaatatttcttaaattttccattattatattatgttatagtgttctttggaaaattaaaaattaaaaaaatgatgacgcctaaaaattataatatagtcaattttttaataactattgtattattatgaatcatttaatctagtcttaatatttatttattacttcattgtaatgtatacataataatattatcttattaattgtaaaaatgtctaatatgaacatataaatatagaacaataattttaaattattatttatgaaatatttttataatgttgatattaatattttaaaaaaaatctctaattatgtttgagttagagaccaaaaatttggtttgaaatcatcgaacatatagatcaattagtgtggaattattttagtttaattaattgtcttagagtttgaatttatcctggatatgtagttatcaaataaggaataactttgcttccctaaaatggatactatgtgctatagaaaagaaaagaaaaaaaaaaaaaaacagttagaaacaaatttttagcctctaaaatggatcaatagcgactgaagaatcaattcccattttatttcagtcactaactgaaaattttgtctttaattcaataacaactgaaaaattattatattttaattagagaccaaaaattcaatgtttaaacatatgagtttgcctaaaaacacatatttgagttagagaccgtctattagtgtataaaatgagttaatagtgacaaaaaaattgtctctaattaaatttcaactagagaatattagtctctaattatataattaatttttaagatcattaacaattgaaacattagtctctaatagacggatttagagactagttattttggtttctaaatcaatttctatagtaattgattattttcaatttctaaatcaatttatgtttaataaatttcttgtgttaagtatactttgtttaccaacaatggttagtttaagtgatcggagtttgaacttcttaaacatgtgatcagatgttcgatttcttattggtaccatgaaaaaattattgttggaaagagacaactcattgatgagtgttaacagattctttgaaggagtttaaaagttttgataatcaatcgagatatttctttgcaattagcgcaaaaaaaaaaagtataccttgttttagaaattattggaataaaattcaaacatgaggccacaatgaaattattaaaaatacaattattaaataccaaaaaaaattattaacatatgtagccattctttatataagattagataaaatgatttacaaatttatggcttaaccatataattttcatggtaattaatgtgtagaagccaaaatgcttgttttttgatatcatgatgaagatccaaaatatcataaatattttggtgtgtctaaaatatttttggaaatgagagacacaaatgtaaaagaactttctcccttcatagaatcttggattctcacccctcctatggaataatttaagtggaaaacttaactaaatattctttttcaggaaaacttaattccaaccctcctaattctgcagtcattcatctgtgatggattcgggtatgcttctgttttctaattaatttatatacctttaatcatttgacaaaaaaaaacccttttatttaataatggttatcatgtttgatatcttcctcatttctaatacaatttgcttgtacaaagctcttcaatcactgttagcaaccaaagctgactgagacattaggctttaaatgggccttgcaagtggcacgagaactctcctttgataaaattatggtttaaactgattgcctacagctgttccaagtttggacaaagaagcaaagacaagctttctcctattttgagactatggaccaatgcagagacaagcttttgttcgatgactccatgtacagacattcttttctcatcaatgcatgatatttccaccctttacgcaaaaaaaaataataataataaaaataaaaaatcattgaattctgcttgttacgttctaataatttgtacgttgttgcgtgtttttaatgaagcaaattattgaattacgatacgattcaattttttttttttttttgcatttgaaaaaggttattctatagataattaatttcattaccgtgatgtgtaacatttttccttttacaagaataaccagatgtttttttagatggtgtattaatagatagtcaacccaataataaaacatctataactaaaagttttaggcctatcagtaaaaaaagttttgttattaatttttataaatgaaaaataaactcagaaagactaaagttgatgagtcagaaaggaaaggaaacgggttatcaaacaaagaaaggaaaaaagaaacgaaagaaactcaaaggagtattgtcgcctttttttttttaaagaaacaaagaaaggaaaaaagaaacgaaagaaatcaaagaagtattgtcgcctttttttaaaaaaaaagaaaggaaaaaaaaacgaaagaaactcgaagaagtattgtcgcctttttttaaagaagattgaattatttatatcatcatcaatgtactactgcaactactactatagtaattaaattatcactactctctcccttcaattattttaataagatagatctttaggaaaagttacaccactagatattattatttttgtggttatttttcttttaagttagtgtggcaattaatagcaatagcaatagcaataaattaattactaatattttattatttaagcaacattatttatgactaatatatattatcggtaaaaattatttattaagacaattattaagaatagccagtaaaaaaattatattttattcaaatcatatctaatttttatttctctttattttttcttttaaaaattgtgactaacgcactaatactttttttagtaattaatcgttctctttcttgacatactttctcgcttttaatcgttttcttttcaacaacctctctcactcatcacaatgactttttccaatcattcattttaatcatcctctttctcaacgacctctcttttttgtaatcactcaccgcatttgacaaataaatatcacttttataaaatgtgtattatctcctttttctaaaaacttatcaaaattaaggagaaaatagaagaaatggaagagacagaaaatgaagagaatccatttccctagcaaaaatgcttctcatataatgcttttagatatctctgtgtttattttttagagcatctccaatataaaatatctatttggatttctttatcaattttttgtggtctatgtggtatttttttgtggtccctaagtgtcatgtcactcataaaaaattcacccaatattttattccaatgcaagaaatcacaaaatactcaaaaaaatccacatatttatatttttttaataaaatttaatatttttttcaatttttataaatacaaataaaaatatgaataattgaagaaaaatgaaatataaaataaaataaataaaacataatgcctaatcatataaaataaaattttacataataataaataattaaacacaataacatcgaagtaaataaaaaatatagtgattcttattccatcaaacgactattttgtttatctcttgcaattttatgtttttcatcacttcctttttttttctccttttttgatgcgcatttcttcttcacttcctatttctttttttctccttctttgatgcgcctttctctgagccttcttcacttctccttctctgtgcatgaccttcttgatttcttcactcacttctccgcgcctcatcgaaggcccttcactcgagccagcttcctcgcgccgcgtcctctgttgcggtcccttcaccgtcgtcgggcgtccaccgtcgtggtcccttgtcgtcgtggtcccttgccatcgcgatccttcgccatcgcgatccttcgccatcgcggtccttcatcgtggaggtccttcgccgtcgtagtctttcgtcgtcgtggtcccttcgccatcgcggtccttcgccgtcgtggtcccttcgtcgtcgggccatcaggttagttattttccctcttcctcgcgctagtagttgatctaaaacgcatttctctctcctcaagtttgcgttccttatataagaaacacatttctcccttcaagaaccaattccgccacataagcactctacagtgcaagacttcttcacgaaaccggttcgtcatcttaaggaacgcttgaagataccgtgttggagatgctcttaatgttagaattttgtgatggttttatctttcaaataattgtgtttgtgatcataaataaaggaacagtagaagatatgagattgatttgatgataaaatgtgaacgaaaggagagataagttggagattcaaattctttggctgataaaaattaataaactaataattaatatttattgataaattaaataaataaataaaaggtagatatatcaaagaagaaaatgaatgattgagaatggatgtatacatggaaattgacggataaaaaagaacaaaacatgtaatgtatgttttatctatgatattgataaaatataaatttttaaataagagtgttcgtgggtcggtttgaatcggttttggccaaatttaggatcaactcaatcaaatttgatcggttcggttcggttttcagaagaaaaaaaatttgaaacacagcccattcatgaacggtttggttcggatcaccgagttacctatttaattttttaaaaaaaactattattttatatcacgattctttcaaatatctcatacaattaacataatattatcaaatgtatgaaagtagtaaaattgattcatataataccatcaacataatattctaaaataaacttataatataaattaaaacaaaagatttttgaacaaaatttagtataatagtctgaatcacaattgtttcttacaaaccaaattttgttataaccaaatttattgtaaccagatttgctaaaacaaacaaataaacaaaatatgattcattaatattataaacatgataaataaaatatgaaaaaaaagtgaaacaaataacgatatacctgaaagttttttaataaaaatgtagatggtcaatttaagtcaattgatatcctagctttccagtcagaagtaacacgtctcaattcatcaaaaacagagacaaaattggtatcctagtttcccatatgtgactttttctaaagtcaaaaaagaagaatacaataaaatagttacatttacgtttctattccttaagcaaataagtatctttaaatcctgatggagagttgaagaatcagacttgtcaaacgcttctatatgatctcacaacaattctctcaatgatgcaaacataaactctctaaactctaatattatttggaatggaatgcatacatgaacaccaaaatatgtttctatttatactaatttaaagaattttttaatacaatcctaaatatattctatcatagcaatcttaaaaatattctattatattatgcaatgcaatcttcaaaataatctatcatattttttaatgcaatcttaaacatttacaataccacacctttttttattgtcaaatttttaaattttttttaatatatatatatataaataataaaatttatattattattatgggttcacaggtttggtcatcaggtcaacgactctgtaaatctaaacacgtgacccaacccgtacatgaacggttttgattggttcgattcggttttgacctaaatatataaataacccaattcaaacggttcggatcggttcagatcaattcatatatacaagtgacctatactcatgaacacccctatttttaaacaacaaagaagaaaatatattaagaatatcccatacagcacaagttgtaccaatattggagcaaaagttacagaggttagagaaagctgaataattgaaaatagagtccagcgaataaacaaacattcctatcaccggcctatattacccggtaccgattccatcatcccacgcctgcaactgaaaacccattgatgtgtgcatctaatacaaatacttcattacagaaaaaaaccaccaccagtagatacttagcattgaaaatcttatacctcccacctactaccaacatcataagcatgtccttgcatagttatgtcctaccgatatttaaacagcactttgaaccttggagatttattcctttgtgcaataaatattaattttactaataattaatctttattaaaaatttaattgattatttttagtgaaatctttatttctattatgttttttatattacaaggttcaaattcaaaactttaattaaatatatcaaattcaattcagtatcactcaaatcaaaaatttgttagtaaaaatttagtgttaagtagatgaatttaaaatatcacaccgaataaagttaataaataaataaagcttataaaatagtaaaagccgacgaaagaaatgttatgtgggattgagggagtccattccaatatgggaaacgaagtaacttagaggtccatttgatactctatttgttccaaaataattattattatatgttattttatcatacgaagaaaaattaagaaataaataaaagcagtaactttataatattaatattataatatcattaatttatttataaattttgttgtacattattggtcttataagggatataaatgagaaaagaataattaatatcatattaaaaaactagaataacaattattttttacatgataatcataatgagacagactgaaagagagtattacacttcctaaaaatgtactttctccattttttatctgtcttttaagattattatgtaaaaaataataatttttttaattctaataaaatagtcacgtgatttcctttttgccttttttttttcttatttcacaataaatgcatgagcaaaataattaaagattagaaataagtatgaatataattgataaaggataattaatgtgatattgaactttgtagataagagataaataaaacaaattaaaattttccataatccaacaacacttgaaaagaaacagagggagtagaatatgtatctcctttttttgttgtcctgactcttcataattcttatataatagcatattatttaaaatagtatgagaagaaaaaaaatagaaatattaattataattttaaaataaaacaaattaaatgaagagactggttaaagtgtccaaagttagaattttgggtgcgcatataatcgcattaaatactcaatataaaacttttcgttcataaagattttattcaacttaattattattaagatgatcttcagtaaaaaaaaatatatgtgattaaaaaaaagtgtttaaagtggtgataactatattttgtcaccgcatggttgtcatagatggcataaataattattatattaattgaaattaatatttaactcttgctatagaagaaattttagtttttaaagattttaaaagaattttctttttaagtactgtgtaaaaaaatttgcactaacaattattagaaatcatcatcggtataattttaagataatcattataaaaattaacaaatttaactaatcatacctgatcatttgtaattaaatgataatctaaagactatttacattatatagactatatatttttaaaaaattaaaaataattaatttcagtcttaaataatcaagtcattactatttaaaagagacccgtgaattgtgaaaacatcaaaaccttacggtattcttaatataagatattatttagaagaaatagataatcatttttataagacattttacagtttctttgaagcatttttttcttattaaatactctacgtatctttgtgttttttattgatgtgttctattattttataatgtccttaaactttaatatttttatatcatccataataaattaataattattaataaggataagattgatatattagtaatattttgaaaaagtaatcaagcaaacttatgtacctatttttatcggtgtcttatattaatgacgggagggagtggtaaataaaggcattggaaaagtatacataaagaataaaagtatacataaaagacattggattagtgattatgatccaaacacgcaagtgtcttcttagaatgttttagcgtgtgaattgcaaaaacttttgaatgggcatcttaagatatggtaagatttgtctttcattattaaaatttatcatacttttagacatctaaatagtagaaattaacacttgattgacactttataagtataatgatgaaattaggagagagaaataatatataggtgttagttatgtttttgaaaaaaaacaagtgttcaaatattattgttttatgagattcttcctatgtgtgctctaaatttttacttttatacatttaaaggaaaaaaaatcaaacaaaccattaattattttaggtcttgaagacggacttctgaaaaactattcttttgttaaaactacttctgatgagtgaatcctattttgggaggttgatatatttacattaatttttctcgagtttaactcatgcttcttaatcaagtcttattcttaaaatcacacctgacaaatcataaaccaaaatgatatatattatattctcgaatttaactcatgtttcttaatcaagttttgttcttaagatcacacctcacaaatcataaataaataataatcttaagtcttgaagacatagaattacttcttgttaatttgttattattgaaactttattgtataaaattatttgcttcctcttttctctatctttatgtttctttttattttccacctaaatcttatattattattacttttactacagattgcttaaatgtgttttcaaagtacgatgactttgaaaaggagttaactaagtcatgaaataattttcttacaatataaaatcataaaaagataatataaatttatgtatattatattatttaataaaaagttatatatatgaaaataaaatgaaaactattataattctttttcaaaaaaatatataatcaccaaatttcaagttctcataaagtagttaattgcccttacataattttgcattatccatgagttaaaaggtaagttctatcgaacatttttaactaattagttaagcatatcaactttcactggacaaacttttcagcttttaaatgattaactgctaatttgacaaaacattgccaaacgttcactgagtgccacagcagcggcatctaatttgattctataaaagttatacacaacatttttttattttttttttgtgttgggacacaacatatatcgtgcaaaaagacgcaaatagaagcacatatggtagtcaataatatccataagtatagtgtagaaacacatttttattagaaaatttatgagaataaatattatatgttgtttatggtacatttttcaaagaaaaagagatttaagattggttgagtaattaagaaagaaagaagaaggaaaaaatttcaatttgatcacttttattaataaaaataacaaattaataaaaaattaatatttattgataaaaaaaaattatcgaaaggagttgttaccgacccgctagtggacaggaataaaggtgtaaccatgcaaattcattttcaccacccacaaatccaagctcaagttaatattattcaaattccaaaaattattaattgcaatggctattgacagtacaccaatatgaagctcacaaattggttttgaggatgcaaccctgaacttgcatgtcttccttgccacgttgtatgtaccttgctatttatttcctgcacgcattgaaatgtatcatggtattgccaagtttagaagacaacaaagaagtctcatcaacaactactaaagtctttttgcatgtatcaacttgtgatctcaactctaaaaacacagtaagtgagtgcttaccactagactaaaaatactagactaaaaactataattaatagttaggacataactttttatgctttagagcattagcctaggtgtcactattcagtgtaactcaaactcacatctgaaggcaagaagctgaattgttggaatatagtgtaaaatgaagttccacattaaatagaattagaaaaataagtacgatatatataagtgaggagaaaatacataaaatggataatgcaaaatttgggagcctcatgtataatgaaagcaaaagaatatgcatcaacacttctatcaattaaaacttcatcttttgtaaatctttataataatactatatcacaatatttcttgaaatgcttgtccattttctttacttattttttcaagtatggatttttaagtattttctttgctctctaagtgttggttgtaatttgtatgtgaaaaaagttaaatatcataaatttttggagctaatcaaaagacatggtcatggaattttatatgattgtgataattttgtatgtgtgtggttatttggtacacatatagtaattttgtacgtttgtgcatcatctatcatttaaagattacagaatcatctatcaaatttaaatcataattgatcatattctttaattaagaaaagatagaaggagaatctccacaatattatagataagaatgaacttctctctttgaaagtagtttaatctttagttttattcatatctttttacgaatttgtgagaaatttgaggcttttgaaagctgaatagcggaacaataccgttaggatgaatcatgatcattgttcttgctattgtatgtctatgtttattttttataggattgttagttttgttctaatcatgagtgactagccccctaatcaaagattatgatgtaaatgtccaaatgtattcttatccttgttcttaatgaaatttttcatcattttatgttaattaattattttccttggttaatgtttatttgaaaccggtcatactaatactcaattaattgtataatagtgatcatctgcatgtaattggtagatctagaaaatattttttgtaccaaattgcatgatcaaactgttttgtaatatccgataaattagttaatctttaattaaacatacataaattaattttatcatttgacttaattgataatatatgatcattagagtattgatttaagacaaacaacatttctgatcttgacttagtttatttttggaatccacaattaactaggaaagatatttcattggaatgttgatttaacgcacgtcaacttttagcttttcatccttttaactaatgcatctaaaaataaaaaatggataaaaaatttcaaaaaaaatttataattagtaactaatggaataatagctaatttgaccaaacacattgctaaacgttcgttcaccgagggccacagcaaaaagcatctagttgactattgaggacaaaacagattccatataactaaagtcacagcagttggtagacataaaaagcaaaaagacgcgaatagaaacacatttttataagaaaattctagagaaaatgttatatgtcatttatggtacattgtacagagagagttgttccagaccctctagtggacactaacataggacgaaccatgcaaattcattttcacgctccaattaatattatttgaattccaaaaattattaattgcaatggctattaacagtacaccaccatgaagctcacaaattggttttgaggatgcatccctgacttgatgtcttccttgccacgtggtatgtaccttgttatttatttcctgcaacattgaaatgaatcatggtaatgccaagtttaaaagacagcaaagaaggttcatcaacaagtagaacagtaatatcagtctttttgcaactagcattgctcaaatctaactaaatgcccgagtacagacacaaaccacaagggatggttgattttatcatttcaaggtataacacttcaccgtttgaattcctccaagacactaaaattttataaggatatccgtctaggaatcttaccaagggagtttaaaagtatctttccaccatccttgttttgagcaatttgcaacgattttgtccaaccgtgaaatgacctgagaaaatgttggcctgacaataggtgttggatcccaacattcctcaatcaacctgcatacaccatgatactaagaccgttttttaaattaaactgaagcttgaagacataatttaacttcaaaatacactaactctttcaactcggaggataatgttttgttttgatcttgaatgctggtcttttcccttctaagcacatcagtctaactgcctcctccgaggacatgggatggaagggatgtgtaccctctatcatctgggtccataaagataataaataaaatttgttgatttcaactaatatacaataacatatgaagattagagagataaatttagaaaatctaaatgattttggaaaagctagatttttttttttcatgaaaacagaagtgcatcagtaatcttagggaactacaatgttacataacagacaagaaatgtcaagacaatgttgtcaaattcctcatccttcccccagcccatgcccttctgagctctgtagattgagtgtttaccactaggctaaaaactatagctaatagtttggacataactttttccactatagagcattagcctagacatcactgttcaatataactcaaactccacgttctgaaggcaagaagctgacccaaagcaataaaaacaagaatctcaaagaaaaactaattggaaaactaattaatctgatataagaaatcataacatgatgggtgatgcaaaaatctggtacctcgtatataatgagaccaaaagaatatgcatccacacttctatcaaaaacttcatctttgtaaatctccggtgccacgtacaagcctgcaatgaatacagccaaatcattaattgaaccatgagagatacttttagcaattctaatcttcaaatatttttattagactaacatataaaacactataatgcttgtccattttctttacttagtttttcaagtatagattttcaagtaaattgcattgaagggccaagggaacatcatttagaaacagaacgagtatcgagctatcaatggagaaaattactctccaggtgttgagtaatttgtatttgaatctttaaatcataatggcagttaatttgtatgtatacttcattcatcattgaaacggaaattcctattgcattcacaaatctaatatgttgaaccagttacaattaaactgaatcttaacgcaagaaaatgggacactggaaaacaaaaaccttcaaataaacttggaaggagacaaaatccaagaatttttttttaaaatacccaaaaacttacttgaaagatcaatgttaggctcaggctgtaccagctttgcttcatcaggtgacattagtgaaaatctcacagtgccaaatccagctatcttcaattgccctccattattcagcaaaatatttctggcaccttaccaaaatttcatatattaaaggaacagtacgagaaaaaatctaattcaaaatgcactcacagtcataaataaacatcaaattgtattaagtgatcttactttggctttaaatcacagtgaataaccggatctggtttgcattcatgaagatagttcatgcccctgctaacaaaaaaatatcaagatgtcttgtataaacaatctggcagaatctccaataaatttataatcatttggtacattgtaagcttagcaagctaagaaaatgaccaaggcgacttttagaaatcaatgaccaaccatataagatataatagaagtaagaaaggacattaaagtttttcaaagatgattcacagagatttcgtacagcatagttccttgaaatggttacttgcctggcaatatcaagagcaaaccgtagaacttttgatggagacaaacgccctttcttttgaagatagcttgccaggtcaccctgaaaaatcaacattgatatgagcaaagaaaagtgagttagatacaagaaacttattttgcaaagatacagagaacatagagggtaagcctaccttagaatggtactcacgcacaatcatcataggtatattctgggtgacagctccaacaaactggaccacattcggatgtcgcaccctttctaataatgtgagttcatgtttgaaagcatttctgtgtgaattattgaaatggtcaaaatttagagccaatgttgagtaattaagtacagaaaaaaaaaaaaaaaaaaaaaacagctatttagaccataatcaacttgaccagaaatcaaagtgaaaagtagtgatatatgcagtcactcggacaggaaaccagcatcaaacaacccggttgattggcaagaagcatatcatacagacactcacaagtcacaacaaacattttcaattgctaaggtgtatacatacatggtatcaggatttgaataactgtccttgtcaagtatcttcactgcaacctttgtgccattccatttagctacttggtatgttccctgcaaacagattgaccaaagaacaatgaagaactaaacaagcaagtttaacccctaatgtcgaatgtttatagatacattaactcaattcccacaagtatcaacaacttttattatacatgaagcatcagcacattaggtaccaacaattatcactttgctggtattacttgtaataaaccaaaagaacaaaatttaacaggaaaaatgaaagatttggggaaaaatattaaaataaaaataagatagttgccaaaggaagcacggtgcataggtcgcgaaatttggcaaagcaaatatttaatgcacagtagaaaacatcacatgccacattactagtcatgcaaattacattactaaagcaaaatgttacagcacagaatctcaattgaccaatttgaaagcaacaataatgctccctcagagtgagaatagttgtgtcagttgcaagaatcaacatgccttaatttccatgaacaaaacaaataccatgtccaggtggaatccaagttgtctaataagccaaaaaagccataactattgaataaccaatcaaatgtaactaagtgaaagaaagagaaacatacctttgaaataccatcactcttccgaacctgtagctctaacgggttgagttcatattccggaacttcacgaggattcgcaacagtcattggagtcttcctggttttctaaccacgtcaaagataactaatcagtaagtccctaaactgaatccaacatatttacacttacttattgatccataacaaacaaataacgatagaacaataccggcacttttgctccacgagccttcaacatgtaataaatttctgtatttccataatatttggcatcggccgccgcctgcacatccacacatccatcaccacttaacacagaaaatcaaataaattttgcactctcatccgatctcaaagatttgtatgttaaagtttattgatttgtttattgtttacaaattaaactcatcttgataataacaaagtttaattgccaattgccatgcactttttatattagcaaccaatcaaaggtcagatgaattttttacagtaatcatcataggtatagtttattgaattttatgtaaactaccttaaaacttaaaaagttatatctgacataattttttttatcaaatgacaatataaagagtgattattttcacgatgatagtgtcatcgtggatataaacatttttcatcatgagtagaaacactctttaaactttcagcatacagagttgtaaaactaatttctcttttaaataatttttaaaaattaacaaaattattatttatgactataacttttttcaataataagataatatatggcgaggagagaggagagagtgaaattacggtgctgccccagcgatcgcgagcgtcgaggttggccttgcggctgagaaggagcctgacgacttcgacgtggccttcgcaggcggcgacgtggagggcggtgcggccgtcgaggtcgatgctgttgacgtcgatgccttcgttgagcaaatcctcaactcccttgacgtcgccgcggcaggccatgaagaggagctgcatggtggagtccaggttctccggcacggtgagctcggcgttgtcggggccggggctgcggcgaatcggatcgagcgaggactggcggccgaagctgaagcgctggttgatccgccgcggatccagcgaggcctgccgcgtgaactgccgcgagaggttcctccgcagcgaacccgacgagaactgccgcgagatgccgcgcttcagctgcgcggcaatgctttccatgccgccgcccagtggaggagaaggaagttgcaacgcaacaaaataaaacttctcacaaatgaaaacaacaaagagcgcgctctacatgttgatatggaaccaaccctgtgcaggttaggttaggttcggttcagttcggttcggttctgttattccaaagagaaaatgaaatgaatcacgcgaggaaacgcgattgcgagaaagaaggcacggatgtctctctctctctttccatcgcttctgaattgccgcaattagacgagggtggtgtgatgcgtccatgtgtaggggtagtttcggttgacttacggggactatcatggttcagtttttttctttttttttcttttctgaaaaaaataataataattaggccaatatactctgacattataataccccgttatacctgtacgtaaatgcttggacccgaccaatgtagcaaaaacaaaacatttgtaatattttttttttactctaatctattttataacaaattaatgtatatattaaaataaataaaacttttttttcattttataattgcaaaactagctctcattactaactgtagttaatatgttgttaacttccttacacttttctctatctatcttcaattattatatactagtcgaaagatcgaaatattctgtacttttctatattttttaagatttaaatacatcatgtttttaatttagttgttattataaaaaatatcttgttattttggtttaatatatatactatatatattgctttttaatctctatcatatttttgttcgttttacattaattccttttaaaaaataagcacacactaaatattttagtaaagctttcaaacagttaattggatcaaatctctatcatattattgtccacttgtttatttttaagctcacactaaatattattagtaatctctatcatattattgtccacttgtttatttttaaacacaatttcaatcctaaactttgaagtcaagcgatgcatgtgtgatatttttcagtaagattttaagtttaaattttatctcctaataaaacctttaactagagagttgactcaaatgttgtagatcatatttctaactcaatgacccacgcagtttgactcattcaaactatttttcagtatttttaataattcgatcagttcgtatatagataatatataatataataataatacatgcaattacagtgtaaagaacttactctattattcaatcacatgataattatatttgataaatttattatttttaatataattaccttaaaattcatactataaatgttttaatcagttaaaaatatacacacttttacactgaccatgtaaactaaactccataaataatatatttttggtaatttttaaatattaaaataatttatagaatttaattaaaatgactaataatatattaatatggagatgttttgcatttcatttaattatacattttctgatctgttgattttataaaattattttaaaaaatatatttaaagtaatttctaattaattgataaagcactaacatgaaaattaaactgtaatttaaattcaaattaacttgctgcaaatataacaataagtctctaataaaactataactaaacaaactttcaaacttaaagtgaaagagttcatcacaaataatgtgattaggcatattagttacaaatgactcgtatataagccaaaaaaaaacattcttatatttaggcatggcaacagggtggtattgcgttctcttccccgccttgactcaaaaccactccccatctcgccccaatttccgtcagattttaaaatccatctccatcttgtcctcggtatttgattaaaattaaaaaaaatatagcttttttattgaaaaattggatgaaaaggctaattacttaaaaaaaaaaaataacaaactcacattaaaaatatggatcataatttaaaattgcaaaacaaatcaatcaattcaattaaaaattacaaaataatatattttttttttttttttaatattatttattacgaggcgggtgtgggtgctgggcggataccataatccatatccgccccgcttttggctatgggggaaactcgaacccgaattgataaactcgattttttcccgttaaaatcagaacagattcagtggtattcacggattcgagtccgctgccatgcctattatatgttgaacttaaataaagtaaatttaaataattttatcttatttaatattatcattcttaaaatactctttaattaattctaattataatttcagtgactttttttattcatgaaacaagtccaagaataacattttagaaataatttatttttatatgagattagaaaattaaggatgtcaactaaatttttaattagtataaattattatttttgtttatatacaattcaaaggaagtaccttttgccataatcaatttaaaaaaatcaattataaaacgtatcttttatagtttaattggaaatgtctcataattttttttatttaagtaaaagttataaataaaaattaaggaaatttataaatagtttttatactaataatatatttttactttatagaataagtaaagtacagaatttaaaaaataaattatttaaatcaagacacgttttcttttcgatgtagtgtgttaaattcaaaattttaaaatcaaatttagattaagatggaaaaatcttaaatttaagtttgcaaaaaataattatatgttgacagtgtaaaattttttatcatatagtttataatatagaaaggattatattattcaccttcttataataataataataatatattttattaaaataagtaaaaaatatataaagcaatttagacaaacaaactaaaaaaaagtttcttattttattaaaataaatgcttagtcaataaataaatttaatcaaatttatcatatactttgtaatataggaatggattatattatcaccttcttataataataataattatgatgatgatgcttttgctttaaatgtttttattatggtctaatttggtgttttgaaagaaaaaaataaaaatgtgaatttgatacaatgctagctagtactaattaacgtattatttttattaactatatttttaatccctcaaattaggtcactttagttttggtgtcgtaaatttgaattttattttttttagtctttaaattttgaaaattatttttttggtctctttcacagtaaaaaaacatgtcacaaaccataccttcaaactgtaaaaataatgcagaaaggtctaaaaagttaatttttcaaattgagagacagtaagagataaataaaaattgaaccaaaataaaaataatataattttaaataactaaactaactaactgtttctctttggatagctccacatgaaactgtcctcttacaagttttcctaaggataagcctgtactcaagatattttgatgcacaaggccatagcaatttacaagtacatggaattaattggctacccaaagatgaaactaatgaaatcgaaatgtctccatggggtcagcgacgacttcataattaagtacgaattgtgtcgcctctgattagattacatgtgcaaaaatacaattatgtcggcttggaccaacgtgtgtttaaaaataataattactacatgttgataattctgctatacttagtttgttttttgtttttaattgcatcttggtgacctatgtctttggaattggaatacttgttaaggaattcaatttttaatgaaaaaaaatgttttttttttttttttattccttcaccatttgctttttttttctgtcaacaaaaaaaaacagccatttgcttcttcttttttattccattgttcacttatttttgttttctattcttttattacatcatttattttatatgtgactatctttcttttttttttctacctttttcattacatctgctctagtacttaaggtatctcacaattaaaaatttaagaatactgatctcttaagttgcaaaaaggttaaattagtttatcactattctaatttatttttaggtttgattttgtcttttaattttttaaatttattttgatcttttaatttttaaaattaattaaatttaatttggctatctaaattaggtcaatataataacaaatcataatttgtgataacttaaaatcaagatcaaatttgaatgatatgatcactcaaattattttagatagtagtatctaattaataactaaattgaaaaaaaaatgagaggattaaatggaaccaattttaaaattaaatgatcaaattgaattaaaaaataaataaaagaccaaatcaaagttaaaaataatcaaaggaaaaaaaaagctaatttaaccttaaaaaatcatttaagtaacttttttcccaatatatacacgaaccttaaaaccaatttttaactacgcatgcaatacctcaaaatgaggcctacatattaatcacttctcacctaaaaatggaaagataaccacacgatagtccttgtaggccacccatactaaagcattaaagagattgaaggtttcctttcttttttgcaagagacaagaagatggacacctatgaaatgtcattttgtgcgagtatcacatgatcgactcattttttgtgataaaataatatatttagtagtcactctatttataattttgtctttcttatgtctttttttattaattttctatttgcctcgtctataaatgtttatgcgtgtctcttaagaatgggatatatatatatatatatatagaaaaatcttgacattttaaggaaataagttacaaacttttagtatttaaaaagactaaaggtatggattgaattgagattttataagatttcaaaatactttttgttataacaaagctttgcgtatctaataatcttttaaaataatataaacaagtattgtagtataccggtacttaatcacgataaaaataatttattgaaatatcaaaattggtgatatttaattgacacttttataatttaaaaagaagtctctagtattaaaaaccatataaattttaatggattttgtatacttttttagtgatatataatgtcacatttgtccaacaatcacattcaaattcctaagtctttttgtcattgcatattttattttctttaatcacaattttttttccttgaaggtggtataaaatattggtacaatatttgatcatttattttttcccaatagtaaaaaaactttctactatttttgtctttaatcaacttgtttggatgaattaaatgaatgtatcaccaaaaagataatgtaaaaaatatataaagatttttggatacttgaactttttggttgcttgatcaaaacaacactgacaatctttactttgtaggaagtatattatgaatcgattcatttataaaaagagaaatattaactccaacaaaattaaagttgctacttttgacacgcacagtattgaaatttggactagtttctctttccatttggagagcaacttggtaggttgcatttcaaaagtgagttgtcaattgcaacaccggtttctcttacagtgcagtggaccctttgcattatattttattaaataaatgaaaagttgtgtctttaaaatattgtgggattcattttgagaatctttagtgaattttttgattgagtaaattttgattggattgtttagagtaagaaaataaaaaatatgatgtgatattatagagaatggtgaaatgttattttaaaaaatagaagctaaattttgatggatttgttggttaaaaatgttctaatggtagaaagttttttcttgcatttattttaatgtgcatgtcagtggataatgtcagaaccatattgacacacttttttaaatactttatgtaattaattgaaatttattaaaaattacaaaaaattaatgaatctcacattttatttaatttaatgattctcacttaaaatgtattgctaacatcctcttataaaaatattttcccgttgtgcttttttttttttttaatgcaatcacgttgttgtgaatcaccattgtggttgtgcatggcaatttaaaaacattgcaatgaatagtatattcaggataatcatttctcagcccttagtgtcatagtggttgttaaaagatgactttatactcacattggtttttgcaatctgagaatccaacttcaaggtaaagtgtttgaagacacggttccatggtatagcaattccatggaaaattgccagcatacagagcaaaaaccaatattagaggcataggaaaacactacagtacctaaacactcctcccacacccacagcatctttcgtccttcagataagcgtcataattcagcttaaaatgaccagtggaaggatgaatataccgaatgaaaatgaaaatgtatatacgatattggattatgctataaggtgatcatagaagaaaattattgaatatatttaatatatatattaaatattaatatgtttactgttaacattcgatattatgtcgtaatatttcgaacactcaacacaaatccttctctttcaaaccccttttaccttcaacaaaaatgaccagaaggatgaaaatgccgaataaaatgaaaatgtaacatgtcactccaacaactttgaataggggactcgctcacgttgctacaaaatttccgacagccccctgctttgaatctacggtgacaggaagagcatgatgtagggttagagtttaatttttatttcacgttacatcatttattataaatataactggggaggggttgtaattttcactttaaagcaattaaaaggtattcaaaaggatttttacgaaatttattcgaacttacaaaaataacttgcgattcttataaagtagtatttttaacttattttgataacttaataattaaatttgggaacggatacacttattttagaatatatgtttttgacactcatattatacttaaaattaaaactaaattgtaaaataataatattttatttttataaaaaattatgaagttgttttactataaataaattctcaattcaacacttgaattaagaattcaatctttataaataaaataagttaatcaaaatgcaggaaatgattattaggagaatcatattcaatttttttgtaagtataattttttagttaataacaatcacgtaatacaaatcaattaattttgatctaatagataatttgaggctcatgtttttttacttaaaaaaataaaataagttaaacttcctcgtaaatcatttcccattataaaattggcataattgaagcttaataaacactatcaatttgaaataatagtagtaacaaacgatctttttctaacataaaaaaaaaaagaaataaaaatcgccgcagtgcagtgaaagcagtagtagaagaagaaaacacgagttacgcacaaagacacacactcccggtgccgccaccaccaccattgctttcagtctccgaatggcaaccactctaactccaattcaaaccctcaaattccgttctcccaatcccaaacctctctttctcccaaacctccttccatctcacacctcacaccttccgcgccgataaactcactctctccgtctccgccgccacctcctccgccaatggttctccctctccccctcccccgctcgctcaaagtacgtcctcctattccattccctttcactcctctgcgtccgattaattactgttctgttctgttccgattcattactaattgatgattattattgacaatgcagggttcgtcgacacacgatttccgtgttcgtcggcgatgagagcggaatgataaaccggattgccggcgtgttcgcgaggagaggatacaacatcgaatcgctcgctgttggcctcaatgaggacagggcgctcttcaccatcgtcgtgtcagggaccgataaggtgctgcgccaagtcatggagcagcttcagaaactcgtcaatgtcttaaaggttcaccgtctttttcgtgacataccaattccgtataactagcgtttttattgggtgtttttgtgagatgccatgtggagaaagtgtttgatagtgaaattagtgagagaatgaatctgaaggaaactgttgcttatgctggctaggttgaggatctttcgagggaaccacaggtggaacgtgaactgatgctcataaaagtgcatgcggatccgaaacaccatgcggaggtacctgcttagtggtttgtggttgttgtatatgtatgcatctgttatgttatgtgtgtgtttattttgttgattgcttctatttgtttatttttgctggaatattctcagttgaagtggttggtggacatcttcagagctaagattgtggatatctcggaacattcggtgacaattgaggttattgctggagacctttaaatatgttttaatttttaatttccatgttttagtgcatgctctgtatttatatgtactcaaatcaattggatgtatttatatgtactcaaatcaattggattgtacttgtaaagtggagaaaaatatcattgttgtttcattaagataattatttactattggaggtgaattgtgttatgagagtatggtacagtgccttgtaaacagctcatcttgggaatatactacatgtattcatatactcttccttttattgcataaataataatggtgtaattacgaaactaaggttggagtatgactataatgtggttgacttgttggactggctgtttttatgttattttgttcttgataggagtctttcatttttacataaaataggattttgctcatctttaaataatatcatgaataaatagtgtgctgatatgagctgggtagatattttttaaccttatttgtgcaagtgtttgtttcatattttgattattttcttttccatctacctattacttagtcacaacacaaccattaccatatcattacttgcaatatgtcattagatattcttggtgataaaatcaggtcgtaatcttgggtgaattgttctgctaatgttacaggtaactggagatccagggaagatggtcgcggttcaaagaaatttcagcaagtttggaattaaagaaatagccagaactggaaaggttggaaagttcaattgaatacccaacaaatttccttaacttttgtatcttgtccattttgttgagcattatattgtaaggctgtgcaaaatttactaattcattattattggatgatgtaactatacttagattgcattaagaagggaaaagatgggtgcatctgctccattctggcggtattcagctgcttcttatcccgatcttgaaagaagaacacctgttaatgcccttgtgggagcgaaaaatatgaaacctgttgccaaacctgatacacctgtgggggtatgatcttatctactcttcaactctacggtttcctttctagacctatgtttgaacacttcaacttgaaaatttaaatgttgtagcttgaaattaaataattggcatatcctatcaaaagtgttaaatttagaaatcacaaacaagcttagtttcctgaagtaaaattatgctagacaaatattgcaaaatggttttaacacttatgcatatctcaaacactattgatattacagctaaaggtcttttctattgaacatcttttgtccatgtgctttggaatatattcttgttacatttaggttgtctttgactctttccttaacatcaattgttctaatttttaagtttatagaatttcaatgattggctaaagaagaacaaatcagtaactattgcaaagaatgaagctaatgctgacataaatgcactccatcactacatgattgatattttccctcccttctgttctttgatttgtttgctcattattaatttcaaatatagtctgactgtttcttttgacatgtttgcttgtgtgaagggagatgtttatcctatagaaccatcagatggttttacagtcaatcaagttcttgacgctcactggggtgtcctcaatgatgaagatgtaagtggtttgtagtttcttattgtccttaaatgtatccctttttcttgtttccttctaatacattgtagatatatgtacattatcttcattagtttctatttgagtttttggttacatagttgaatatatttgttagaaaatatatggaaatatcctaaatattttattgagaataacctcttttggaatagtttcccaattccttattacctcttaggattagttaccatatttctttattttatcataatatgtttccttaattgattatgattatgatcaatataaataaggcttagtacttttaggtttatgaacatgtcaacacatcaatacattataatacgtctcagttactatcaaccattgcttcattctcttttatctttcttcctcccttaatacctaaatccccagaatcaaacatggtatcagagagggtaccgttctctctcttctgtgccttcaatactatgtttattgtacattagcatgtaatattcatcaattttctgaatgacatgcttgtgactgtcttactgttggtgggataattccttcagactagtggaattcgatcacacactttatccatgcttgtgaatgatgctcctggagttctaaacattgttacaggagtttttgctagaagaggctataacattcaggtttcctttttattttattttataatatttgtgtacaaattgcaagcacataagtccgatgttttggtttctctgttttctcatcttgaatctgctttgttatttccagagtttagctgtaggacatgcagaagttgaaggactttctcgacttacaactgtggttcctgggacagatgagtcaatttgcaagttggtgcagcaactctataagctagtagagctacatgaggttcaaaatgtctttgaaaaagaatgcatcatatcctatacataaattatttgctttgagtaatatatattgttagtgttgctgtttgcattgtcctgtagcactttgagtgcctgtttaagttttttttggagaaatattcacatacttttgccagttccctgagagaagtttaaaataaaaatgcttccgaaaaaaaaaaaaatcccaaacacctactaagtgcagatctcccatcagtgtcctagtggatacagaatttgacatatcaggtttagccaaacatgtgaccctgatagtctacaatgtcacacaactaagtttttttttttttttttttttttttttttgcaatttgtgttgaaacttttgaagtggaggaggaaaaggctaatgcttgattagcctgaaactgtaattccgtggtatgatcctattatattgtaaaatcagcagttatattaggtgttctaaattgcagctacagtaaggatttaggtgtattaggttaagcaatttgtcaaagttgttaggttatttctttaagctaccgatttcaacattgagtatgtaatccttgaaatcttcattgatcatagtgaccttcccccttgtttttgcccatggacgttagcctatagtttactgtacaaaccacattaaattcctttctttttttgtttgtgcaccttgacatgactactagcacaggacatttgtcttgaaagcctttgttggaacttgaatattagcagattttgtgtttcctaatattatgtgaataataaaaagagtattctgaaacttgagatcttgcactggtcttatttttagaatctttactagtttttggaatctttagtatagttccagaattcctatcaaaaaacattctatcaaatctcttacttgaagcataaatccttatcttcctatcttctgtttctttcttatgtattttacctttgagaatgagattgatatagagtgcataaatatttgaccatttttaatgtttacaaaatctggccattgcattcttttctgtatttaaactgatatttcttcaggttcgtgatatcacccacttgccatttgctgagcgagaattgatgctaataaagattgctgtaaatgctgctgcacggcgtgatgtccttgacattgctagcattttccgggctaaagctgtagatgtatctgatcacacaataactctggaggtgaattttatgcagacttttcaaccaagtgatatggcatcgtatttaatgtcaacttatgttgatactcataaacatggtggatactggatacctctatatgtggagagaatgttgaatttagtgactatagtgtaattacaaattgcactaaaaccaattttgtttagctaaatgttacattgttactgtgctacaagttcataggattatgcatttataccagtttaatatctgttggatcatgcatcaagttttgttcaacagccaacgaaaccaccacaaattgggcagggtactagagccccaatggtcctcagtttatcataaagattttttctcggtcatgaaaataaataacattaagctatttatccagcatcctaacattctaagaatcctgttatgcccattgtctgcagctttccacatccatttttttcattgacatgataagctatcagcaatagaattgcttttcttctcatgttaacaaatataattgtagatttaaataagaattgtaccctaacctttgtaagtaactttatttattcttcttccacattaattaatattaaatacaaaagtggggcactgaaatgacatttttcctcaaaaagtgtaatgtagtagaagttaacaactgatgacaccatattggtgcaaattctcagcttttcttctaagtcattatttcttccttccaactacgcctatggttattaaaacaacaggctactgcttttttcttaataaggttatgctgatgacaaaaaattggaaatttgattttatatttatttatttgcttcaaagtatttgctagttttgaaatgtctgccatgatgacgtcagatttacagatcctttattattttgatttttaactaattgatttgcttttgaaccagcttactggagatttggacaagatggttgcattgcagagattgttagaaccatatggcatttgtgaggtatgttttataaatttttttcacttaccatagtagatattttgctagacagtgacttgtttaaattccttattccataaacttccagagtcgaatttggtgcatttacttcctcaaatgtatctcctgattctgtccaagattgtttactcagttgctattattttgttctgaggttttcctttgttttatgggtcagaatattcatactggaggaaagaactcagttttgctggtcttggctaagatgtccttgttttcttttgaagctctgtagaggataagaataggatgagccccctacacaggcagttagctgagtcattcttacacgtcgatgttcattttttattatctacaaaacacaccagtagccattattttaaaaaccaaattagggagtataacagtcaaagaagagggttaagaattgcgtttcaaacagaatttggagtacatgtattttattaaaatataaaaataacaaaatacatcagaaaaaatgaaaaatataccacaatgaataaatataaatttataaatattaaaatttagttttttgaataatttttcactatatatgaaatttggaaaatccttctcaaagtataaacgagtttctctgtagaacaagcagaggtattcacctttaaattttactatattatgatcatgatgcactttaaattcaatcaaagagtgaatattctggcaaatgtttactttgaaccttttccttaacattttgcttccttttagcaaaaggaaaaaaagctggccaccgtgcatgctatacttggtttggtttcttagtgtgctgtgcttcatcctaaaggttcaagattcaaattccattaggaacaagtgggtgtgattcctctaatggaaaagactgttaaacagtcatttaccaaacctgtgctggatcacactcaacagtttagtgctgaaccggccagttgtcaccagttcaaggctagtgcagttctaacatgtaatcggacacaactggctggttcagtcttgttttaagactggtttttgctcatgctcctattgcaccggcactctttactttgaatcagtctttctgatgtttcttattgtttcaggtggcacgaacagggcgaattgctctagtccgtgagtccggtgtggactccaagtacttgcgtggatactcttatcctttgtaatcactttcacctgagtggaagaaccatcaaagtcttaggattttagagcttgtactttctcttaaactttgcctacggattcttgctttctgaactataatgttaagtctttcagtgatttgcaaatgtaggcttgggatgacattgagattaaaaaaaaaaaagttttcctccttctctcaactttgcttcattttttggttgaattacagtctactgttttgtgtagggacaaattttttacatgtcaaaatatttatgtttcgtacttggatgttgtctgttcaaaattaaattccttatattaatgctatcgagtcctatgttgtatgcattaggacattaattttattgcttatgcaattgtgatgttttaaacatatcagtaatatttctcgtattgatttcttatgtttttcgatgaagaataattgtcttatgataataccaagttattaacattgtgttatttatatctatcaatacaaataatggaaggttccaaaatagtcgatgtattattaccaagagtaataaaaattattaattgatagtgcaggattttatgaaactaattgaaattcacttgacattcattgattgagtcaacaatttttttcagagtttttaatgtgcttttattcataaggtttttaatgtatattgatcaaatattagattttgtgtgatatataaagcttaattgtaagttttatgatcaaactttattattttacaaattttatcataaacttttcataattttgtgaatttttactattcaacttttaatattttacaaatttttctatccaatttattatttttatgtatcttattatcacggtaatgatgttttattttatttttaatttttatttgtgacacgtgtaaacatgtaaaattaaaaaattgagtaacaaaatcataaaatgaaaaaatttataattaagcctaatataaatattaggtgttaagttaaccaatgaactaaaatatgatcaaaagtgaagagataaaatttacaaaaataatgataataacagacaaaatgcaatcaagtcaaattaaaaatgtaattataataaaataatgattaaataataaagttaacagtacacatttttactaaaaagtataatttaaccctttaatgtttgttattttaatattattagtcttaaataatctttttggctaataattaagttttaattattattttagtcttttaagattttaaatttaattttagtatctactatcaagaaagtaacaacattaattcatacataataaaattaaaataaaatccattgacttatcacatcacaagacaattatgtaattttgttataataacgtttttaaatcctggtgagtttatcatcatttaacactactacttaatagaaactaaaaaaattaaaatcaaaacaaaaatattttaaatgactaaaatcaaaacctctttttataaagactataaaaagtttttataattttttacatatttgaattaaaatgaagattaatacaacccatatgaatttcaactaacgaaagataaaagtttccaaacacaaattgccgggggatgaaatggttggagagacgtgcaattaacatttaacaacatgaaaataacactacattaccaaactaaaaccactgcagcagaaggcaatgtatgaacacacaacagagcttctagacgggaaaaagttccccgccacacaaatcttgtttaaaaaagaaaatatttattataaacgttaataacattcgttgtaagtccatcattacggaacccatcagcaacagatcatcaccgagttttctttactcttctgcagcactagcagcactaagatccacactgaggtcaataacctgttcaacattaggagtacaagaatcagcatgttacccaattaccaagaaagttatccaggaatatcatcaatgtttttcaagatttcccatgcccaaacaggttgctagtccacccataaggtttctgattactcaatggtattaatacaatagcaacaaatacaaaatcaactagaatgttcaatatttttcattcaccgccattcttcaatcaaattattaacgagtctacacttagtttatttataagaatcagaattcacgaaaagcaagcaaccgattttggaatatataaattttcatattaagaaaatgattggttaaagaataataaaagatcattttattaataaattacatcactgaaactgctaaccatcaaatttccagtgaggcatccattgtataaggaatagaaagatgagaataaatttaaaattcattgtataactctacaaaacgacaattagatatccaactcattctaaaatgatcaattaaaatttatcttagccattttagcttttgggagtggggaagaagagaatctaaggatatttttaatttgagaaaatgttctgttttcatttcttattttcacttttaattacaaaaattaatctaaggattcctacagtatgtagacttataaatatgtgatacaatattataaaatacagtactattgtagaacaatctcagtcactatttgtggctcacaaattaattcaagaagtggaaacaagtggtaaccaaggcataacattacctttccagttatcaatgtatacatgttgagaacgtcatccacagtcgactcaaagtgagtagtagcatcataactctgtcaaaaagttttaaatgcggtattgtcaacctatcaacatatggcaaaaatattaataccaccgagtaaactcactgttgatataaagcagttgtccaaagtgggttcgttgaccggttcatatctgtcatagatatcaaaaaatatctcatcaacaggtcctagaaggtcaattccaggttttagttcaattgcggctgatctgtctctgcctcggttgatacaaatgcaataaattttccttttggagcaacattgtgagtatacgaacaacaaaataggtacctgaccagaacagaatagagcattcaatttaaagaggaatacacaatttacaattgattggacatcgcatgcacaaaatattagtaattttttcaagttttaaacatcaaatcatcttagaaattttagtataccttctgtattggggatgattacaaaattaacagtcctaaccagatcatgagtttatggtattgtttactatgtttaataagaagagtttaaaatcatacatttatattagtatagctgaaaaaggagaaaagaaaccaaaggacaacatgacgggagattgatattgatatgtaaaacataacacatacctaatggtcatttatactaataggtctaggtcaatttagtaattaataatatacaaatagtataaccctggcccaataggactgttaagatcatgagactccgaacatagaatccaaatattctaaaatccgtaagctaaagcttgttaagctttaaaataaattagaagcatacttgtatttttcacttgtcagcttgacagccagtgattttatctgtatcattaaatttttgaaatttcttattagaatttctaaataaatgaaatagaagcaaacttatttcatgctggaaccatttgataattcagatgagactgaacaatttagcttcagtcaagaaaccactgcccacgctaattaatggtcccagtagcacgatatatattgtatcggtattgcaaaattttctacaaatttaactatatagatatatatatatatttaatatgtgcatgtaaacttacatgtctgacttccgacccaactgtttctgtggtaaaataatttgcaccgaatgggaatcatcagtgctggggattgggtggctcatgatggctattgcccttgcaaccctaccaaccttcctcacctgttgaaatgattacaattttgttttaaagaaggacgcagttccatcaagagtcatttaagaattaatatcagttcaccttcgccaataatttttttatcaacagtagttaaacatccttcagaaacaaaactatttacatagcattactcctagatttagaaggaagcaattattcactttcaccatcatctgaactggttgcaaatatcaaactacaggttggtttctaataccttgccggcaaatatgatggatcacaaacaacttttttgcacttgcagttccccttcagatgtgacaccaacaacctttccttcctcatcaaatctacctggcattcaagcaaaaaattaaaaatccacaagagtgtatatcagcatacagttcaaacttcaaaacaaatcaaaatcacatggcaattatagtacaaaaatagggatggaaataaacacaagttcaataatttaagaaggtatatatattgggttaggtatactgacagtggtgtatatcaaattcacaatcaattatacaccaatgaataaatttttcaaagttagcttaattcatgcaattaatacatttttcaaagaaactaaaacatcaactacttgatgacaattgacagcatgattttattcaaattttcaaaaatacgacattcaagatctaaaaataattatagttcgaagactggattaataaaaaaatcctattgaagttgtaattatgcaagtgtgccaagtcttacactagtgtcaattgagagatataacagagaaatgtgtgtatgtatgtataatagagtatataccttgcactcaggcttattcaacatatatgttccaccgtaaacagcactaagccgtgcaaatgcctgaagaaaaaaaaaataattaacgaaccttgagcaaaacaaactccaacagtatattccagaaagagatgaagcagatgggtagacatgggagagtgagatacctggggaagctctcctaaaccatacaaaggatatatgtacggtgaccctccttgaaagcgtgcaagagactctgcatataactacaagtaggaaacatacatatgaatattaaatagggaaacacaataaagctaatgggaaccaaatggaacagaagaaattttcaattaagaagatccacgaatgagcatgaattacaagtgcatgataacccagtaaacttaccttcattctcttcacagtgtccagtgctggctcagccaagtagcgatcatcctatgaagcgccaaagcatgaccaatgaagtctatagtgttatcatcaaggccgtattttctgtcacacgtcaacaaaaaaagcaaaagaatcttaaaatactcctttttcttctcattagtcagtacagggatcaagagatatagggaaatgtatgatcatcatggatgcaaaataaatttgacgtgtaactacattatatatttacaacaaaaaatgccaaataagagtaaataatcaaatgctaagaatttgaactaataaatacatattgactccctatacaatataagaactacagaacagaccataaaccatacacttacattttactaccaactttacatgactgactcatgtagcagttcagcaaatccattatatataaaacacaaatataaataaatcaaaatttcatgacattattgataaggacagggaaaaggcaaggtaattactcctaaaccaatttctacatgtttatgcagactatgaaggcaacacaaagctgagcctgagatgttaaatctgcataaataatggacacggcaagaaaacaagtgcacacatacgctatcaactctttagtagtcactcttgtcaagtccatcccctcgtgggtcttgggatcactctcattgtagttttgcacataaatgaaaaacttgcgtgcacggcgtttttcaaatagccccataagtggggacttcaatgcctccatgtcgtttgcaggcaccttatgaacctgtaccaaccccacaagcaaaaaaaaaattaaaacatctaaaccaaaagaaacctcccattaagataacgagcaacactacacaaacatacctttcctttattaaacacatagctcccatccacagctttgaaatagagatacttggtaacatcggtatgatgagaacccgcaccaaattgccattagccataataaactagaagaaaacaaatcataaataataatgttgcacaaattgagaatcatatcatatgcatccagatttagtataccaaaatataataaataaaaaacaaataaataaattataagaccttagggttcatatcgatgttgtagtccctgctagcgcccaaatgtggaggaggcttgtcatctcccctgaatctcttccaaagctgaagaggaggacagagaaaatcatcatttcgcagttcaaacttcataataacatattcttaatctaatattattatttttgcagaaaatgaaaataataaagaaattattaaaaaaaaaaaaacctgaataagattgagcgaagtggactctcctccgtaatagtcttcctatccatatgcagaacctgaatcgaacaagaaatagctattagcatgcgaggattggatcgattgagaagaaaagaaaaacgaaagtgatgaatggaaatagtaccttgaggccatcgacggagagaagccgctgagaatgcactccttgagacccgtgcccaacacgatcacatcgtactcctcatccatgttcgatcgatctcgatctcgcccgaaaacggggtttagggtttccgaaatgagaaagaacagcgatggatagacagaacaacacaacacaaaagtgtgatttgattggtacgagagaagagacaagatgggaacaaccgcaggaacaagtaaagaaccggatctcgggccttgacctgcacagcactccacacttaaaaataaaagaataatagtaataattaatcgctgtgtaatgaaatgatatcgcgcgacactttcctcatccctgttactgttattatcaccgtgcccctcaattttgccatgataaatacagtatctattttagtgcctaagaagccgttccatacggggagaaatttttcatatagttgagaattatgattttagaaaatcatgaatcctcaaatatttatttataagagtttataacaaatcttaattttttcatcaaaaataaataaatcatgtgattttttttcatattcgatttaactttttgaacataataaattacaaagcaaaatataatacttagttataaaaaaaaaaaagcatagatgatatgtgcaccttgagaaataaaagatttctggttgagtctcaattttatgtaataattactttcatgcataaatttcaatagacgagataagtttcatataaatcaatatgatattcctcaataatcaaaatcttccaacacgtttcttagcatgtgtaattaagtttgtaaatctttagtatggaagcaaatccttatttgactagtgataataattatatttgtattaataatgaaaaagtataagacataatgagtgtcatacacaatgacatatacaaaaaagatatagtcaccatgagtcaaaatttatgtgtccataatatatagcaaataaaaaataataatgaaaagttacaaaagaagcatgaaaaaggagaagtcacttgtactaacaatattattaaaggttacgaaatgttatacataaatgtctatattgtcttaaaaacaaaaagaaaaaattataagtaataggaggaaaaaaaatcaaaaaaggcaaaagttttttttgaattgtttatgtatattttttattgaaaattatatcaaatcgatccaaatctatactatttttttatcaaaatctttatatttttaatattcattgacttttttaaattgtaaaaaatcttaattaaatattattgaatttattgtactttttaaaaattataataatcttaattgaatatcacaagacttatttattcatttgaatttttatttaataccttaaaactttttataattttttaaaaattattcaaatcctaatctaatatatccttatttttttaaacgaatatcaaatataaaaaattaagattctcaatattcctaataaactcaaaacgtctccctattaaatgtttcctaaaaaatgagatgtaatatgaaacataaaaaatttaaatttaattcttaaatatgaaaaaaatgtgatagactacaaacaatttaatgacaaattaatcctaaatttataattaatattaaattgatcatcgaaaatataatttattatcaaattatttttgaatattacaattaaattacataatcatctcacatatttaattatataaccaaattgtcaaacttttttaacatttaaaaattaatttaattttttatcttttatgattaatttattattgttttactttcgtgactaaaataggtatttattcattttcctaaatcaccgaatatattttattcttattttcttttctctccgtttttttccaagccaggcagaaagctagaaatacaataggaaacaaaattcacttttttaccatttaatactcgaaacattgattaggctagaagcctaaaacagtcaccatcaattaatctatgacttaatagctaattattataaatgtgaaaattaacatgtattagtttgaccgaaactgtatgtaaaaaaagaaaacagagtttgagcgaaagtgaatttatattcttaaatagaatcttaagttgaaatcttataaataaaataaatagaatgaaaaactcattgaatcagttagccaattttttaatataaattcgtgatttgtaaaactaataattaaatactcaaattaaacattttattttaaaaaatttatatgttccattcatattaacataacattgtcaatttttttatatagaaaatgatatgtgtgatagatttattaattttataatagttatttcaaaaatctcagttagtataactttttattgagatggtaactgtgatttatatattttgtgtaaacaaaattatccagaaaatatatgaaaacaaatatttcttcttcttttttcttgatccttctagtttattaacagtgttcgaattttatggaaatatacacccattcaacctctgtcactttcatggacaataaacaaatctacgacaatcctaattattttttgaattgaaaactctgtaaacgataattagtatccagtacctttcttttattttacctggtttgtatagttaagattacccaaaaattaaccaaaaatctaactagaagttttacaagtaaaagaacaagtgttggtttctttaaataataataataataataattattgttattattatgtgaacttcgttgttaagggttctaacaaagtaaatttgttcccttttttagtttagagtatcttaagttgcctttaaacaattaatggtatgttggagtgaggtgtcaaccagatggaatcatatcttacacaagctatcgatatttgtccaaacaaaagaaaatcaacttaagttatactattttggattgaagtttataatttttttttatgaatttcaatatacaaaagttgattctaatacatcaagtaaaaaaaaaaaaagaatattaccttcaagataaaaaaaaatatattttaaaaatctcccaattttaatctaaacatgcactgcacttatatgatcaatatcctaagggttacattttagaagtttaagttgaatatcaactttttattttgacccatatagaacatcaacccgataattgtcttgatcgaaatttgttagatggtttgaactttaaattttgtttaggtaatagtcatttgtattattaatatgtaaagttgataaatctattaattaaaatatgaaaatttaaattatagtcattaaaagtgaaaaaaatgtgataaatttatcaatttgttaacttctatactttactgttaataaaaaagtgtacatgacacatggagaaaaaatgtctcaaattattaccaacgtgactacggaataaataaaccaaaagttagtaagttttcatttgatcaatttgtcatactccaaatttcgtttcattcaacgataaaatataatttaatttcatctctccattttttttatcgttacaagtataatattacaataaacactaaaaaatagagaaacaaaaataaattagaacaacataataataagcataatattaattaataagtatagtatgtctgatgctttgaagtttttaatgagactcaaataaaaatgcaaaatcattaagttaatccttaaaaaatgagatccaacttttttttttgtcagtatctaatgttgtcacaatatttaacatgaacagtatatcaatcatggcaaatttttcaattacaaaagggggaaaataaaaattatattatattttacctttaaatgaaacgaaattgaagtatgataaattagtctaatggaaacttattgatattttggtctaatgaaaattactgcattttgatccaatggaaacttattgacattttgatccaatctattcagcaactatgttgataatcatttttgtgacattttcgttcttctatgtcactaggctttcattaatgataacttacgaaagtcaacatataaatgaatttgtcatacttttttactttgaaaattaaattttgaatttttatctttcgaagatgaatttgtcagcactttacatatctaagaacgaaaataactacttacttttagcttatttaacttaacttaatcatagctcattctagacttaaacctacaaaataggtgaaatataatgatttatttgaaatatattacggggaataaagtcataattatctaaaatatatttacaagtttcctaaagctagtcatatctaatgaaaaaaaaaatgttagtgtttccatggaaagaaagcaaatgagtccccttataattactccactttgacctaaaaaatgtcaagaaaagtgaatcttcgttgttttcgagcatgaataattgttgttgaatactttaacaagaactcacattaaaaaggaaaaagaaccaaaaaaaaaaaatgcttaagatactataaaaattccaatgctaaaaacgacagccaaatatatggttggcatgataataaaaatcaattctaataattaaaatacaacttgtatggccattcgtagtagtaaatcacaatcaagagatgtaaaattttatccaataaaatacatgaaaatgcatgtcatgtgagacatctccatgtagaataactaatacatatcgaagcaacgatcaagataacatgttcttatccaacaacccaaatcataatgcaatttttttgtaacctcgtataacgcataatacaattgtatcataacactttaccactaatcctgaggaacatgactgttagattgttacgagaggtttcaattactattacacaacaaatgaacctttattcacacgtagtgttttgtacaatgcatcctcaatgtctgtctcaatttatcctactttttccatcttataataaatgtcgtgtaaaaaaaagttttaaaataactattattttaattatttaatgtaatattaatcacttctttctattaatattttaataaatgtcattttagtttttcaatataatattaatatttacactcaaatttaatttatttacatatttttaattggtctaggtaattagttagttagtttttagttcagtaaaaagtgaatacattgaaaataataaaaattaagaaaaaaaaaccataacgatagatatggtaacaaattttgatggtttaaactttaaagtgttgtttctcataaaaagaaattgatttaagtaataattattgatttgagtaagcaaaaaatgaactgaaaaatagagaagttgatatcaattagaacatgcaaacaaaataataaaaagataaaaacacatcagttagaagaattgaatatggataataattaataaaaaacatgaaacttatggtgaagtttattttaatatatataagtttataattaattttggatttgcatatagttcatagccagaattccttattctattccactttttattggtgttttgtggttttagccccttccagttccacttccatcctacatagtaccaaagcatgatgaaaaagtaggaatatatgatagaaaatcttcccaaaagatgtataggaatcagttttattataaactttttcagtcttttgaataagcaatttgtcataattttgatttttataatctttaatctgaatttgtatgatcaaaataaattcaaaaaatattatatatatatatatatatatatagattttaatttgtccttccattaagtatatattttagtagattttaatttctatacactgtttgcaatattttttacattattaataattaaaattataataatataaattaaaaataattataataaaatttaactaacttatttatataaaattgtatgattacataatagtatgaaaatacattttatattacaattcatgcacttttattcatactttaatacaaaacttatgataaattacaagttatattcgaatacacgtttagacaacttccaacaattcaaaattacttaattcttaatttttttaataagagttatcgtcaaatttttattttttatttttataatgtaaaagaccagagacctatattaaaaatacaaaaaacagactttttattatttatttaaaagaaaaacagtgtcttcttccattaaaattaacccgcgatatcgtgttagtgaagagggagagaggatccaaatccaagtacggttgggttggagagaaaatgcgtccctgctgaaaacaccaaaccctaaaacgcgaaaaggttctaaaatttgcgaaggaaagagctagcggagatggagattcactacagtaacagctatttcgagaggcgccccatcctcaagtccaaggctcccgctgttaaatgggtcaaagaatggtattcccaatttcttcacgctctcatatttgcatcttatgttttagggatttcaatatcgtggaaaattgtcttgtttgtaacgaggctcaatttatagtcatagttccattattttgttatgtttcaattactcatataagagtaataatacgaaaatattgtttacaaataattagaattcatgaacatgtttttattaaaaattaaagcagtacacatatatattggagttaaaatttttcctcgtgaatttgtaccattcaaacagagatttgctgttaattaataaattaaataactaaaaaagttaaggaataaaagacaaatcaatcagtaattcgcgtgcattagttttctttgttaagtgttagtttgttagtttttttgtcaggagcgatcaaatctgtgaccttttcctccttcccttctttcttaaccacccaaccaaccttatatctactctgttattgttaattactgtgcttatcgaattagctttgagaatctggttggtttttatgtttagatggaggagtatggaggggaaggagggggagagtcactttttcatttatactaaagctttcttagtaattgagttttttttttttaatgagtggaatgaaattgtaatcagggattatcatgggaccttgctaccattcttattatttttataaacgttttacaattttctcgatttaggaatgtgaatgaatggatataatgtgtttaaggttagtctttccatgttgctgttagatggagagatcaggttataatgttttagctggccatgtgcagtttccattcttttcatatttcattggttaagtgttatgctaatcatcagatgctgccagggttccccaagatcttgtgacgacgggagggaagtgcatgatcttaaaatgggtaacaggttggtcttttttactacccagcaagcttacatctttgctcattcctgccccatttggccattctttgtctgtttacatctgtgtattttattttatttttttaaaaattgattaatgctactgtttgttttagcttctataatgatacaaaacttggtagaaaataaggggaaacaagatttgagacagaatttaacatggtgtaacctaatgactaatatgcattgttgacatgagataatcagttgtttggctgttttttgctgaatttgggtgagaggtggtaacagtttgtacgtctggagagatagaagttatagtatcttttttaatacttaatactaattcaataaacaaattgttgtaaacatgcaaaaaattgatgtttaggtgctttgctaagagaccactgtatcatatgatgatgttattatatcatgttttgtatcttacatttctctttgttttactttcctaagaggataccttgaagaccttgaaagaaaaggtgaaagagccttcagtgccagagccagaacctgagccaactactgaagtactttttctttgcagctatgatggctgtggaaagacattcatagatgctggtgcattgaggaaacattctcacatccatggagagaggcagtatgtttgtcactacgatggatgtggaaaggtagtggttttaatacttacagatgcacaccatacacatgtattttatatatattatatactatatatttgccattgtattgccaagttgtgaaacaatagttttcattactgcatgctgcaaaagcagatcaaattacactttgttttaccagtctcttatccagtgattagcctaatagcctatagctttaatgaaacattgtgttgatccctctcaagcataaactctgtttttctttcatgccatgaaatagattttgcatgtgtttgcttttggattgaagattacatgtctatcatggggggcagggttaggtaaagtgatctaagaactgcatttatttgcagacttcaggtattggcatgttatgctgcatgattggagcataattaattaaaacaaatcattaaacctttttaattggtttatatttttttaattacactttatttatttatttaatgctatgtatcaagttgcaatagcttgctgtggactgtggtttactcaatagcaggtctatttagcagtgctgaaagtatttgtttacattgcagaaatttctggatagctcaaagttgaaaagacattttctcattcatacaggggagagggattttgtgtgtcctcatgaaggctgtggtaaggtgatgatttgatccaattaagggtttgttgttttctatgacggcttcctttccctagttggtgttgcatgttctgtgtgttgttctttatggtttacacatttggatttgtgacatagtcaaattagctgatgctttccatctatttcttcctatcacaaagaccaacatgaattcagtcttcaactgtccactctgaatctgttttggttggaatgtttttctcaatggaaatttggaattaccagagatattcaagcagcaaagcttgagttcttaattgtgagacctatgtgtacatagtctttaaattgttgatatagagggtaaccaatgaagttgtaaattttcaatttgaatcaatatagaccaaatgttttttatagttgagtatattgtgattttcataaatctgtcatgaactctctctctatacacacacacacacacacttttgatggataaattactttatgtatgatatcatcttcaattattatccactatttggtaagttattattagtcttttctttggagtttggataatgtctttatgagtgtatgtttgtaatcacatctgctgcaggccttctccctggatttcaacttaaggtctcacatgaaaacacattcccaagagaactatcatatctgcccatatccagattgtggaaagagatatgctcatgaatacaagctaaagaatcacattgcatctcatcatgaaaaggttggtaatgtttcctatttgtgtagctggtacattttccttatttttttaccactcagtgtattaatattatatgatgcatgttattatgtaaagcatacctgttgttttagtccatccatttggtgtttgtgcggtagtttcatttggtttgttagtatatctcaatacaaatatgtattatttctctcatgtatgtcgtgaatatctgtataaagatgtctctaattcaaactgatgaattactccagtggatgtgactccagaaactgtaaacatttcttgaacagtcttttgatttgcaatttcaaccttatcttacagaatgcatccgtggatgtgacaaagtacactactccaccttcagagaagcaaacaaaaacttctaaaccatctggaggggcatatggttctgcatcatctgaccgtccctatgcatgtccctatgatgggtgcgaaaaggcatacatccatgaatacaagcttagactccatttgaagagggagcacccggggcttatggctgatgaaaatgcagagcatgctcaggctaatgttgacaatgaaatggatgaagcaagtgaccatgatgcctatgttgcgaaacgatcaaatggtaaaattcagaagcagagtaagcctaaaccaaacctcaagttgcctccttccaaaattgcaaaacgcaaagtgtccactcccactttaactgtaaataaaaattcttggccgtgaaagatgaaccttttgatgaagaagatagcgaagaaacagaagaggatcgtgacaatgttgaagatggttggagatatgcaggaggaaacaatgaagatgatgatgaggaaacagaatatgaagactgaattagttatggcatcctctacggaacttaccttttccaagaaatatattttctcttcaacaaaaaaatttcagttgtctcttttttatttggctgaggaaatgacatcttgtcaactttgtgttggttgttacagccttaggaagaatttatataaataaaatgcgatgtaaaatgctcttggttcaattgtcatccgttgtcaccacaagattctgactgaattttgttgactttggataaaccttggtaggtggtctattcatcctgtcacagctatatacttcaaatattttatcattagtttgtttttaaatgtttaaaaggtcacaacatcaatcttttaatagattttaactttaaattagttaagtaaaattgtcattcattcttatttaagaccaaaagagcgatacaaatggataaattttaagatgtactgagcatgccgttcacgattctccttgccgaccatggcaccaagctccatcaccctttcgagcttagggtctgagtagttgtgtatccctagcaatgatcttaattttagactgaccattcaaggtaaagagaatacttaaatgtttttagactaattcaatgtttaatggtggaattgatattaataaaattgtaataatataatctcagattttaataggtcacacaccttgtgccaagtatgagttttaatgaaattagtgttgcttataggaaatcatatttttaatattaaaagtatacatagaagtctaaattataatatttacttttaagttttaataatatacaacaatattcattaataatgggttcatatttaaaataataagaaaataacataatttaagttgattttttatttgtgtaagaaaaaactaaaacaatattatattaaatgtttttcaaggacaattgaattgttggttttttctaggttagttttttggtataggattaatttcatttttttttctttttttcttttataattatcgaagtaatttatgtaaaaaataatgataatcttttcaaaaataatgaaaatgtataaaatgaatattattcttttattttatgatttcgtacattttgttctttaacttttatttttaagtttgaagtaaggcaaaatgtataatttaacttttagaaatcgataaacacattaaaggtgagatttaaatctttacgcattctttacttgacaccaccaaaatcgtgaagttcgttaagttatttgtatttttgatttattactacatttgttaattgaagttttaatcgactattgtgcaaatttaattttgatttaggataaataattattattttaattttaaagtaaaaataatataaatattataatattaaaataaataatgtagtataagtgatgtcacagcaaagaaacaaacagatgaaaagaaagagaaaaagttagtactatatgtttatatctattagtatatgacaaaatattaagagttaaaattataaatttatttattaaatgttttttattttattataaaaatttaagatttttttgttgatatatttacataactgtcgcattaacagtaacatttaataaataagaagatgtattatccaacaatggtaatcacatatactctacgggtttatttctctcctatgagattcttcattcaataaatgagagaatattcttgagtcctaccacagatcataataatgtaaataagatctcaaaacagatttttacccaaatctacggagcaagtttagtttggtgttgtgttgcactgttactgttgttttaaggtaggaagaaagaaagagcgggtgaggagtgaggaggaggaaacatggctacggcgtcggcgtcggcgtcgtgggaggaactgacgctgaaagtgaaatggagcggcaacgagtacaccgtccgcgtctgctgcgacgacaccgtggcgagctcaaacgtcgaatctgcgagctaaccaacgtcttaccccttcgccagaagctcttgtaccctaaaatcggttccaaactcaacgacgactctctcttcctctcccagcttcccctcaactcctctctcaagatgaccatgatcgggtacgccactacgctgtcgtttcgtttcacacacttttatttttagggttttctttcattacattgctcacgaataatgaatgaatgatttggcagtactacggaagaggacttgctcgtggatcccgttgagtcccctgagatcctgacgatttggagcttcccaaagatgaggctgttgacatcaaagatatggaagtcaacaagctgaaattgaatagacgcattcatcaattcaaggttcaagttgttctttttccgcattttcattttgtttctttctattgtaactaacaatacctatctacataatatcctacagattgagcttcaaaatccgtgtcgccaagggaagaaactgcttgttctggatattgattacactctcttcgatcaccgctccactgctgagaaccctcttcaactcatgagaccctgtaatttcatttccccctttcgttttcttcttttttcactcagtggatggagtttgcttaaaattacaaaaatgccatttttaatcactcaagttatcgaaccttggcaactttagtccttagttttgtaattttagaggctaaaaggttgttggtttggtaattttagtgattaaaatgacattcttcgaattttaggaactaaattgatcaatgcagatgatttcagggactaatttgattaatctatttttttactattattattgaacttaattgaaaggcattgatattataaatgtctttttacactgtcattcaatcacatgttgttatgtatggtaaatttgtttgccttttctaaaagttatctcaagaatgatttctaattggttgatagtacaagatttttcacactgacagttaaacttggtattgtttctttcctctctcttgtctgtaacagaccttcacgagtttcttactactgtttattcggagtatgacattatgatatggtctgcaaccaggtactgtcatcttactttatctgtattctgttctgtcaattttttattcttttgggacgataatttgtaatggaatcaatgctacattcacttcctgcagcatgaagtggattaaagtcaagatggaacaacttggggtgttggacaatcctaactacaaaatcaccgcacttcttgaccacatggcaatgatcacggttcagacttcttctcgtggggtctttgattgcaagcctcttggtttgatctgggctaagttccctgaggtataattatgaatattatgcaataaactaacatgccatttattttcttaatgaaagttaacggaattatgttggcatatttgctcaatcatacattaccatctacagcccaatgaatagtatacttcttatatggggagaaacgggacacccagaaaatactattgctgtaacttagtcttcctgaaaaactaaaaagatgttgatgcttgtgagtatagtcataagtgagataaacctaggtgggttatggagttattgattctagttaaataaaattgcaaaatgaaactatttgacattctaaattgctgtaatctatacctggttttcatttatttctgtattgttttcaattttttgcatcagttaaccatgcccttgatctagttgtcttgatgttggtttcttattctatttcagttctacaatgcttcaaatactatcatgtttgatgaccttagaagaaattttgtgatgaacccacagaatggtttgacaattaaaccattcaggaaggctcatgccaaccgagatagtgatcaggagcttgtgaaacttacccagtacttactagccattgcagagcttgatgacttgagcaaccttgatcataataattgggagttattcacagaggacaatgctaaaagacgtaggcacagataaatgataattgaatgcaataactgaatctggtaagcaagatgcaacttctagacttgtaaaagtttgcagttttataagagacattgttcagccagaggatttcagttttttatatcaagtatttatgtttggacggggtgaatgacagaaaggaaaggatttcttgtagcagcttttggagtatctaagatgattaatattgcttatgcaatttctatctagcaattcctgaacagaatttgatttgatgcatgaaaattttatcctttcataatttgttgggaaagggtataaagcatggataaattgcaaaatgatgattagttgtgtggcacctatggctgcaactattctccaaagtgatcaattgattctaattatagacaatgtattacatggaagttcaatcttctcctcgtgtttttcggcctatcatgtaattaacttatcattgttcttggattttatgcttcatgatctatattgtctttttttagtgatcatcttctaagtgggtaattattgtgtgaataactccatttggattaagtggggaaataagagagaaaatgatagggagaacataggtgaggtccaatttggttcgtcttaaagtgactgaagaaaaaagtgtatggttctgcttctgttcgttttaataactcaatgatttgttatggattctctaagcaaaagtatcggattagttaaaaaaaaataaaaattgttaagtcagatattgaattagaaatgtttggtaaaattagtctttgaattagttgattaattaaatataaagtgacataaaataagacgttatatatttttataaaacttactttttgtaaataaaatgtatgtttcagctaattatagttttatgtttcacttaatattgaacgtagtgatttttgtttgaagtatttattaaaaattaaaatgaatagtataataattaaaataaacactaaccatcaaccaactcacctattttacatattgatttttaaattctgattggaggtttaactcgacaccaccggtttagttcttgactacgtccttcacactttgcctttaattcgacactacccgcaagtaaaacggtgttcaatatataaacgtgaacatgaaccacaaacatgttgcccaaatagtgtgggctttattgtgggttggattcacaccgtgggcaacacgttaatataacaacatattagctcatcaaatgaaaagttaagttgctttgacttggaggaccttctaagatgcgatttaatataacaacatattagaacatcaaatgaaagttaagttgtttgacttgtaggacctacaaaatttaaaagcaataaataacctttaactagacttataagtgaaagagaacttgtagaaatcaatgacttaataatatcctaaatcaattttctcatgctaccaaacatgttgagaaaacataacttcattaaaatcacattacaaacattagcttaacattatccatacaaataagacacattcaaatggcccgagatatttgctatttgcactggaccaaattccacaatagtggagattaacaagagggggtatacagctacatattcactgaagaaacagtggggtgaaagcttgaaaatgttggttaccacctctggtaggtcaactgacagaaatagaataagatttcggtaatgaccaccaggtgcacattaaatggtaataataagtaaatagaaaacggaaagactaagagaaggctgaaatcagcaaagctggcaggcagagagagggcatatgatggaaatctctgcacaatcccatgcatgggaagggaaggaagcaattctatcgtgggtgtggcaacaccggttgaatgtagaagcagaacaaggctacagctactgcaaatctaaattctgagagcagggtcttgccctgaattggtgtccttgtgttttagagaaaggtttgcgaactgagattcgaggtctctactgtttgtgcgtctgtgacttccagatggttgctgttgtggctgtgtctgtggttgctgctgctgctgatacaatgcacgtaatcttccaatctctctttcagtacttcctgctccactgaatttcacattgcatagattttagtgtacaaaacatgttcctgtgatttctaatgaaaccaatcatgcttaaaaaaagaactcatgggcctaaagagaactcaggcaaggatttcagttcatgttttctcggagtaatattttcttggtctcctgcatggtgtccccccacctttttgggagccagacaaatccccactcactcatctgaatatttagtagcacggctcaggccacgtgtttccaggggaatatgaatcctgcaatgcaggaaaagtctgctacccacatgccacacggtattaggtggccaactgagccccacctcatttcttgaactcaaatgttaattcctaatttccatcactatcctatattgctagattcttctaatatagaaaggtacacaagaatggatttttccccatggttttgaagtccttgagctacagttttgaatttttcccaaattacttgaatacaacccttaaaagatcaaacctgcctttcttaatctcattacagtaattctcttgcaaccatgctctagcacatagaaaatagaacctgaactttctacttccttgccacttatatgatataatcaaacttagattaaccttatgtgttccttttctattaatttatactatataatatatcataaatcacaaggaattcactagctgaggtatctaaagcatatatacgcaatccaagttaaaaaaaacttgtgttacttgaaaatggccaaacttatatcatagaaacttacaatatttgataagctgctcttgtgctatattttctaaacgttgcttgagtgctttattctccatactcagaataagattctgctggttaagaaactcgagctcagccgagacttcagacccttctgcctatgttgacatagaaagaaatagaatcagcacttacataaaatgtcactctgcaaacatgcacgatattgccttgtgcagaaacctacctgtaaagcttgtacattcctttccagctcagctatgtattgaagtttccggacccgtgaacgttgagcaaattgcctgcattacaagtgtttcagaatttttttcctttccatatatgaattgattggttccaaaaaaaaaaaacttctgtaaattaaatagaaaacaaaaagagaaaaacacaccacattcatcatataataagaagcatggtttaactgctttctctacatgacaattagtataccagcaatagtgatgcagacatcactttgtaccacaaacaattgttatataacttatatcttttcccttctacgtatattattaagatgccatatggccacaggtagtatagtctagatttgatattataataatgtccagcctatttggtaaggcttaaaagggtcaataatggggatgacatgacttaatgggtttgccacaagaaaccattcagaacttgatcccccaagttagatattagtggcataaaatcaagcaatcactgtaataaccataaaatcaagcagagaaaataactacgtactgtttagcacgttttgtatcagtttcagaggcagatgactttgcatgtgaactgtcctttttttcaggaaatgattttgcatcctgtaagcctgattctactaaatcgtgcttttcacttgctgctggtggaagaccatctgcatcatgtggtgtacattgcaatcctgaactctgaaagcagcactgtctttgcctgagggaacaccaactggatttgtcatggcatttgaaaaagagtcccatgacctatttttctgttttacggagttcatttctgcataaacaggtacatgacgaacatctttgctgcggtcaaagtcttgagatgaccaagacggaatagacatcatattcttatatttatactcgtcctgattagcataattaatgttagatgcattaacagtgtctatgtacgcaaaagaatcacttgatgaacgccgatggccacctcttcggacaggtgtctctggctcgttaaggagatcatcaagccatgaaggctgctcctctataacaagctctcagatgaagtacgttggtggtgtgtgtttccatctctaggtctgttaccatcctttaaaccaacaggggatttgggacataatcagcatatgcttgggaaacactaggaagcggacttttaggaggaagtagaggatgctttccaggatacataaaatttctgaaacctgatgagccctttgaatttgccatagaagcagaatgaacaatacctgtcgaatttaaaattaccaaagaatgtgatcatgtgaataaatcaaaagataaagacaacatagaaaattttatatttaaacaaaaatccatgattcaacaataaagatctgatatgcatgtgttctcgattataaaatataaaccacaaatcagtaaaaagatcctataatgcgaatagcatagtatccttgaaaatgttccaaaaattgaaatttggtttatatgcaaatttactcacagcaccaaaagagtaaatgcgctagtatcagagaatccacatgtaatgtaaccaaggcagtttgggagagaaaaaaaagcatctcagtaatctcaataaccataaatgataaatctgcatacttcatcgagaaaaaagcctaagaactaaatatctcagatctccatgatactatatatttcattggataaaagttcacaacatattggcagctttacggatttatctctttcttttattagtccaaaatacaattctaaaaattgtccacccatctcacaaaaatctcaaattttcattttacatatacattattatcatttcagatagttgatcaacattgtcaatcctttcctcacggtacaggagcatcacatcagattgtccattacaatttcatcataagcaatgcacaactcgtatgaaatagtaccaagcacaatagcaatcccatcacacataaatgacataatattaaccaatgttttaagtaaaaccagcccataatgataaaaaaattaccagcttaattttcttcaataaaaaatcaaacccaaacacatgcatctaacaagcctggcatcgcaacagtaaactaccaatgtaacagaatactcaataacatcatttttttttaaaaaaaaggagaaacaaaacttcaaaattggaagccacaagaaactagctaggggaaagaaaatccaatccacaaagaaaaatttaaccacaataagttaaaaaataagaaaaataaaacgtagcacccaattgccaaactttctattttatactttcattttctcaggaccagatgaggggaaaaaaaacaaagatagaaacttcacttttctacctttcccaaagaatctgcccaaaacacgcactcagaaaacaagaggagaaaaggatcaacacagaatttgaaaacattgaaaacccgacacggtgcaatgtgcgacactgtggcatcaacagcgcaatgatttcaagctgatcgaacgaattgggaatgaaaattgaaacagattcgtttttcgcaagcaaacaaaaaattaagacaacaccaaaaggaaagaaagaagaagaaaaaaaaaacctttgcagattgaagattcgagatcccgaaatgcaatggtaaaggagcttgaaatcaaagcaaagactctctctctctctctctctctctctcttagggttcgtttcttcaacacctctctctctttctcttctctctgtcttcttgttgaagctgggaaatggggcttaattgtaaaaccatgataagtaaatactgttcctaaaacttttctatttaacgtttcaccctttaagtttcgttattccaaaaaaaacaaccttgggttagcaacttaaaaataatactcgttgttgtatctctgtccaacttgtctagagacatggcaaaatagaaccataaattcgttattatataaaaaaaatccataacatggaaagattccagtaatagattttggacattggactgaaaataaattcacttttccttagttgactcacactgggtcacccttgataccaaaattttaataatgttaatgattatgattagaactattgatttttaaaagctcatccaatatctaaatggcatatataaatgttgtttattaggaaaatgacacaagattttaatataacgttatcatataaaaatttataaaaatattaattatacatttttaacacactcttttgaatatattttattattacatgaaatttattaaaaataataattttatgatcacacatcttatttaattaattctctttcttaattaattatgttattttctataaacttaaatcaataatataatatgtgttaaaaatagtttattgctataattcttaaaataaattaagacttttatagccatgtagacgggtcgatgtaaaattcaaaatttatgatgttaaaaataattattataaaatttttaaaattattatatatgtttattgtgaataaatgaaaatataaaatatggttataatgttaatgtatattttttttatcgttttaaaatttagcagggaatactattttttttaaatatatttataaatttttaaatgattattatatttcaaatataatatcatgtggtaaggttttttagcattttgaattcactgtgaaatcaaaatggtgaactatattttaaaatgaaaataattattaagttcagatattaaataaaaaactttttgatatgtgagaataattattgtatgtcattacgaaagtttatatagtatatttatatgagttaacggaaaaattaacaatttattgtattttttacaaattcaaaaaaaaatttaattttttatctttaaaatctaattgccataactaacaaaatcaaatacgtaaaaataagtatttatcccatattataacattttccgaaaataaaaaggtatattcttttgttcgaatcaggtaggtgtgccgtatgcgcatgccaaaagtttcgatacaagtgtcatggctcaaatgtcttatttcttactattttaatagaaaaaaatgtatttttttagattaatttagttctaaattttcatcgcataaatgttgaggtgagacctgacatcctatttgaatgaaaatgtacatttaaactttttagctagaattttttcaattaatggctatgacagattcggtttaatttagaagaaaaaaaatcaaaacaaaaaatggaacaaagtaagtatggaaaaaattgatcgtatatacttattttatttttaacaatcatctaataaaaagtagaaatattttttgcaaagtaaatatagtagttgaagcaaaaagaattatcgtaggaaaaataatttcacctctaaattaattttaaattttgtttaagtcttactattatattattttatttcgtctcataattgtttaaaactcattgtttgattgctatgcatgcagcaagtgttatgttccatccattctagtttgtttttatcctttctaattgataaaaaataacattaataagtactcttaagatattaattaaaaattattattattttattaaaatacgtaaatatgttatatataattcttttacattttattataatttccgaattaaatatttttttcattaatcaatactctaagtacattaaaaaaaaaaaaaacctattttagttcatctctattactagttactagtaattaaaaaatgatatacttaaatcaatataactttttttcactaagatcattccagtttattaaattaatataatttggaaacttgcttttaagataaaaaaattaaatataaatagtttattccaaacataatttcaattacaatagattttataaaatgtatagttcaaaaataagtttaccaaaatttaacttaaaataaattttgatatttttagtaattatttaatataaatcaaatctatttataacacagataattaatatgaagtttaaaaaatatattttgtagcctgattagtttttagtttgagttttgaagtttttagaattaacaagtagttttttagctttagtttcaaaaaaatcttaaatcagtttttaaaatattattaattttaaaataaactcatttcaaaagtttcataaatattaaaattatttttaaaacattttgtatagtggttatgataatagtaatatcagcaacaactctgataatatagatacaatggtgattacgatgaaataacaatgacaatattatagatacaatggtgataacgatgaaaataacaataacatagtggtggtagtggtggtaatgttgatagtgacgccaaggataaaggtgatattagtagtaatggtggtgaagacaatgataataatgttggtggtgtcaatggtgatggttgtgacattgacaatgatgggatgattgtgatgataatgatagatgtgatattattggtagtggtgacaatgataataatattgatgataccaccgacaatgataataatactgacaaactaaaattcaaactcaaatattttttttattttgaaaatgaatgtataaatatttcaacaaaaataatctaaaaatcatttcagttatatgtccagcaaacacatttttttaaattacatttaaaaattaaaagccaaaaacttgtaaccaccacaaaactaacccataaaatattatgactacagagtatatgtattaacaatctaaagactctttatactataattcatattttacgttattatttattgtaaatttaaggttaaatatattttttgtttctttgtaatttttttttcgttttagtccttacataatatgttttttgttgtccttaaattattttaaataacatttttttagtgttcaatacatttttcttgctgttcaaaatgctaaaaaaaactaaattacaaagataaaaaatatatttaaaccataaatttattattttttacaataattacctttaaaattataactaccatgatttataattaaattaaaatattttttatgctgaaataaatattaaactcaattatttaacaagaaaattttgatccaactaatcgtaattgattttgatccaactaatcgtaattgatgaccaataatatagtggctgtctcgagacttcacattaaccgtgtccatctaatgtcatgacaaggaatataaacgtcacattaattacaaaataaatgttatttacaatttcttgacactttttcaaatattttttattggttgaaatttaataaaatttatcaattttttgaatcttgtttatcatttaaaagattatcttttatgatttaaatatgagatctacaaaaatttatagtttttttaaaaaatcagccaatcacacaataactatttgactcatgcataatttataaacatatttttaatctttataaaaatattaccgtattttgcttttagccacagatttggtttcacaaccaggttccaaacagatttagcataaacataatctcttagagatgagcattttaatctttattttgctggacttaggattgcatgtttttaattcagttccaggctccagcttttatattcagcaacagattttagctgatgtagtctcggttcttttgttgggcttttagttctttgggctcttagcccctttcatccaactaaaaaagaacaataaggataaaagtcgaagaaaacaaaatacaagcttctaaggttgttgaaataacttataaattaataaaaacaagttgacttattaagtctaagctagtcaaataaattataagttagtttatgtttatttgacatgtcagacatacttataatgtttttttttcatgccttaagcattttttttctttataatatacttatgtttttattttagttcttttaattttttttatattccatttaacttaattaatgtcttttgtttgcattagtccttatcattactcaattattatcaactgctgaggtgcagaaggccacttcatgacttccacacattaggacgtaataaagtgttattacttagtttcttttagtctctctaaatatgttttattttattttaatctttgtctctttaactctttccttcctcattttaatttctctaaattattattattattattattattattattattatacaaagataaaatcattaacttggtaaaaaaagtaatacatggaagcaaaatcaatacaataatttatttaattatatatgatagaatatatgaacgacatacaattgttaaacataaccaccaaagcaattaaacaattaagtgaataaaaaatcctcattctgaaaggttctttattaaaccattttagttatcaatttaaacattttcataatacaagtattcattatgaggtcccaattttgctatcccaatacacaacgtatactctaaaaacacacacatacagctcatttttttcttctttttgacagaacacacaacacgcttaatagcatggattttggaatctataatattaaatttaagacttcataaacaagtttggatgactaatgtcaaaatcagacacatatatagagatatataaattatatatttaaaataaactataatgaatttgtaaattataaatctaaaagaatataggacatcaaattggaaaataacaatgtccaattttaaaaccctaatctatccaaatcaacttaggtcaaacaaattaacagccaggtatcatgctcaccataatgttttatatatatatattattatatatattatatatattatatatcttttcattatcgatttatttttttaattttatttgtcgtctattgcaaaatttaagaagcattcatagtatagaatacaattcatttttttataccaaatataagttaaatatatatttatgtaaaatatatattagagattattgtaatgtttgtaaaaatctaatgcatactagaagtattgaaatttgagagacacacaaatacaacgactattctaccaaaagtaaaaaaaaaaaaaaaaaaaaaaaaaaacctcattagaattgagaagatccaattttcttgatagttgtcgatttgtctgcttacaaagatgtggttgactattcatataaatcaagcccccacaatgccattttttcttatgcaatttcatccgtcatgctcatatcaactgaataagccgaaatacacacggggacccataacaaaatggccaacacacacacgcatgcacgcgacaccataaagttggtaaattaaaaatgatggtgtgaatagtatcagctataaaacacatgatgctaaaagcaatgttggaacatcctatacatcaactattacaattatcgtaagaaattgagatagctgcttcataagccacttctccggtgaaacgtttgtgtctgttattcagatcactcgcggctgagattcaaattgccaattgtcacaacagccttgccttatgatcccagcaacttcttccatcttgcatatgctaaaataagcaagaaaagcaatacgcaagctgcagacgtgatccaaacgaagggccaaaataatccatcaatgtgatataaattacaaggaatgttcataccaaatgtaccagcaatcaaagtttcaatagcaatagcaaatgatgcaatagtcaacgtcaactgcagctgaataagttcatttcggtggttatcaagttggatgttgacatagtcttcagtgtcatcaatatactccctaacctgcaaatcagtcaaattctcacaatatttggcattccagaaacaataaccaaaatcagctgacatttcaacagcacaaatgctccctaaagcccaaatcttggtccatgaaacacagactaacttcctccccctcaacattaacaatatagacttcctaccattttgttataaacaagaaatgaaaatcaacagtaggttacaaccgtttgtttttaaatcaacagggcaggcaataatatattttgtaaatccagaattgcaacaaacttggacaaatctaccattaccattatcctatagggtgagcttaaattaatttattggagcttgggaattcttaaggataagctcccaatagtgtcacattgaaactagcaaacaattgagattccctccaccctcaagacaagagaaaagtaaaataatgcaatattatatctctggtaagtatcacaagtcacaactaagtttatgtggttgagtcacgtatgcaaatgaaacatatgaaatttatcatctaaaagcacaagtgtgtgatataaataagatagatgatagaatccaagtagaaaacgacagtttcatccttcaaaatttgacagactcatgatttgaccagaatatggttgttagaatacttacagataatattttgttacggttccatccaactgcatgaaatatgcatcaagcaacatctccaagtcctccacattgttataatcctcataatggctggtcacaagactttcacttctgttagaaccaagtcggcgaacaaacgtgaggtattaggaaagttatttgaggttgtggcacccaaatgagcctcctcaaattgttgattctgcaaccacttcctcgtcaaatatagttgtgccatatcttcgttgtcatctaacagatgttcaatttcatctcgcacctgtgaaagagggtcatacacttcttaagtatgatatctcaaagatgaggaatgcatcttcacatacaaggtaaaaccgcctgcaataaattttctatatataaaagagtgaacaaaaacctcaacttaagagcataataaatgattattgaacaatgtaacaaaagaaattaaacaattaaagagtttggcaagaaatagcctttcattctttattcaaagactgcagaaatggatgcagattgcagtccaattacatgttatttctctgaaaaatcctcaatcatcacaatgcacaataactaaaagaatctgttggcacttttattagcttgcacatttcatgggcttttaactggtggcttgaccagtccaacaaactatattaattaaacaaattggacttggtacatctattttcccaaaggttaatcctattctcaatttccaatttccaagtcatctataagtaatgaaataactatccacatcaacttagttatagcaacaatcagaggaagaaccacatggtacttatgcaaaaacataccttctgcactcgtgccagcaaccggtaagattactcttcaaactcctcacatgttcaagattcttggtgctaacattccgagccaattcatccaacacagggtaagcacctcgctcaaggtccgccacattcgagtccagataagtacacacagcctccaaagcaatctccagaacttgaaactcaaacggaagctctgactgcaaaccatcagcgcctctggcgtaggcaaccattgcctgccattagagacctgcatttcgccttcctgttcctccatgcgccgagaagtttaggttgacttttgcaggaagctgttgcctgagttgctcaacaaagggaagaacctcctgccgaagaggatcaagcaataacacttcttcagcagtcacgatcgcctttataaactccaaattaaccaccattgctttctctctagctgcaattttttatataaaaagacaattataattctattcttcattcttcattaaatcataataccatccaagaaaagaaaagaaaacacagaaccacagtcaagttaccaaaacaaacacaatttaagacatgtgattcaattcattagagaaacctaattttgagaacacgatgaaaatgaaaaaggaaaattgttgaagattgaaatactgttattattcagttacctattattttgtgagttgttattctgtttagattagaggaaagttgttattctgttacaaattattctgtttaggttgttattaatacttgttaaatacaccttttaagaggtagcagatatgaaggaaatgatgaatagttctctggattgagttttaatatggtatcagaagaaatttaatccaaagaactcaaatcccattttttttttttaatctgattcctttttttagccaacctgtaacttcttttccctctttgcacagtctccaatccctaatttccctaatttctccaccatggaaaaccctgatctcctgtccatcccacctccctaccaacttcttccctgttccacagtccaacatcatcatacagcaagacaactcttcctttcctgtcaccgtcatccttgatgatcaaactaccccctttggtctcaattaatggacaagcacataggtgcccgtaacaagtctgggtacctcactggtgcgatggccaaacctccgaccaatgatcctaattatgctacctggtcactgaaaacaaacgagtgaaaagctgactcatcgaatccatgagcccctctctcatgcagtggttcatccgccttgaatctgcaagcgaaatctgggatgcgctctccaacgttctacgacggatctgatgaaacttgtctgtttgaactcaaccaacactccttctccaccaaacagaatggttgtcctctctccacctattataatggcttctctccatctttcaggagattgatcaccgcatggcttcttttgcaaccaccgtcgatggcgtagccagacgcactcttccatggtcggctgcgtgtctacatttttctgagtggtttagactcagattttgaccaggtacgtggcgaaatccttcgtagagattacaaattggatcttgagagcaaatatgcatttgtccgtgcaacatcagcacccatcacaatgggacgccctgcttctacaacggattctctattttttatctcatactcctgtgcttcctctgcttctacaatggatattcttactcaaacataaaatgaagtcttctctgtttttcaaaatttcataatatggtccaaacccaatttcaaagttcaatccaaatccttcaatcagataatggacttgaatataattttttttttttttctgaattctggactctaaaggtatcaaacatcagacttcatgaacacacctagcaaaatgggttagctgagaggaaaaacaggcacttgtagaagtaacgaggcatctttatttgacatgaatgtgccttccaattactgggggagcagtcctttcagcagcttatttaataaatcgtactccctctagttctctaaattttcttactccacagcaaaaacttgaaactttcttttctatccctcatgtaatgaatcttgaacctagagtctttggttgtactgcctatgtccatgttcccaaaactctacgaaacaagcttgatccttgtgctaagaaatgcatctttgtcggatactctgaccttcaaaagggatatcgttgttttgatcctacaacccaaaaaatgcatgttgcccttgaagtatcctttagggaaactgaagtttttattcaaggggagtttcttcttctcagggggagatccagaacaatagagaagacgaattctggctatctacttctacagttcctactccaataccttccaccacaaatgatcagctcacaaacactaattctcctcaaaactcttcacctgaagtaacctgtgaacctccagaagcagatctcaacgatgcaagtcatcctttatcccatgagacaccatgcctaactgaatcacctattgtacataattctgaaatacattctgaacccagaactgagtcgattcctgtccctagtacagatcattcaatttgtgctgctcctaatagtattcaaatcaaaaatcagagagaccgaataaaggcaaacccaaaactgtttatgaaccagaccctaaagtgaaagtaaagtatcctattagtaattatgcgtcatctcataggctatctggatcatatgctctaacagttgatcaattatctactgtatatattcctaagagtgtgcagtttggaagatcctagaaggaagcaagcaatgaacattgagatggaagcacttcagcacaataaaacttggagattaacttctctaccgagtgggaagaagacaattggatgcaaatgggtatacaccgtgaagctaaaagcagatgggagtattgatagatacaaagcaagcttgtagcaaagggatacacacaaaggtatgaagtagactatcaagacacgtttgctccagtggctaaacttaatacaatcagaatcctaatatccattgctgcaaatagagattgccattgaaacagtttgatgtaaagaacggttttttgaatggtgatttagaagagaagtctacatggaggttccacctggagtgaagctaactccttcaacggagaatgtagtttgcaaactggaaaaggctctctatggccttaaacaatcacccagggcatggtttggaaggctctctttagcaatgaagaagtttggttaaaagcaaagcaactcgaatcataccatgttcataaagcataacaaagggaaggtaacaatactcattgtttatgtagatgatatggtgctaacaggggatgatatagaaggaatgaaattacttgagaagaaattagctgctgaatttgaaatgaaggatctgggtcctctaaatattttcttgggatagaaagtgcaagatctgaacagggtatatttctaaaggaaatacattttagattttctgtccgagactggattgatggcttgcaagcctgctgatacccgatggaagtgaatcattctttgggtatttatccggatcaggttgaggtagataaaagcagatatcaaaggttggtaggaaaattaatttatttatcacatactagacctgatatcacatattctgtaagcattgtaagtagattcatgcactctccgatgaagagatatgaaggcagtgtatcatattttgagatatctcaaaggttctatggaaagtcttaaaataatatagcgtgcattgaaggaacacagactcagacttggtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaacagttggtggatgattttcagatttcccatgttcggtcccaggagcaacttgctgatgtattaacaaaagctgtctcagaaaaagtgtttgaggcatgattgatattcatgaacgagtggagtgttgaagattgaaatactgttatattcagttaactattattttgtgagttgttattctgtttagattagaggaaagttgttattctgttacaaattattctgtttaggttgttattaatattgtataaatacaccttttaagaggtagcagatatgaaggaaatgaatgaatagttctctggattgagttttaacaaaaataaaggggaaaattataataccgaggatgttggaggagtgggagaagacggggcccaagattctcaagtctctagcgggaatcgctgcgtggcggatgatggcgttcttctccaactcacaagttctgaccggcccgatcggtcaaacctcatccacaagcgggcgccgccggtcttcttcttcgccttcgtcaaggcgcagctgccggcggcggcggcgataggacggttgttgttgtcgtcgggtgaggttgcgattccggccgcgtagggaggctgcggcggagacggaggaggaggcggggcggcgttcttcttgggtcggcggcgagaggtggagcggcggaagaagggaccctttcccattgtgattgagaataataattggtaaacaaaattattattgttgttaaatgattaaattgaataataataataataataataatagaagagtgaagattgttgttgttcttcttctccttcaccttcaccttctctgctttgatcctccataaaggagacgacactccttctctgccgcacactccctatttgtttttatgtttgggacggctttaattattgacccaccgaccaaagcaaatccaaagtcaatgggtgtggaaataaaaaagtttgttattacttattagtaactgcatctccatcactcgattatcgttatttgtatttttttatacattagaaaacaaccatttttatattaaatttcttaaaaaacttatcgtttaatatcactttttatttattatattttacagatattttattttgttatattaaattttaaatattttcttttattcttttatatttttgaaatatatcattttttatttttattttttactaattacattaaacaatttcaaatttaaaagttaacataataataatttttttaaggaaaattgaaaaagaatcaaaatgatatatttaaaaaaaataaagatcataattaaacttttaaaacttaatatacaaaaataaaataattatgaaacatatgaattaaaagtgactttaaacataaagttattattacatgtatgattatttattaatttataatatttatcttaaaaataatattaataatgatttatctttgatacaaaaaaattgtatgatgacaaaacaaaataattgtttttttattatctatcctcagaattttggtcttggtaattatttttaatattttaaaataaaataaaaatatagcaaagagagaataggttcattacataaaaaattggaatatttttcataaataattgagtgtgagaaccaaatgaatagaaatataagaaatctagacattttgaaataaatgaaaaagagtctatttctattaaataatttattagataattgaaaacagaaaatgtcgagaattattcgcaactaagaataattacaataaaaaatcattataatactacatctatgttagtattttagtgccacgtctgtattttaattaaatattaaactaataaatgaattaaagttatacattaaaatggtggatggactaaatttataataaaaaaataaattttaaaaataacaataataaaaagactaaaaatgttttaacaaaaatttaaaaatatattatgagtattatttttctttaggagaattaatctttatgactgtcacaaataataattctttaggagaattagattttatgactgtcacaaataataattgtttgtcatgtcatcttggtcacactcactaatgaaattaataaataagaactgtaaagttatattttctaagagttcaagaattaattcattagtttaaaagcatagaaattaagatattttttgactaaaaatatacaagaactaaaaacacaaattttcttagtttaaataggatagtttttttcttcgagaaaaataggattgttttttacatttacgggacacaaatttatttttgaacaactttttctaccttaagaaatttctcaagttttctttaatattttcaaagttttcacttactttaatgggttgttaaactccttaatcaatcttagacaattaatctccgacgtttctattttcttcttttatctttctttaaagtcttgatcacatttttagttgaattgacatgtagtaatttcaaatatgcaatatgcttttagttcacaatctgattaagattttagtcaagaaaaggaattactcgatttgaccattatatgacatgcgtggtgatgtagaactgtggtgtaattatgggttaaaaagggatcaaagttccaaaaggaatgtcagagttttagtattaaaatctaacgtcctaagaaatttatatagagttcaaataaaaaaataacttaaaaatatatccttctagtattaattaaatacctcaatcatcattttattgttactgttgttatataaaatgatcaactaaaaatcaacatagctactgatagaaaaacttttggtacgaatccttacgtattaacgtcatagtattttttggatacatattaagaataaaagaaatcaagaaatttgaaataaatcttgcaaaatccttttgttgagtttgtgtgtaaagatttaatcatttattgacgcatttcacatttccctcttgttgaactacgttctatttttaaaattaagtaaatttaaacctatctattattcttccacctttttttgatacattctattttacttccacctaaaacacctactatctaggaatttacaaatgattaaacatttaataattaaaatttagtagaaacatgagaaaacttgaaaaaaatttattgtaaaattaggattaaagaaggagaattgagttatttattttaagtaaaacttgttgaatttaggaaaaatcaaacaatttaattgatttaaatattttaaataaaaaatataataagggtttaaataaaatgaacagaccaactttgcttaattttaaaaagtgaaaaactttatttgacttgaaaaaccttaaagaaacaaaaccatagataatccaaactaaaggaaccaaatataaaaattaactcaaatttatttaagagaaaaatgttagcaacacactcctcttataagataattccttggttaaaagaaacatgttgaaaaattttcattcatgtaaaataacattgaattctgaacattagataggaatcgcgaccaagatttaaatcctaacttaacagcttcaaattcttcaaattgaatgaagatcatatctaggttacagtataggggacagaaatacaagaaccgcatgttatgcataatcaatgatgtcatgtatgcagcaagaatatcttaagttcccaactctttttccattactcatgttgatcccgtatattaaaaagccaccaaagtagcaactaaattaaaattaattgccacacgtgaaaggaaaatccatgatccaaaaaatacatttcatgcatcaactgaatctactactctgcttacccttggcattatatatgcgcatatgctaacacattataaatgttactctcaatgcaccagccaaccaagtacatcaaaagcagactcaattaggaaattagagcactcatgcagaatgtgaccacatcatctatattttccaagctccatcttaattcctcttgattgttctctgaccataatgtatctattattcccgcaatggtaaatataactgtgcaggaaggttggaatccatttctaatcagttgcgtgagacaaaaacttacatgtccttaatgtacagacaagtcgattatgaatagcaaaagcactcgatacatctagttcatactagctacaaatttaaattatactactttcatttagagcttaattttgatacattgtcagtctaaagatttttatatgacaattagggatagatattaattatacccagactctatgggtacccgctcaatggaatggatcaaggtctgggtatttacagcaaaatttaatgggatggatgcaggaacgagtactattagtctagtacccagttcatcccacacccgcatatatatatatatatatatatatatatatatatatatatatatattaaaagagatctatgcactcactatcaaatacagaaatttacatacaaaaggtaattttaagtctataaattggctttaccatcattaccaattttttgagctgcaattcttagcagctatatcagtaggcgaatattctaagacttcctttggttaatcaggtggttagtgcatccggaagtgaatttggtgatccaagaattttgccaccaacatcaggaaaggattcataatcatcaagtgcactgacttttccatccctgctgatcttaactggatattgcatcaagtgtcccctcatccgattctcttcctcagacacatatatgtcccagtttcgtttggcaattttattgacatgtctgacacattccaggttatgaggttcagcaaaacaatgatcaagactaccaaggtgctcagcccacagtgacattctgtatccatacacctacaccaacacaatctttgagggaattgccaattactgagaaaagaaaagatgaaattacataaccaagatctattcacagatctgagtttatgctacgagtccactagtatgagagggtgtcatcaattatgcttacaatgatttattctgataaaatagtatacatgatttatccaaaagatataaactatttaatggtgggttggctctataacactttgggctgatacaaagattggaacctcaagattatactttcacacacacataaatatttagttaattaactttttttggtagtgtctaattatttcgtgtgtttgcaatatgtgctatatatatatatatatatatatatatacatacttttatcttagattaatatgctcaattcctatctagtacaactattctagctcattaacaaacgtagctggagcttcaaacctggccacgtggatgagcattcttttctgtccatgtatattttggttgataggcacccatagctatttctgtgtcccttgaaccatctaaggatctctggttaatatttgctgatccaataattacgtattcgtcatcaactaccattcctttggcatggacataaatcataaaacgtctgaattttttaactgatacctgattatagaaagggaaaaaataacaataagatcataaactatcaccacataaatagaaaaagtctgcaaatggatcttgatgcaccaactgattacttctcaaatgtaaatatgtaatggccattatataatgctgacacttatataatttattcaaaactaagtaaatattcatttggtagataatccatgatcatttggcactaggcatatatttcattgacaaaactaatacaaacttatggaatatctgtgtgaaatgttgaaaatgataaaatcagaaggaaatattttcttttatttcatactttttgaagttgtattttccgtccaaggaatttgatccagaagaccaataaacattttataaatttaacttaattatgtttaagttaacttttatactaataagtgacacagatatagatatgaaggccgggactttaatctccaccaacttcattcctgctagacgagaaggagccaccttgctcattactcatcacacatgtatgaaacttgctttggccaacataaaaagcatttataagtgttctgtatgtttccagaacacaaatgtataacaccgaagtgctatgtggttgctgtttgatcactctaactctggagttcaagggagtcaatggagaatgacaccttgaaacagaagatcacagagatacaccaatggaagtggggtgtgtgctctgtgtaattgaaagagatagagtcagagtgtgtgtgtacctttcaccaacgagcaagctatatttatagatgaaatacctaactgttggctaactgcattgtgcgcgagtggcttcctatatttccggcctccacctgcacgttcataactacctgagtggactgagtcttggtccacgtacgttgaatctcaataacgcatcgtaactaattgggccttaacataggcccaattatgactccagaacagttgccccccagcccggttgcggagtacactcggtagccggggtgctttctttgacgtcacggttgttgggttgacagtctctccgaccacgattacctgccttgttatagattacggatacgattctccgaccacgtttatccgggttcaccctatccagacattttgtgggcgaccctatgtaattgtcctattcagtcaacatccgaggtcggaatcatatacctgttgaagaaaaagatatgttgccgaccctattccttaggaggatcgtgtccggattttcggcgtaaagcatagtcgacctacatttcatccggatagccgtcctcggacgaaatgcccccagatatctatcccttgggttttgaaaagctgttgggcttccaccctggcgtcggttactgttctttataattaaaggtaatgaatgcatttaatgcacctgtctcttcactgacctggtgatgattgttatggacgtgattttaccataataccctggtgtcgtttcagtttggcaactgagccgtttcttttcttctggcggttactgaaaactgccctcactttttcaaatttgattttcaaaactgcccattcgtgtctactactccatcgcttgtcatttctgcttatttctttttctgtcacttcctcttttcctctcattatcctctcgagtgtttccttgcgccttctgcaaaatcttccttcgtttttcaaacatcttcaacttcttcgttatcaacaggttagtatcttcttctcttctttttctgcattgtttgttgttttggcattgttgtgtttctgtcgatatcatcatttcttaggatttctccacagtttctttctggctattctttagttcttgagtttttcttcacaccttttgggtttctgggtttcgtctttcttctctggtttacttcattctgtgattattcgtttttgagatactatgaaattcacccctgaagaagaggcgaatatacgcaggaaatttgggccgcgttccgcttggctgctatatggccttccgcttccggcgggggaaaacccaaatgaccccctgcgccgccatactggcggttccttttcttccaaaaagcaagggaccaccgcctctctcggtggtccatctccttcatttctctcactacatccgggtcctgtagaccctaacccggaacttccagggccaatagtgtccggtcccatctcctctaggactacgtcttctttgggcccttcttttcttgggcccaatgttgacattggtaacccccaaaatctctctttagtcatttctagtcgtaatcccaatcctccggctagcccttctcctcgttccgggtacgaatcgtcctcggatggagtgataactattgagtatgaggcctgcatgaactgtgtgtccgaggccgttaactttatccaactggggtccgacgacattgcagattcaatccttggaatgtgtcgtcataaccctgttttgcgtcctgctttcaaaggctcgcaatctgggcggcccgctcatgctgtcgtcggcggggtttcggcctcggtttctcgtgattttaatgagttgtctccaggtacgttttactaacttactttcttacttcattttcgtaggtataatgggtgttactcccgacacagtggacgaatctgcttcagtcgagtctcagtccgaggtccccccagcgttagcgtctaggttcccctgggtcacccatgagattcttcgaacctcctccgcccttggtcttcatagtatactgtcgaccccagtggggaggcaggacaggtttgtcctgcaggctcccctacccggcgagccactttgtgctcaacgggagggtaacgatcctaatttcttcttcttttttcaagatgtagtaacccaaataggtattatcttccctttttcttcttttgaaattgaagttttgaaccaccttcgggtagctccttcccagctccatccgaatagttggggttttatccgttgttttgagttattctgctcggatttgaaaatcccgtgcacagtccccctcttcttttattactattctcctcatacccctaggacgggtagggagccttctaaccggaagggatggatttccttccgtagtcagagtaaaaggaaactctttgagcctttttcggattcgttccggggcttcaaagacaagtatttcaaagttgctgcgtcgccccattgtcaacccttcttcctgtccgggcctgagtcttctgatgtggagtgggtctttcctttgtactggtcacaagaccattataaacatgatcactccaattatcgttttatcgaggaggaactgtccgactcggacgcctcctctgtcttcgtaatttctgaatttgtgggtgcttatggtcagcccaagacttctgactacatcggcagcggacgtcaaactggtctgctttggtaattgtattttcttggttcacacttgaaatttatgctaatcttgtaaatttttctgattgtagccggcatgggatcccgacctcccccaaagtccaaaaccgacgcggcccacctttccaagccgactgaggccaggggcaagggcaagaggcccgccaatgacaaccttggcggcgcgcccaagaaacggggtggtccttcttataggacattctttgatggcggccccccagttttgtcgttggatgcgccgtcgactgcacagcctgcccctgcacggcctgccccttccccgacattgaatccggtcacagtgatcgatactgtggaccttactgtggccggagatcggtcgcgtactactcctccttccgactccgagcagctccgggcgcgggatcgttcggataacttgtggaaaaaaggggttactgaagcattggtccgtttgaccaagcccccttcttatatgaccaacccgggtgccccagtgggggaagagctggacgagatggtcaaaattgaggagtacgcgtaccgcagcgcctctctggcccgggctcttacttcggtccgggaaaagtaagtgttctttcaataattttttatctctatttgctcaataaatatgcttctaagtgttgtcgtcgcagatatggggtggctttggaggaaaaggagaaggctttggaggagaaagataaggctttggaggagaaggataaggccttaggggaaaaggacaaggcctgcacggcgcttgtttcccttgaggctcaactcacttctctccaaacgcaatcggcggcggaggccaagctgttgaaggaggagctgctcaaatctcaagccgactcggcctcgttgcgggtagagttggctcgatcactgagttcccttgaagctgcggaccagaaggtggccatgctgacctcaaatttggattctgtcaaggctgataaagaagcctgtgttcagaattatgagggtcagttggctgctatgaaggcgagccttcgtgatgctgccgaggagggtttcagcaacgcccttgaacagattaattttttgaaccccagggtagctatgactactgccgggatgcatttcttggcatatgtcgaagacgggcagcttatccctcctcctgcatccgaagagcctttggcggctacaacagaagttgtgtcgacagaagagcctactcctgccgatgctactgcttctaccgacgccgcccacctgtatccggccccgtttctgattcccaacccccgcaaaactgaaggaccagaatgccggttttatcttgtatttttctcttgaatgggcccggtgcccggaacaatgattttaaattctttgttgggctcggtgcccggaacaattagtaaatttgtatataaattgttcaagttcttcacttgattcgtaaaatatcttgcgcgcgcatctttttggttccaatgaccatttgttatatttgcatgtattgtatgtcgttcacgttatccgaccataaacaactttgctaacgaatctgttgtccggcctgatcagggccgtttagcatatcatttatagtcgttatcataccatgaaaccgtatagaatggctcaatacttatggtattcaaaaattcttgcatttatatccgttgttacaataacaatatgtgtgtccgagtaggatcaacactttaggattacaacgatataacttattcaacaaaatgaaaattttgctcaggaaatgtcttcgtcgcgaaagaggaccatatgggctcggatagacctatccggaatccataccctcgatcacgagatcgtcctgttcgacttcctgatgaatagggaccatacgagttcgggtgttacttttcccgaatccatacccctattaaccagtaggtcgacagtttaactgtaatattgcttcaacttgttcgcattccatgttcgtttgaccggcttaccttgtagtgtttctaacacgtacgctcctttatctaactttttagcaacccggtatggaccctcccagttaggtgctagttttccatcccgggcattcttgtttccgacgtcggcacgtcgtactactaagtcggttttttcgaactcacgtgggacgacctttttgttgtacttatacgccatttgctgttttacctttaactcctgggcatgtgctgctagccggacttcctcgatgattgtcgactccagagctaagacttcgttgtttgtttcctctccggatagcaatgcttgttttcgtcgccatgactgttgtccgacctcgactgggatcatagcttcgtttccgtatgtcattcggaatggtgtctccccggttgatgactggacagaagtccggatcccccataggacatagtataattgttccacccaagtcgatccggcctcatacatccgcttccatagggcctccagaattgttttgtttgcggcctctgcttgtccgttggattgaggatgctctactgatgcgaaccggtgtcggatgtggaaattagccatcatctcttggaatcctttgtctatgaattgggtcccgttgtcggtgattacttctccgggaattccaaaacgagaaattatatttctttcgaagaatttttgtacccgggccgacgtgatggtgtttgacggggccgcttcgatccatttagtaaagtagtccacggtgactattagccacctcatctgtccctcagccggcttgaatggacccaggagatccatgccccacttataaaatggccatggggccgagatggattgcaattcttctggcggggataataaccttggcgcatgcatttggcagctttcacaggacctcacatgttttgtggcgtctgcgctcattgtcggccaaaaatagccagcccgaagtgcctttcttgtcagtgcccggctccccatatgctgtccgttgattccttcatgaatctcggataggatatagtcgacttggtttggggccacacataccaacaaagggctatgcaaccccttcctgtataattctccatcgaccatcgtgtacatggccgacattcgtgtcaggcgtcgggcttctaaatcgtcgtctggcaaattcccctttccagaaaatttactattgggcgtcgccaatcctggtcggtggtaatcatcattacgcacgtcggttgcatcgtttgctgttgaattactgttcggttgttcccgggttttttggtgctcgccagctttgataggatatctgcccgggtattctcttctcgaggaatgtgattcactgtaatgtcgtcgaactcggacatcaattcatttactcggctcaggtatttggccaacaaaggccctttcacttggtatcgtccttcgatttgtgccgcgactagctgtgaatccgtgtaaacctttacgctcttggctccctgttccttggcttgcaccagtccggcgatcaaggcttcgtattcggcttgattgttcgatgttgggaagcctagttgtaatgaaatttcagttgctacccctccgagttctcgattataatcccggctccactccctttcttgttggaagacccgtccacaaacaaggtccaccactcgtcgggcattgggttgtgaggggtgagttctcggacgaagtccgccaacgcttgggacttaatcgcgtggcgggcctcgaatttcaaatcgaactcggacaactggacggcccagttggtcagcctccctgccaaatccggcttgtgtagcacctgtcggattggctgatctgtccgtatgacgattgtgtggctctgaaagtatgggcgtagctttttggcagcgacgatcaaggtgaaaactagcttctccaacttttgatatcttaattcggagtcgcgcaatgctcggctcacgaagtataccggcttctgcgtggactctacttctcttactaaggctgcacttacggcttcttcgcctaccgacaaatacatgatcagtacttctcccatttccggccttgatagtaccgggggtgacgctagtgactgcttcatgttagtgaaggaggcttcgcattccgggttccattctatggcggcctgtttctttagcatcttgaaaaatggcagtgctttttctgctgactttggcataaatcgggtgagagcggctattcgacccgtcagttgctggacttccttcttgctcgtcgggaattgcatgtccaacacggcgcggcacttatccgggttggcttctattccccggtgtgttagcatgaaccccaaaaattttccggccccgactccaaaagtacattttaacggattgagccgtatactgaaccttcgtagccgaccaaaggtttcttcgagatcttcgacgtgtctgttagcatctgtcgacttgacgatcatgtcgtctatgtagacttcaatatttcgtccgagctgtggttcgaaaactgtgttcatcatcctttggtacgtggcccctgcgttcttgaggccgaatggcatgacgttatagcagtaattagccctatcgccgatgaatgccgttttctcttggtcgtccgggtgcatagggatttggttgtatccggagaacgcatccataaatgacaatactttgtacccggatgagttgtcgaccagttggtcgatatttggcatggggtaggcgtccttcgggcacatcttgttcaaatcggtgtagtcggtgcacactctccatttttcgttcggctttcgcaccattacaacgttcgacaaccaagtggtatattgaacttcgcgtatgaaacctgcttgcagcagttcgtcgatatgagcccgcaaagcctgtgctctctccggccccagtttgcgttttttctgttccaccggcttcgaccccggatacatggctaatctgtggctacagaaagcagggtcgacgccgggtatctctgacgccttccacgcgaatatgtcgatatttttcttcagacaacggatcagcctgtccctttgctcaggttctaatgcccccccaatgttggtcacctgaccggctgaggctccgattacgatctgttcgactttcttcacgggttttggtctccattcatctggggcttctcgcatatccagctccacgacgttaacggaacgtattaggttggaaatgttgttgtcggtgtctttctcacttttacgaaccgtgtcgtaataacactgtcgcgactctttctggtcgccacatatagttactactcgtctgttgttacccacgaacttgagtttctgatgtttagtggacattaggatgtcccatttatggatagtcggtctccccaatatcatgttgtattgggatgggaaatctgccacgacgaactccacttcttcggacttgtaagattctctcgttcctagggttaatcgtagacggatggatcccatcacatttgtgttgccgccgttgaaaccgatcagcatcgtcttgcagggctttaagtcttttacatccaacttcatcttccggaacgcagtcaacatgataatatcggcggagctcccattgtctacgtacattcttcttaccctgcaatttcccaccgttgccgatatgaccagcccgtcttcatgtccgggtaccactccctccatgtcctgttcggtaaaatacaagagaggaggttctggcttttcgacccgggctttgaatctgggttgtgcctggaccgacaatacctctttcaagtactttttcctttgggtggaagtgtcgccgccaccacccatacctcccgagatcacgttacactcgaactcgggctccgggaactcgtcattgtcttcccggggtttctttccttcgtcttttcgttgactttcttctcctttgcgtttattctttcttccttgtgttcggatgacgtactgctttagccttccttcccggatgaacttctcgatcgcatcccgcaggtcccagcattggtcagtagtgtgcccgggtccgttatggaactcacagaattgtgacttatccaatccggccttgttgaaaacggggcgaagacgttccactttcttcatttctgtaaatgcaacttccttccaaatttgtgaccgggacacgttcagtggagtatacttctcgtatttgttttcatatcttgctggtcgggattttggttcattattccgagttcgattctcggaataccctctattctttgggggcggactcctcttatcatgacgttcttttccacgtccagggttattgacgacttccatctgttctagctccaaatatttcttcgcgcgagcacgaaactccatcaacgacttcaccgggtccttatatatggacttggcaaatcttgatgaaccatcgagtccggctgatattagatacacgtggactctctcctccaacccctcaacttgcagagctgcttctttaaacctatccaaatagctttgcaaggtttctccgggtagctgtctgactttgcccagagtgaactcggacttcggctgctttttgctggtcgcaaaatttaacaggaacttctgtccgaaatcttcaaaatttttgatcgacctaggcggtagggtatgaaaccacgtctgcgccgggcccgtcaaggtcgtgacgaaaattcttgatattatgggctcgtcaatcccccggacacacatttgcaaatcgaactcgtcgatgtgcacttgcgggtcctgtgttccgtcgtattttgataggaaagatccatcaaaatcgtccagatatcgggccttcacaatgtcgtccacaaaaggactgttattttgatgcccccgactatacttccgacggtatatggggcccgtcttctgacagaaattttgttcgcccttcttatcgtgtccgtcatctcgcggaatcttctcattacttacccgtcgactaggattgtcgtcggggatctgtcctacgtcgacctcgtcacgtagctcgtctcgactccgattcggttcgtcattcctcctttgatctcccgggtcggcgtcgcgtcgatgagttatctgagttctcaaatcttgtggctgctccatccgcctttgaacctccgagtctgtattccttctttgattcaggtgcgtcctcaaatcctccgtctcgccctcaggatttgagagttgcacccggtcagctatcattcgcagctgttgctccaattgcgccgttcgttgcatctcggcacgtctccattcttcattatgttcttcaatttggcgagtaatgtttcggatgtcgtcttgtctttgtaaattctgccgtttctccatgttctcaattcgggttaggattgaattgaggacattgctaactaactgtcctccgagctcaccctcctggcctatcctccgtgctataggagtcttctgttggtctgtctgggcgggagaggaagcttcgtcggaaacagcctcggtcacgtgtacttcttctctccgcgccacattctggttctccggtaggtaaatctccctgttcggcatctccaaatgcggtacggaatgactgtttcttgtgttaaccattgttgaaaggtgtgagactcgaaatttaacgttccccacagacggcgccaatgttctgtatgtttccagaacacaaatgtataacaccgaagtgctatgtggttgctgtttgatcactctaactctggagttcaagggagtcaatggagaatgacaccttgaagcagaagatcacagagatacaccaatggaagtggggtgtgtgctctgtgtaattgaaagagatagagtcagagtgtgtgtgtacctttcaccaacgagcaagccatatttatagatgaaatacctaaccgttggctaactgcattgtgcgcgagtggcttcctatatttcctgcctccacctgcacgttcataactacctgagtggactgagtcttggtccacgtatgttgaatctcaataacgcatcgtaactaattgggccttaacataggcccaattatgactccagaacaataagtaagaatctcacatttataagtgcagcacttaacctcccagacatgtgatttccaggacttgttaatccatcaagattaggtgctttgaattcaaacttcgactatgttgtaatttctatttagtgctttgtccaatcataggtgggtaatgaatgggtaagacagaccacccattattgaatcatgcactatggggagattttaatacttacatgtagccagacatgagacaccatgaccactgtaatgcttacaattgattagtttgaattcgctcaagagaaaaccctagggatactcatagctccattcactaatacacaatccaattacaaattagggatatactcaatccttgggattggttgaatgaaaatacagactatataatgtgaatgaacacactttttcaacaatatactttcaatattttctttttctttttttaatcctataattaccaatacaaatctttttcattcatttcaaaatattattagtatacttttatttttatttacatgttcgatccttttaattaataaatatatttttgataatgcaccaaacattaagccaaaaaattataaacagaagagacaggcaatggtgcgtccaaagcgatcccaatccattacatccaaatcatcctccaatctgaaccagcgtcgccacctccgtcatcgagccaccgacggactccgaccgcgccatcgccttcgtctactactccccctccgcgccgtctgcttcacctacgacgattgtcacgtcgttcgatccatcctccgcagcttcttcgtcaccaacgacgagcacgaccgtgaagagctgcagcacatcctcggctgccggatgaagcaacaacgcaaccaaacgcacaggatctaagtttatttgttcagatctgagtttctttgcacgcacattgccatttgaacttcaaccgctcatactttcgcaaccttcgtgactctgttttgtgttcattgttgttcttgtgttcatagctgttggtgggtatagggggttagggttgcgagcggaattggtgaaggtggctgtggtgcgtgcccgcgacggtggtaaggggtcaggatggttgttggtgtttaggaaaggaaaaaggttagagattacgatttttttttttttaaataaaataaagatagtgatgattaaaaattattactgtattaaaataattatttaaaatttaaaatactaatgaaattaaatgttttaaatgaaaaactgaaaaaagtattaaaatgatatatttcaaaaatataaaagataaaaatgaatttttaaatttaatggatcattaagtctatttttgagttgtacccttttagataatttcttatgctgtaataactataaattataagttgttgcaggattttctgcattatgatcctaagccttagtacacaaggtaaagcaggcacaacctattgtcgaagttgttatcaatttgtagaattcaaatgttgctataactattctgatgaatgatgaaggcattattgtgacaagaattaaattcttgtgttttcataatgagcacgtcaagaattctaagtgctgttcaataagtatttcaaactgcatgcaatgcctaatttggatatggaaacacaagtgtagttaagtttagcataccaaagcccggttttcagatgtatttggtgttggtgaaatatttgtggattgtggttctctctttccaaggcagtaaaaattgagataatcttgtggatgatactgataagagagacctgctttttcaagggcatcagctacaatctggtacatcatagacattgtctgtccctatagtcatccaaatttcaaatacatgggttgtgataagtacacttcaatcatatttgttatgccaaagaataaacgaaaaacgcagagataaaaagaaaagaatacatatattattgtggttcagctaatgagacctacatcacagacaatgagtctcaaacattgaaacaatgaacatccctatttttactctaacttgcaagtcgataaatccatttacattctaaggaagtacataaaaaactggcctcataattcaggacaactcgttaacaaaattccaggcctctcaacgatattcataaatttgtgtcacttatgttatgtacatctattaaatattggaatatcaaaccccagattcatccttccccttatggtttgtgagttcattttcttcaaccaattgaaggcgaaggaaaaaaataagtctatgccaatatataaattgaacgaaaaaatgatttaggatggcagtagaacagtttgaaggaatttttttttgttgtttttttttttttggtacatagtagaattttaatgacaataagtctgttgcatttgacaagtttgcagtgattgtggattatcattaaccacattgcactcgtttccctcaaaaaaaatccattaccaggtaataatatataagtttgtggaagaaacacgttctaccaaactgacttcctaatttagacagactcacatgaaaagtactgaaaatgttcatctgcaaattttaacaagggaatatacagaatagaaattggtctgacctgccagaacaatatttcttgaacagcagcacttgttggaacaccctctggccacattggtataactatatatacacaaaaacgttcatttgcaccaatcttaccggcaattttcaaagccaactccatgggaaccaatggtttgcacctgttaagataagaaataaaaaccttacacttgcagtgtatttgtaaaaactacagcaatgtgtatctcacaaattgacttaatattcaaatgctactgaaacttaggatcaggagagtgatatagttcccttaaatgttagcaagaaatatgaatttgtataatgtatgcaggcatttgaaaacaatattacaaaaagagaaaaaataaagcaataataagcccttcaaggtgcacaccatatttacctaataaactctaagataagaaatctaacatggaaatgaatgcaaggttgcagacttatgtctttatctcctccttttatctcgcacatgaaccatagactttattgacttttactgaaaaaaacaagtgtatccttctttcaattttcaacttcctctcttaacatccaaaactccctctaatgccaagtctttatcttggatagtgacacttaacaggattaatatgcaaatgatttgttgtatattcatgcacctcccactaacctgtcatggttattccttcatagatacacaattatatgttctgggtctgagacatatatataggtacattacctaaacgccagaattttgattttgtaacaacgcaaaaactagcaaatgccttataaagttgaagatactgaaaaattaagtttatctacctgcattgtttttatatgaaggccaatgataggaggagcccaaaaaatactgattctcaatatatacaaagtgctcagcggatcttattgctctcacataagcagtatggatgctttgatctactttcaaattttttccacaaaaaagattctgaaacaaattaatattaaaagttaaggactaatttatctcaatataacttgaaaccacaccccaatgtgaaggtaatgaaaataacaagaactcatagtataaaggggcatcacgtataactttgttctcacctgagccttagctttgtcaacatccttaggaaatcccttcacggatcctgaatctatggacctaaatatctgtattaaatgtaaattctagttcaaatctttacttgattttatcaggggcacgtgtacatcacagttctatcaacatatttccatacctgcacattccaactctcggatcattttcatcggttacatgaacagatttatcgccgttggaacaaggagaaggtttgacaatccatgaaatccggtctagccttagcaaagcatcatcatgccaatttgtcacctttttgagcctgaagtcgcgccattttttggccttcctccatctttgttcaaaattggtcaatatatcatatgcgctggaccttcaattttgcaatgtaagtcatgccatggctgccttggtgcacacgaatttgaatgtaactgtttcatatagcacacaatttcagcaaattcccttatgttatttttttctcctttatttggtgctgatgtgtgcatttgttttccttctcactttcacccataaaaccgtgaatatcaaaccatagcatatactatgtgtatataaacattgacataattgattttataatgacatatgaacactctcataaggcaaaatcaccatataaggcaacattgaagaccaacagataatctagcaaatgaagtttatcaaaattaacagacaaagaagaagatttgggaaaactcaagcaaaatcagaaataaaaatttggttttgtttagagcacagcatcattctttaatctatttaccaagcccaccccagtgtaaggctctcgcttcttgttgtcattattgttgacaaaaatcagaacacagaaaaagccagaagttggtattagtatctttattccactgtatgcacataaagatatgttttataaaattccctagtagtataataaaagagaaggcatgctatattcttgtgaattcttcaatgtttacaataaacacttacttgaaatgtaggattatgaaaatcattatgaaacactgtatctagatcacgaaaaagccgatgctcaggtgtatcatatctaccatcacatagatccaaaccaccaatgaaagctgttattttccgattattcccagaacctagactgtctacaagaacacatttctggtgatgcgtaaagagggttcccacaacctggaccagatgattcaatcaaattagtattgttttaagttatagctaaagtacacaacgtgacctcattatatctatgactactactaaatgcaagtcttccagggaagaaataatgacattgatggtgacatgaaatagctagtatctttatccaacacaattctaaactcaaatgcaagaactccgtgcctgttgcttgaaaatactgagcttattgcttgcatagcgtggagatagcacacaatgaacagtagaatgtttgaaaaacttcttagtttcttcatcatgagtctgcatgacaccatcctgcaatcaagaaaatcaaatattataatgtacattaatattaaatcttagtgaacaggagtaagtacaaagtttttatgcaaccatatctacattacaataatccatgaaggaaatatctgctaaaacttatattttaggaatcttgaaagcctagcatctcattactgaatgttaatggtgcatatacaagatagtctaagcaaatccaccccataaagaagatacatcaccactatcttttacttcagaacccacccaattttatgctaaataggacttttactttgtattactttatggtatgaaagtaatataatgaatttatttggaaagcagtgcaataattaggacaaataaaaaactaacttccctagaatttgatgaggaatcaatgacatcatgtttatttttctgattagggtaatgagaattactgttttcaaaagaaacttgtcatgtgaagttctgtcatcccaaatcagcataaccactcggagcccttcttgtgacttgtacttcaacagctctccaagtgaaagctctcccccagaaggcaatggttttgttgcctctctcacaagcctcactgggtggtaaactgaccatcctataatgtatatcaggtgatgagcttccaaaattgcatggcatatgtcctcccaacatttattatgctgaaacacttttccaccctcaagtcgaatttcaggtagcataccatcaggtaaatgtgcatcttgatatagagtcacactccctcctttcctgagagggaaatatgttttaggaactcctaatgcttttccatccccactactaatactttctgaacggttcactccaatttgcctatactgaacagaaatatgcaattcaggataaggttttaagcagtttccatactgaccaatgataggaaaccaatcattaacagtatttcctgcaattatcttctgaacaggtatctccaccactccaatgagttcagccccaagaatatcattgtccttcacaaggaactcagtttttgagcagggtgagcaacaggcacaataaattgctcatcccacaaagggttctcacagttagcaatcactctagtctgagcaatggtagccccagcaatgcatacagaaacataagggtcactagttatcatcttgtcttttccagagtgtgtctttagtccttttataaatggagggtggcacatgttgcccatagtgatgcattttctaactgtttccgtggataaatctaaatttggaagagacttggcttctattatcaacagatccaagtcaccatgtaagaaaaccggtccattaaggccttcatgctccctgtttggaaagctttgggaaataccaccatgacaatccatttcaacctgagaactcaaaaaagatgcatgttttctaaattagaacactttgttttcaggtgctaaaatccaaattctagatgcaaaaagcattatggaaaatggtttaaaaatatataacatgcatgttgatcaccttatgatcctttcagttatttcacatcatcatcttttggttgtaaggaaaccatgcctcttcaacaaattctcagaggtcagatctttacaaagagaggagagaagccaatgataagaaataaaagtaaaaaaagggaaaaaaaagaaaagaaagaaatttgtgtgtatatggattcatgtaacaatgttgcagttcaagcatggtccaacaccacgtccacaagaagcaggagaagtttttaggccgaaaatggtggcaaatctcgtggaattagaagtttggaacccatctctctcttggtttttcatttcctgaattggcatattccaaacgaaatccatgcatggagacaaaatgataaacaaatatataaagaaagagattggtgaggtggaagctgatggagagaccgagagattggagacattttgcatggaaccaaggaacttcgtgctctcttctagttacccctctctctccgatacacgtggaaatgtttaataaaaggaaaaaagattaatctatttttaacatcatgacatttttcacatttatgttttttctccttaaactttataaggacacttaacattttcaattttcttccattatatttttagtaatttttatctattttattattattttaataattatcacatttattaacttattttttctttccatctctctcttactcttccattcaatctcttttattttgaccatcataattttcagtctttttcctatgttttgattttaaatccttaattttttttgtctttgctctcaagtaacaacaatttaaatgatgacttaacaagacgttgataatttattaacttgtcatgttatgacaaatagtcatacaagtttattttaaaaaaaatgtgtttgtatgtcctcatatattcaaaattgtggacaaattttatatcataactaaattaactattttttttataaagagtatgaattacttgaaagagtattgtatgacaaaagaaataataatatggtgagaagatgtgaattaattgaaaatatatattaacattgttcctatcacttctcttgttaataattatcagatatggttcacccatattttgttcaattactatcaaaacctatacacaaaacattacaattgggctagtcatgttacttgccaattgttagggattttcttactttaccatttgaatctcaaatgcaccattcaaattttgtctaatttcaacattgtccttttgtacttcttcttccttcctttcgttttccatttcttcttacaccattcagtttctcttcttattttgctgacctcctccttccattggctcttggaggtttgttagttacattgttgtggtggtttgtacatgttgcattcacttcgtcgtggtggtggtgggtgttgcggtgcaacatcagagtaagtttttacatttgcaaaatattagatacatgtcatacattgaatatgtatgggtcatacagattgtcaatctgtataggttcaaacaaaaaaaaattatagttaatgaatttgtattatattaacacttaaattttcaaatataattatatcatttggataaacaatttaattaaagacttattgaatagtactcatgaaaataatttaaattaattgtttcatataagttgtaagatcttttcaaaagctattatagagaatttattgaaataaatttaacatagcttaacatattataatctattttcataaaaactttcagatatttacacaagtgtttgtcaaaaaataagttcaaataaattcttttaaacagactttaaataagagatttgaaagtacaactatgtgatcttatcaaagatacaactataatttcatattaatcttttagttttgttggtacatgataattattagttccattaattaaagattatgatctaggaaaaaaatctcaagaaggaaaaagactaaatactaaagacaattatcttgccacatgcttaataaataattttcctttgctatttttgatgcaattttagagcgagagaataatatttaattaatgatagaaaaagttttcaaattgaaaaaatatctattaaatattttaagaaattaacctaaaactcgtcaaatatcaaactgtattttactatgctcgattaattatttaacttaaacttttttttactacatttaataaatactagtatgttttattttcaatttaagagtattttcttgaagttgtgggttgatttgaagtattagactaatagtgggcaaatttttagattatgattagaatgagaggattgcatcaggctttaggcaaaggttagtggtgatgaggaagaagccctcaacatcgaaggctacaacatcgacacgtaactgttgtgagaatattagcatgtggatcatgctgccaagagcctcacaatccagttacggaagattaggtgttattcataggtttttcaggcggccctaagatacatcagtgttgacatcatatgttgatcatgtagcagctaaagtgtggacatggaggtagttatttctttaattataacatttaatttttttgtcattttaatttacctaattaattataattatttgcagaacatattgacttgaagttggcctctcatgggaggaaggttgagaaattaggaagacctgcacctaaattgaagatttagtggttggttcgagcttaagttcttattacatgttcattggagacaagagaagagacttttgtctgcttttgcgaagagatgacacaaggaaactaatattttcatctgcccatagaagagatgagtattacctcgatgatgtgcatcgttgttacatctgccattataagtgcttccatatctatgatgcaatagatgtagagcaggttgtagattgttagttgagttgctaggagtgactacacaagaagcataagatgagaccatcaatgtagatgagacagagcagactgtggagttgttagttgagttgcttggagttgttacttctacccattatatgtgccttccataccaaatgacatgcattgttaattttatgcatccggttgttccaaaatatatcacatacatcttcatccttcatctatgccaatgaatatatatatcgagttcatgtacttcattaattgttacatttagtattactgtctcttatagaagaagatatgcatatcttgcattgtagaattgcttcattgctgtacaattgttggcattgtggtccttcaaagttaaagaatattttttgttttgaccatcgactttgtcatatcaccaacaataatcttttcatcctcattaatcgaccaacatatagatgtcactcaatgacttagtcaatgcatgattatgagtacacatattaagttgatcatccaccttcacctcccaggattggtttcgctcacagcttgacaaccacatttttagtgctagtcatcgtctgtactaaatctatcatgtatgctctatatttttcactcctctcacaatcaattaaaacaaatgaggtctttcctctctttccagttgatgtgtcggacctcattatcacaaccacaaaacaatatcatacgcaacaatacgaacccattgcaatatgtcatcatgggtagggaacacctacaaaaggacaatacatgtttcgtcttgttaggacatttatttacttactttaactaaatagaaaatcatatcaatacttgagacattagaacaatcaatattgtcaaccacaacagttcctctcccctatcttcattcatattaatttcttcatacataatgttctcatatatcactcatctttgttcatcttaacaaaacattaaaaaaaaaaaattcaatgacaaattaagaaaactaatgaaattcgatactatagcccatacggattgacatataataattgatacttgtatatacatataaaataatttatctcttaataaaatatatccattgttattacttttaattaattctaattattttaaaaaaatccatatattttaaaaacttcaatgtagaaatttattttaaaatcttttacacttgagaaaaaatatcaatgaacaatgaaagatactaatgtaacatgtatgtagatatatcaataaatatatttttaagatatagtatgacacaattttattatttttttggtacatcaaattttttagtttatacatacaatttgttttttttttgttactagaaaaaatataaaataaactattcaaatgtatataatatagtaatatattatattgaaatttataaaaggcggtggcgtacacacacacaccaacacacacacatatatataatgatttatatctaaatttccatatttcattattattttaaatatattataaataactattttatacttttatatatttaaaaatcaatataaaaatttattttaaattttctagacttgaaaatactatttatataaatatttaatgttattatgtaatatatttatacaatatataaataaataaaattttcttatacaatatgacctatttttgtatttaactatttttttaaattcattataatttttttaatttttataatgcttataatattggtaatctgtatagtctttacatattgacaaccatatggactttatggattgtcaattgtatggacaatacgaattagtagtatttcacatatgtaaaaagctatgccgtcgttgtcattgcaacacccccatgacaatgacgatgaagtcaatggaacaagtaacaaaccaccacaagccaacacaaggaggatgtcagcaaagtaagaagaaatgaatggtgtaaaaagaaatggaaaacgaaaggaaggaagaagtaaaataaaaaatattgaaattaaacaaaatttgaataatatatttgagattcctggtgcatgaagaaaattccgatcgccaaaattaaaattaaactcttattccaccccgaccattaaagaggaaagaaaaagataagaaaaactattgtgcataaacagtaagaaaagcatcatcaaactaatgaattaaggtgcaacaatttcacttgttatcgcaaatatgacaaagtaataaactcacacttcatgatttcagctagctaactagccaatgccaaatcactataacaaaataaaaattgaacatatagatagaattagaatagcaatggataagattacatcatatatatattgatcattcgatctctccctccttgtgtgtctcaatgacaacgtctgacctaggttgagcaacacaggtgagaacccagccactttctatttggtcatcatcaaggaagctaccatctgactgatccacgttaccttccacaattttgccaacacaggaaacgcaagaaccagacctgcacgagtagggaaggtcaatgccttcgtcctctgccttgtcaacaatgtaaacatcatctgggcattcaaactccactggtccttctggggttatgagcttcaccttgtacgaggccatgcaagtgacacgaccacctcgtccacttttcagaccaaaaagagattcaccaacgttggggaatgtctttaggcttgtggtggtcataggttgcctcctcatgaaggaggtgctcaccatggttccggatagagctgctgtggtggccattgaatgcacaatgaaatgaaaaacactggaatatgctatgcacttggtttgtgttttgtgacaacttattaagggtgtgggcttgtggaaatagtgtgcttgcaacacataacaaggtgaagttgcatccaaccctatctgccacgtggcagcattgtatgcatgggtttattatctcctttatcaccacgcaaatagtggttggcacaaccctcgtatcattaatgttcaaatggaacaagttttttgtatggttctgacttaaacaagttttagccattggatgcaagaggtctatctacttgaatggttttcaaaactccacttcagtaacaggtagggaattacgtacatatgagagccacaaagttcagaaagcaactcatagttgtcacagcagcaacaagatcgaaccattgttaattttataataataaactaaacggtaaagacactacaaacattatttatcatttaaaagttaaggaagcagataagaatgatattcagatgttcatacaaaattcatttccgagacttcatcccctctttacatatattgaatagttgaaacccatgttgggaattagacatcagtccttcaagggacccctattttataaggggatgaaacagtaaccacaagagttgaatattgtactacttatctaaaattatgaagataatcaattacagccggggaaagaatctcagggcttccccaatatagaaaaataatacatcctcattctcaaaaaccctgtggattctacctgtaaacattgttaggttccctacacatgaccagaggcttcctccaaaaatttattgtcttcagcaacaaacctatggaagtgctcaggtctgactcagaaaaccttaatcgcacttgatatttctgtagatcctcctcacgaacaaatttgaacctagaaaacccacagctcctgcacatttaaagataaattataacccaagtggggcttaatcagcactagatacgatatccaatcacataagcagggtgaaaatctaaatcaaattgaagaagacttaccacatagaattcctagtccaagagaaaacattaaagtgtatccaaaataaaagctggtctggaagaagcctgacatcttcgtcttcacatagaagtagtatattgagtacaaatacacataaacagctgttgaggcagctgaaaagaaagaagtccattgccagtggtagttctcagcatttaacaaaaagtatgtccccacaattgtcacacaaacggtaacgatgataagaatcagaaagactagcagcataaagccatacacatagtacacctgtatgccacaaagaaagaaaaaatatataagccaatgtgaaggttcacccagcttccactaaaatttacacatttttttacttaaaaagaccagtttctagtattattttccttgataatgctctgctcttttgacatgcgaataacttttataaccaaaccaataagtaaaaaagaaactttatcacagaaacaagtcatagtagtgccgtgattcaccttgtaattccagaaggaagtgaatacaaaatacatttcaatgaatatgctgccaaagggtagcagtcctcccatcagagaaaccacagagggtgtaaggtaccacttcttttcaggaatgggacgaggaatagtctttacgcgacagggattattcagagcaccactccagtttcttccaacaactgtgccaagaagtgctagagggaaggagatgaaagcccaaatgacaaaaacaaccaccattgtgccaaatggaattgctgctagagacccatagaatatagcgattgtgttcaatataaatccaattccaaagcacatgaatgggaacagagaagctgtaaggatcatggatttaatccagtgtttacctaacaaacagataaaaattagttacataatcattgaaaaccaaaaagagaagaccgagacaaagccacccaaacacacttggagcaatatacagaaaattaaagaagattcttacccccatttcgggagtacatccccccactcacataaccagaaatgaaagatgtgagagcataacacacaataaagtagtgacaatggctcctcgcctgagacaagcaacgaaggaaacttacatgataatcaatgaaagagaaaggagcaaacaacagaaagtattccaactagtatgaagtagaaatagccaactgtgcaagcactgccacatgcttattacatctagtaacattagtacacaactaggttccaatgaattcattattcaaacttatgcttaagtcagttgaaggttatgcacatacccaacatacaacatcccaacaatagccaacaagacgacaagaagaaccagcaacgcaagctgagcacctgtgccaacaacagctgaaagaataactaagttgcgaggaggccgaaaaacatcaccatgcacaagtttccagccagattcttcactaacatctctctcctgtaagcatggaagaaatgaccaaatatttgacaattagaaccacaatgctttctctaggaagaacggattcatattccacaaataattaagataaaagtcacgaaaccatcaccagactttccaaatcatcatcttcccgagcatactttgcatagtcatttctcagagttcgcatcaatatcattgacaccaaaccagtaaggaagatgaccatcatgaaagagttaaaaatggagaaccaatgaatctagggaaaaagaaaacaaaggagcaaaactctcagtgacagagctatggtaggaccaacatggatgaatacatagcaattcacaaaaccataaacaacaccatttcaattttaaaagcaaagctgtacctgatgctcaaagaaaggatgtccaggtagacatcaaagcgacgcccgaaagtgatattggtagaatcccatttgacagaatatgtcatgtccaaatgttttcctacttccaaaggctttgggatatcctgagtgagattaacatgaataatctgcaaggaaacagaccttaatatgaaacttaaaggatccataacatgtcataagatagcataagatatttaagtaacttctaacctgatcatggttgtatttaacaataatgtttttgtgtgtataaatgacatgcttgccattatcactgttcttatcaggatgtaactctccaacatatccttaaaatgaaaaaagaagtgtcttagataaatcactaacatgttaagtacaaaatcatattaaataaagagaaaggagaagaggcagttctggacataccccacaaaggtagatcatctgaacttgtgtttagtgcatcacatagcagaccaaaagaaataagaacagatgctagtaagtaattcagttaaaaaagaaagagaattcaataattattaaattatttaattaaaaacatacaaggaagatcatcctttggaaaaaatcctcacaacattatgacaatcaagacaaataatatcgatgattaattaacactaagttattgaaaatacttaagaaattacttcacacagagttcttaatttaatactttcagttgtaatagtgactatattatagaaattaacactcactaaagtattctagaatgcttatgaaaaactataagggcttacttggtagacaagataaaatataagaataggataggctaagaccataataagcttatatactattcaatgtttgatgtgcaccaaataatctattatatgatatttatgctaccctttgctatgtttgaggtgaattagaaatgataaaaatataaatgtaaatgacaatattaccctttgcaagatactaatatataatttatatatatggcatatatttaaaaatacatatatatatatatatataatattataatataatttttacaataatttttatatagaataagcataagatattttggaaatttccatatactttaggtgttttctggttgcttctgctatacattttgatgttgtgtttattttattcttcatgttaccgtactgaccaaagaaataattttctgcaagcttccaacatttcttgaaagtacaatcattctacaagttgtcaattgtcatagtaataagtgaaacacacaaagcaaaacatacccatgaagaattcaaaccagtaattattctctattgcatccttgaactgtttcacctttgcttcatcgagatctatctggcaaaagacagtcttatccacatttcctgaaaaacaatagcatccattaaagccagtttgccaaccgactgctcttctatgaaatacatagtacgacagaaaccttcatactttggaacttaatttcaagttggctatcgatgagctcattgccacccaggacctcaccaagaccaccccatttgtgtgcagcacttgcactactagatggatgacaaaatgggaggctgtaatagttgtatgtttcttgtggattgttataaggaccaactttgttcacccaaaggttaactggttcatcatgttgatactgcaatttttttttttttacaaaataaaatatataatgcagtacaataactaatacatacaaaaaaaaacatcttaaaaaacagaagcgttcaccatttgatactacaaatgaaatatacatatttaatctgtttcaccagctcagtggggaaaaattccaggataacaaatatagtataggggtggggataagcgtcacaactgactattatagaaagaaaaaaaagaaaaaaaaaaaaaaaaagaaaaagagaagaacaacatatactaagttattgacatgattaacaatttgatttcgttcactgaatgataatcaattatataatctatgatagtcttctgggagaaatattaagacaccacacattggcaaagcttaaaactctatattttaaaccttctggcaaacatgtaatgggtgtccacatcaattggattcaaatttatgttagaaaataaaatccagaatctttgtctaggaagccagttgtattcagagaaccagataacaatgttattagagtaaaaaacatgcaactcataagatgatgcgctgatcttaatattacttaagtactctaaatcaaactgatccaccattaaaaacttcttatgttagggtagaatttgatttacaacctgcccagagaatcctacatattacatacattcaattatttacaatcaattttttttcatcagaaccgttccagttctaaaaagaatccatcagacagcagatatgactagcaactgttaaatttgttttaaaaactttgaatcttaaaaatggggtacacaaatagggctataattctccacatcaatcttcacaatactgaaaatagtacagatagataacaaaaacctatatagcttccatgtgacatcacaattataaccaaagacttctaaacaacaccaaaatttcttttctgttctgtccaatttcagccaaccctcttttcacacatctcttaatggatccttctatggattcaatgacaatggatgcacacaacaacaacaaactaggtaccaaagcctaatcacaatgtaagctcttcccacttcccacgtcactagtcacaatacagcctctcggtatttcaaatcccctccaaaactagctcagcattaattattataaccttaaaaaaaaaaaaacagatgatccaagatcatgaactagtaaaaggggacaaagaagtcaaattgaatctaattagcagagaaaagccaaacaatgaacagcaaacacccacattgcaaagacacctaggtgagcacaagccaaaaacccagttgagatctaacactaggaaaacacaaccattacattacaatcttaaaaccggaagaaaaaaaaaatccgaagctaagagattgaaattgagtgcaagtaagagctaaaaacgcacgcggtaggcagatccaaatcccaatgcagcaaagagagtgtagatcgaatcgaaagaagggaaagggttttgggaatgaggaattaccttgtgatctgactctgaagcgaaggcgggagaaaggaagagagagaaaaggagcgggaagaggagggatcgggattcgaagaacatggcagtgatgaactagaagagagaaagagaaagaagagacaacagaacaacgcaacaacagaggaagcacgaacggactataatggtaatttacgttgtcgacgacgaaagagaaaataaggttacgttacgactacactgaaatgaaatgaataatgacgatgagtgcaaattttttcatttcattacggtttttggggtaatacggtgaaaccgtgttctgtgactttgacggtgaagttaatcttgggctatttggtttccaatctatagtccagtacgtgagttacattatggcccatgtattcagtattcacaccccctcccccaccaccaccctttttttgtctttccactcctcactttttttctattgtgaatttttcattccaccccattcttcacatttccctcactctctaagcaccctatcaagtctcaaccccacctccttatcttcttcaagcatattctcactttctcttctacaaacacttctcttccttgttcctcattctcttcttcatgtgaggtttcgctaccttgtacttcttcaacaacgttccctttcttaaatttttttacgtgtaattgatttgataaaaactagtttcgttaaatatcttgacaaacggagattaatttcaatcaaggatatttttgtaagaaaaaggttggggtgtaaagattaaaaataagaggtgccaatgacattcacccaaattgtatgtttgggggaaggaaagtgatctctacctttacaggaggggaaagttttttcattttatgtttgttggctattaaaaaaatttagataatttttttaggaatcaaaagagttatgtatattttaattattttaccatattatataatttgtaaaaaataacatgatatttctatcatagtaataaaaattaaacttgaaaaaaacaagattctcgtcttccctaatggattttttttttgagtaacttgttaaaaatatttatgagaaacatcattttctatgaatgttagtcaaaataataaaaacatgagaaactaagtttcccaacctattgttcttagaggatgtttgataaggaagaattttttcatacccaagaaatatgattcatataaatgtaaaatgcctgaaaattaatattaatataaaatatgtaactaaaattttttctccacttgaaaaattggattcttagccccccccccccccccctcccctcctctttaagaatgtttttgcaagaatgagaatgagatgtaaaattgattttcaagaattgtgacaaacttttattaattgtatatcaaacatgaaaaacataatttatactttaagattatgaaaatttttaagaaattcactaccaaacggcctaggaaaacaacatctctagaaatactacaagggtattattcaaatgttataaagtttgtatcaatgaaaaatctaaaattaattgacttaaagtcttgtatcatgtctcgatggaaaaataaataaaaaagacactaataatagtttttgcatcgagtataatttaagtgttaaatattttattatagagaggggagagagaaggaaaagagggaaggagaagtatagagaggagagatgagtgagaggagagaaaaaggcacgtgaggagttaaaataggagataggtaaagaaaatgagcataaaaaattcaaattattatattttgcatgagaattaagatgttataattttaagtaatcaaaatattttaacaaattattagaatttgaaatatttttaaggatctcattagtatgcacgtcaatcaaatataaaatcttatatctttaaaaaaaagtttaagttttattttaattactttaaaaatcacaattatcataaaattttaattgaatgataatataatttttttacacttataccataatgtataacaattaaactcacattttaaatatactatccaaataatatatcttaacaccacaaattctaaattttcacataaattgaattactcacttcaattaatcttatctaaacacagctgattaaaaaaaatctatctaaacacaccaagtatttatagtaaaatttgattagagaatcaataattaagatcgtaactaaatattttatttttatcacaattcttaatttatgattttttatcaaataattacaaatgcctttatcataactttatctttagtttattagatttatctaaaaaatcttcgaatttagattattattcaattgattttcccattatatcttgagtttgaaacaacttcatcactattaatatatatatttgcaccgttttttaataatttagctttataactttgtctcaatttaaaaaatctcacatcttcaataaagttatattttattatccgttttcctctattaagatacgtgattatatcactattatctaataataacgataacatttctatctcttaactttttatttatattcacactttggaagatttatattgaaaagtatctctctaattaatgcgcgcttttcttcccgcaactgatcatttaacagtttggctatttatctatatacatatatcgattagagtttgattgatcagtgatttgtgctagtgcctagttagtagttattggctgatcaagtgtggtgtttgaagtttgaagaagaaacagagaggaaggtgtgtgtgaacatggagaagtaagaggtagtgaatcaggacataggggttgggagatacgcggtcgtacggcttatgcgtcacaaagaaaccaaagatctcattgccgtcaaatacatctgccgggaagacaaggtacgttgctacttatgtaaacacctgtattttgttttccaaatgatttgatggtggaaagggaaatcataaaccctaggagacgaattttttttattattattaataatattattattattatatctcttttaattgtcactaatatttattagaacttactgatatttttaatgaaaattttcctttttaattatattttttttcatccacaatatttgaatctgagactttgtttaagaaattatttatttatttctcaaatatgggttagaaaattttatactcacgtttattagttggtaataaataattattgtttgatatatttagtgttcttaaaatcggtccgtctcgacagtttggatcgaaaattaatggcctaatcggatcgattttcttattgaataaattgtgtagttgacttaggatgactcggtcaaacccgaccaagaaggttaccgaatctcaattggaccggtttaatcctgtcaattttataacttttttattttttaaaaattaattttttttaaaatttggattattatcaattgttattttggattttagaatatagatagacttttcttactcaaataatgttagttatatatttataatatatatatatatataattttaaatttttaatatataccgagataaaatgagtcaaatcaggttaattaatgacccaccgattagatcactggttttctatctggatcaatgactgtatcgggtttcacaactatgagtatattattcatttttaaaatatttaaaataatattttcatgttatatttttttaaaaaaatctcaaaattaaagaaataatatgtgaaataaaatgtgacttagatctcttgcttttaaaaaatacaaacacccattcactttaataaacattgtttttaaagcaaatttaacacttttttgcatattattgagaaggtggcaagggaaatcgtaaaccttagatctcttcgtcatccgaatattgttcggttcaagtaggtatgatctgtttttactctccctctcttctttcaaagtatttgtttggcttctattattataaaatatgagttttaggttaattttcataaaagttaataaatttatcttaatagattgtgattcagcgataaaataaaactgttttatatataatgtctgactataatatattttttcataaaataatagcattgggtaagattacaaataatataagtgaaaagtataacagtgaataagttaaaattttaaaggaaatcaataatacgtgaataatattaattggtcattaatgtctttaaccactcgttgttaatatatgtgtttatacagtacattagtattatgttgagataatttgttctatatggaatttgaactttgaaggtggccttgacttcaacacatcttacaatagttatggagtatgtagcgggtggagagctgtatgaccgacaaatttcacgtaaaatggttatggagtatgttctagattcattttggagttagatttcacaaatttcacttctacaatgctgtttttttaaaaaaaaaagttagaagatttaatatattttggagaattttaaggtgtattttttctaactattttattctgattaaaatgacaaaacatagctcctatgtatcataaagttgaaatcttttgatatcattgaatttcatgtttaatttgacatgaaggaacatgacatattctacaatgtgttgagtgattttgcatctattgttgaaaatgtgtatgaatatcaatgaattaaaagatgacgatttttataaagattacttattaaactctttaaatcctcgtttagctatgacttatagtgtgtataagattgcaaaggagatatgagatcacttgagcactcaattttaaaaataatagagactttctaagattcttctaacataaagttctttgactttaagtttaatatgaattcaaacatcacttctcaattaagtgaacttgagaacatgaggaacaagctaaaagaggacaattttgatttgtctattaatctttttgttggtcttatgttgagtaagttacctgctgaatgaaattcttttaagactgacatgcacagactaaaaaaacatatgagattgaatgaacatatgggattggtcttgtgttgagtacctactgaatggattatcaggtaaatcccatatgttcatccggtctcatctgttcttttagtctgtgcatgtcattcttaaaagaatttcatttagcaggtagcttactcaacacaagaccaacaaagagattattagacaaatcaaattgtcctcttttagcttgttcctcatgttctcaagttcaattaattgagaagtgatgtttgagttcatattaaacttaaagtcaaagaacttcttcgctagaagagtcttagaaaacctattttgtttttgaaattgagtgttaaagtgaacccttatctcttttgcaatcttatactcattataagtcatagctagacgaggatttaaagagtttaacaagtaatttctacaaaaatctttatctttaatccattgatattcatccacattttcaacaataaatacaaaattaattaacacaatgtagaatatgtcacattccttcatgccaaattgaacatgaaattttcaaccatgaaattcagtggcatcaaaagatttcagctttatgatatcataggagctatgtttttccattttaatcaaagtaaaatagttagaaagagtgcaccttaaaatcctccaaagtatacaaatcttctaactttttttttttaaaaaaacaacattatagaggtgaaatttgtcaaatctgacctcaaaaatgaattcgaaatacccaaaaaaccttaggaacgactttttttggtcgtcggtcgctagaaaacgaaccagtcatcggaaaactgtagaaacttccaacgactatatctccttcgtctaacctttgttttacgcaagtgaccagtcaaaacgatcgtctcgacgagtagagcaaaatccacaaggttttaactcatgaaattggctgaaatttttgggatctggattcaaagattgcggagagaaagttttcaaactcagatcctggtcaatcctttcgtcaaaacatgaaagtgatatcacccttgagtttctcttgatgagattttcgaaacaacaccttattctctcaaatccgacacacgaaactaatacttcaagattgttagaggtaaagggtttaagagatggatttagtgttgggtgcttgaagtgttacactaagagacatcaaatatgtaatgctcaacagtgttacctccagcaaagggagaaccttagtgatatagcaaactattggactccagtccatatggacccatataattatacattaacttattatgcttgaatgtgaacatattatttattgtttaaatatatatatatatatattaaatatattcaactaaaagtatattactgtatttcatattatcaatgcattttcataatgagtttcgatattttttatttattaatggtataaccatagacagtgattaacaaaactgaattagaaataatagtggggtgaaaaatgctaaacattcttggattaattaatataaaataactagagtatccaaaaaattgattttaatgggtatgttcggttagaataaaaaggttttgcacagttgattaattagataatttcaacgaataataaagaattagtttgaaagcttgtctggtagcatttctcttctataaaagtataatataataaataaattccaatgttcacaagtcatggctactgttcgtaatatgcaattttttctcattcttcttgtgtatacatatttcaggctcgatatttcttccagcagttgatttcaggagttaattatagccacagcatggtagatgaaatacacattagtacattactctgagaacgaattgtaatttgttttcagtgtgtgttggtagtgatatgtttttttttttttttatgaaatatgtcatcgacacttgaagttggagaataccttattggatggaagccctgctaataatcttaaaatttgtgatttcggatattctaaggttcaattgacaaaatcatatataccaaccttgaatgcttaaacaaataaccaattaaatttaaatatacattatttgataattttttcttctgacaagacaacctttacttttctagtcatacctacttcattcgaggcctcattcaatgattggaactccagcctatattgcaccagaggttctttctgggaaagactatgatggaaaggtaatggaaaggtaatactacagtttctaactttagatcatgaaaaagactagaagattcatgttgtattaattatagactgatacaattattcagcagtcacttagaacacgcagtgacatttcctttttagagtgaaatagaaataacatattttagtgactactatgaagcacttaaaatgccttagagttaactgattctgacttgatgagtttctctgtattatatggtagttttgttcattttttggctgatgtgttactgttttgtacctgttcagttggcagatgtatggtcctgtgtgttggagtttttgtttaaactctatgagttatgaataagaggcggttaacaattcaaaatagtaactacttataaccgctcttgggaaaggttagaaaaataactactcccaaccgctccgataaccaacggttacgatggtttatcgccaagagtcgcgatggttcatcgccaagagtcgcgatggtttactgacaactcttcaccagggttgtttgttgtctataaatagacacagagacagtcagaaaaaaggaaggagaaaggaaggaagtagaaaactgatagttaacttttctgatagtctcgcttagacactagtgcatttcatatcacataactctgtggttcctcaagcattgtctttgttcgtttgggctgttgatttgaagtgccatcaatcttcagacgtgatccgttctatcctgggagacaattgttcattaacctttggcatcaattggagggaacaaattgtcttaaggagacaacattgttgggctcggatcctttcatctctttgcatctgtttctgattcatacttatcatacaggttctatttaaattgtttttgtacagttgtagtagattatgttgttcctcttgactactcagattctgacccttgtgcaattggatatattccaattctaaattaactaatagttccaacaatcttaagacaatttgtttttgaatctgagttcagtatattctatctttgtgaattatatactgttgtctactctctgtactttgaacgattaatctgtgtgattaattagtgtttctgtttgtgtaacagaaatgacttcgacaagtgcaaacttggtcatcaacaacaagactccctctgtttcaactcttgctgaaaagcctgaaaaattcaatggggttgatttcaagcgttggcaacagaaaatgttgttctatttgacaaccctatgtttggaacgttttctcaaggaagacgctccgaagttgaaagaaggagacgaacatgataaagagaaggttgttgcggttgatgcatggaaacactctgatttcctatgcagaaactacatcctcaatggtctagacaattccttgtataatgtgtatagcactttgaaaaccagtaaggaattgtgggatagtctagacaagaaatacaaaacagaagatgctggcttgaagaaatttattgttggtaaatttctggacttcaagatggaagactcaaagaatgtgatgagtcaagtggaggaccttcaagtgttagtgcatgaaattcatgctgaggggatgaccctgagcgaatcatttcaggttgctgcggttattgaaaaattaccaccatcctggaaggatttcaagaattatctcaagcataagcgcaaggagatgacacttgaagatctgataataagattgaggatagaagcagacaacaaagttgctgaaaagaaatttggcaacaatcctatggtctctagggctaatgttgttgaagagggatcaaagtccaagaaacggaaatattccgatattggaaatgctaaacaaggcaaaggtaaaggcaaaaagttcaaaggcaattgctacaattgcggtaatcctggccatcgtgcaaaggattgcaaaaagtcacagaaatccaaaaagaagactactcaagccaacttggttgataccgcttgtggagaaattgaaaatctcaacttaacagcggtggtgttggagtgtaaccttgtaggggacactaaagagtggtgggtggataccggtgccactaggcatgtctgttcatccaagtggatgttttcctcctatacccctgtgaagaatgatgagaaactttatatgggtaactcttcttcttcaaaagtggaaggtattggaaaggtggctttaaagatgacttctggcaaggttgtgacacttaatgatgtgcttcatgtgcctgaaatttgcaagaacttagtgtctggatcccttctgagcaagaatggatttaaacttgtatttgtttctgataagtttgtacttactaagaatgatgtgtatgtaggaaaaggataccttagtgagggcctttttaagatgaatgtaatgactgtaaacagtgatggtgttaataataatgttacttctgtttacttgcttgagtcttctaatttatggcatcaaagattaggacatgttaattttaaatcaattaaaagtttggttaatttagatttattgcctaaagttgaatgttctaatattaaatgtcaagtatgtgttgaatcaaagatttcaaaattacctttttcttctgttgatagatcaactgaattgttagatttaatacatactgatatatgtgatatgaaatctgtaccatctaggggtaataaaaaatattttattacttttattgatgattgcagtagatattgttatgtctatttacttaatagtaaggatgaagcacttgtggcttttagacaatataaaaatgaagttgaaaatcaacttaacaagaaaattaaggctataaggagcgatcgtggggagaatatgatggccccttcgacgaattctgtatagaatctggggttatacatcagacgactgctccttatgcaccgcaatcaaatgggattgcagaaaggaaaaatcggacattaaaagaaatgatgaatgctatgttaatcacgtccggtttaccatagaacttgtggggggaagccattttgacggcgaactatattattaatagagttcctcataagaagacaaagagcataccatacgaagtatggaaaggaaagcaaccttccttgaaatacttgaaagtgtgggggtgcttggctaaggtcacggttcctaaacccaaaaggttgaagatcggacctaaaaccgtggattgtgtattcattggttatgcacttaatagtagtgctagtcgatttttggtttataaatccgatgtctcagatatacatgttaatacgattattgaatcaagggacgctaggttctttgaggatatatttccgtataaaaaggtatatgaaccaagcggcaatgacaatgataatgttgtgagacctcaagagactacaactagtgttaatcctgtagaggaagaacctagacgtagtaagaggcaaaggactaccacatcctttggacctgattttctaacatatctgttagaaaatgagcctcagacgtataaagaagctgtaacgtccccagaggcaccattctgggaagaggctatcaatagtgaaattgaatccatcttgtcaaatcacacgtgggaattggcagaccttcctcctggcactaagcctctaggaagtaagtgggtcttcaaaaggaagatgaaggaagatggcactattgataaatataaagctaggctagtagtcaaaggctataagcaacgcgaaggtctcgactacttcgatacctattcacctgttacaaggattacatccattaggatgttagtcgcgctagcagcgttgtatgggttagaattacatcaaatggatgttaagacaactttcttaaatggagacctagaagaagagatctatttagaacaacctgaagggttttctgttccaggacaagaacggaaagtgtgtcgtttaattaaatccctttacgggttaaagcaagctccaaaacaatggcatgcaaagtttgataaagttatgttatcgaacggttttagtattaatgaatgtgacaagtgtgtctacattcaatatactgataaagggtttgccatagtttgtctttatgtagacgacatgttgataatgggtagtaataatcaaatgattaaaaccactaagcaattgcttgccagcaaatttgacatgaaagatttgggaagagcagatgttattttgggtatcaaaatccatagaacatcaagaggtttggctctatcacaggctcactatattgctaaaattcttgaaaaattcaagagtttaaatataactcctgtgaataatcccatagactctagtcttcgactatcaaagaatactggcaaagctatagcacaaaaggaatatgctcaagtattaggcagtcttatgtatgttatgaattgcactagacctgatattgcttatgcagtgagcatgttgagtcgctttacgagtaatccaaacatgtatcattggaaagctatgataagagttttaggatacctaaagcacactcaaaactttggtttgcattatgaacagtatcctgcagttattgaaggatattgtgatgcaaattggatcaccggttctaatgatactaaatctacaagcagatatgtgttcacccttggtgggggtgctgtatcttggaaatcgtccaagcagacttgcattgcaagatcaactatggaagcagaatttatcgctttagataaagccggtgagaaagcagaatggcttcgtaattttgtcgaagatgttcccaattggccaaaaccagtaccagctgtaggcatacattgtgatagccaagctgccattggtagggctaagaacatcatgtataacggaaagtctagacatatacgtcgtagacatgataccgttagacaactactctcgaatggaatcatctcaatagactatgtgaggtctaaagagaacatagcggatccattaactaaagggattcctagagagttagttgaaaatttgtcgaaaggaatgggtctaaggcctatcaattgttgatcatcgcggtaactctaccttgatgagtggagatcccacgaactaggttcaaagagacaactaagtcatgatcgactgttaaacactgtggagttttaaactcatactcattcctatgacaatacagtgtatatgagggtaagcataatggcttttaatggtttcttaatctgatgtgttcagatgatatatgtggaggtatatcacaagaaatcacctatgtgagtgtgaagtgagggccgcttcaatgagaacttaaaaaggccgattctctacaacacttgcagaaccaggaaggtgtccacggccaaaatggacacaacaatgaggacgagcaatgctagagaagcaattgtgtgactcctattgtctcggtatacaccatacaggttgacggttcaaggcatcacgaccaccgattggcctagtatacccgataggtttacactagagaaggttcaaaggtaacccctacctatctcgatgcaattgtttctcgccgaggaaccacacttgcatacatattcatatgcatttagtcatgttgaattgatctcttattcatgtgggggattgttggagtttttgtttaaactctatgagttatgaataagaggcggttaacaattcaaaatagtaactacttataaccgctcttgggaaaggttagaaaaataactactcacaaccgctccgataaccaacggttacgatggtttatcgccaagagtcgcgatggttcatcgccaagagtcgcgatggtttactgacaactcttcaccagggttgtttgttgtctataaatagacacagagacagtcagaaaaaaggaaggagaaaggaaggaagtagaaaactgatagttaacttttctgatagtctcgcttagacactagtgcatttcatatcacataactctgtggttcctcaagcattgtctttgttcgtttgggctgttgatttgaagtgccatcaatcttcagacgtgatccgttctatcctgggagacaattgttcattaacctttggcatcaattggagggaacaaattgtcttaaggagacaacattgttgggctcggatcctttcatctctttgcatctgtttctgattcatacttatcatacaggttctatttaaattgtttttgtacagttgtagtagattatgttgttcctcttgactactcagattctgacccttgtgcaattggatatattccaattctaaattaactaatagttccaacactgtggagtaatactttatataatgctggtaggagaattgccatttgaggacaaagaggataccaaaatctccacaaaaccataaaggtaatttgctttatttttttaatttaatttttatatactatcagtataaaagtttttagaccgtcaagtgtcaatcaatcagaaattatcttaagtatgacttaagataatcattatagaagtgaacaaatttatgtgaaatctctaatctctttacactatttagtacatatgctattttactttttatttttgaactagctctgttgatagattcatcaatcatcatgtcttatatgtactctttctgactccctatgtgtgtgtgtgtatatatatattatccagagagttatagctgttcaatacaagttccctgacaaagtttgcatatctcaagacagtaaaaatctgatatcccgcatttttgtggcaaatccagcaatggtatgtatatgaacatagtcatttaattattttttggagggaacattataaaataaaaacacttataactgtagcatgatattacttggtgtatgttgttgtaactctgccttataattatgttgtagagaatcaccgtgaaggaaataaagtcactacatccatggtttttaaagaacttgcctatggaattgagagaagcggctcaagatgtttactacagtggagaaaatacaaaatatcctcttaaaaatatagaagagatcatgaacattgtcaacgaggccaaaactacacctgcaacttccagtccaaatctataagagagattgattggggaatggaagaaatgataatgccgaggtacatgaaatcatttatgagaagcgagtcaaggaagcaccaaccatattcaattttttggataataaattagattttttgttcacttttccccctaacttaaggtaaatgttttgcctgtatctatgtatcaaattttagttttatgacataaagttgaactgtacatttttgttgatatggtacaaggtttgtagttgtgagctgtgacagcattattgtgatttataagtaagaggtcttcgttttctccctctgaatatgatgttatgttcagtcttcaaagcaatgagctatgataggaatagatgacacattgttgaattgtataatttaaatttcaaattatcgttaggatttgttaggttgttatagtttgttcagtttgttattatcctgtattattagcattttgttgaatttctctctcttatataagtacctcatgttgagggaaaatatagaagagaatggagtgaatgaatgaatgaatgaaagaggaattattattccgatttatgcatatctgatttttaacatggtatcagagtcatggttcccttcatgaatgagagccatggtatcctccatgaaaaaaatcatgtgttatcttccatgaaaaaaaaaaattttcgctaccttattttttagagtctgtcttcttcacattcccattgctaatcaaagtcatttccggaagagtgtctgaagaaacaattggcaagttgggcatgactgatattcatgcaccaacttgagggggagtgttgcattgtataatttaaatttcaaattattattaggatttgttaggttgttatagtttgttcagtttgttattatcccgtattattaatattttgttgaatttctctctcttatataagaacctcatgtttgagggaaatatagaagaaaatggagtgaatgaatgaatgaaagaagaattattattccgatttatgcatacttcattttaacacacattaacacatcacttgcctctatcttgcacagtgatttagggtcaggttgttatctttacatttatttggccttttcttggtttttgatttctttgagaagaaaactatataggggtctaattactagttgtggatgcaagtattatgattgttctgttaccattttagaaagaaatctttcatgaaagaaaatagaatgaagtaaagtcaaacgaaagaatttcattttttttcttttattttatcacaaaatcttcaaataataaaataacaatttaattatatttcctggtgcattttctcattttcttcaatttcttccatcattaaatatccaaacatagcctttaatgcttgtttgacatctaaaatgcaccattataattataatttcagaacaatttcatgaaattacaaaataactaaattgaattactttcaatttttaatcaacaccttaaaaattgttcattgcatgtctcagaaatagtagaggtggataaaggttcgagcaataacctgacttgattttttatttttttttgggaaatctgacttgacttaaagcttgaaggatagatgaggtagggtaaaaaataataaaactcgtttagtttcagtcaatatttaaacctttccaatgaatattttaaaacctttatttttatgcaactacaccctattcagactaaacattaaaattcccaaaaatcaacctgatcctaacctgcctactttaatttaattggtttggaacaaaatgttcagtctgaccttgcttttgtcccccgaattacttctcaggttcatgcatatttctccatgttagatagcattgctagtccaactatagtactatacctatgtgttcatcattcttaccatatatcaatgtaatttagtcacacattaattctctttttcatggaagctgtaaattgtaattacatacatggtcaagattaatctcaattcacggcaagaaataaaaggaaacataaaaaaacacaagggaggtggtggtacgctatgttaggacatttgaaacgtcaacttcctttggcacatacaatgtattttcacgaaaagtaatcactaatgctcctatttttacaacgcaaatgaagcactttttcacaaattttcaatggagctgccacggacgagactttgatagtgacccttattgataaagacaagcgtattatttacaaatgaatattggagtcgacattaggggattatgcttggatctctttgtgataactgattagagaatatgtcatatctattctttcatgcttatatttgtttttgttatctttaatccaaggtaatcatcatactcctatttttttataacttcttttttatttatcattaagttcattattatcaaattcaattaatttaagttaaagatattattaatgttgatctttaattcaaaattcttttgagtcatttatgcaatttttaaatattatattttttatgaatttttaaatattataattaaaccttcggttattagctttctaaattcgaatttcagcaagaagaaaaaataaaataaaaaaatcactctgcaattgagagttcgagagttctttttgcttcatgcaagtaataattgggaaaagattaactataatcgcgcaacaaaatctttgcctgctaattgttgatatatatataggtgggattcgactttaagcattgcagactctatactagatatttttaacttcgttgtttaacgagttatttatttttagatgttattactttttattattattggggatgatctacttattatattatattagattacttaaaattaagctaagatagtttatgagtaaaaaatattttcttgttatttagagattctttaaggaaataattttagaattgcttaaaattatataattggagtaaaatatgaattgtttattaactatgatgtgatattataagaataaattaatataaagtaaagaatttaaaatgaattatttaaattatatcgattaaagatgttgaaagtaaactatttgacgcactcgaacggaattgaaagccaagctaattaatatcctaatcttgaggctaaaatactaaactgtcttcattcgttgttgttttatacgagttaatttacttttctgtttggatttccagcattatattactaaagtttgattacgagaaaaaaaaattatggcctttaaaaagaggaggttattaaaggtgggcaattattaaaaaatcaataaatatatagtatttgtaatgtaaaagttttgactatatcatttagtgcatatttggttagaggttactattggttgtcttccgtaattttggagaagcatccctttattatttctatgctaaagtgcattggtattcccactatttaggttttaataggaatctaaacatattcttaattattgattgttatgcattataagattattaactcttataatcttataatattacctctagactaaaatataagaaaaaaataatatatgctagaaataaaactatcttaattataaataaaaaattaaagaaaattctaacaaatttatcagtgcattaatattaaaacgtgatttttttccaaaattataatcatttatctacttttttccatttcattaaaactacaattttttcttttttttatcatagcattcatcatatatatgttactttatttttctacctttcctcctttcttccaatttttctctatctactcccaattcattccatattaggatggataactattcttttcattaaggttaaatttgacaaatattttagttagtttttaatttttttactagctaaaaaactgttgattgtcgatgaacaaacttattttaataacttcttaatagattctaatatttcttgaaatgtcacttaagtaatattttttaaaatgctagtttctaatttttattttttatatttttttcatttttatcctcaataatatattaaattttcttataccttttttaaataaattatgatttcattatttttatgttattttacatgttttagctatttcaacaactaattttaaacttagttaaactaacttttcaactaattttgtcaaatataattaagatgtatgtatttttgggaagttacaaacttgcctcggtgataaaagaagagaggaaaatataatttattcaatttcttttattaaaaaaaactaacaattaatatttttcataaaagttgatatttgcatttttattccctaaagtaaacctacactttaaaaaaggtaaatgtagagaagaaattcctttcattccccgaccgttcaccttaaacatgataaatgctatgagtactagatttcccccgccgaacgttattaaactaaattagcactaggccatccttactttaaagtaaggaaattaattgaaaaacagtagaaaattagatatccaaaaaggaggtgaaaagagattgtcaaacaaggtgaaaaggaaagtttgctatttcattaaaatataaatttgttgtctaaggttctccctttgtccagtgagcagacagcacaatcctattttctatgttataaatcattatcatatctactttcttcttttcccagacaatcaatttaactttaacagaggaagatctgttcttgttgttgagttatcaaccacccttgggactagaaagctttatttgaaaggtagatttcacatagtacttcatatttttcggctttatatggctgtcattcttggagaaagtttttctcttttgtgtcttatgtcttaaccatgtctgcagataccgttaacctttgcagaaaggctagattattttccctacataattctgtttctcttctttacaagctaaaaacgacccatttaaagacaataatacaatatagcaacacgtttatttgagtcatgatctttaaaaatgaaatctaacaaacagaaatttctttaacctgcagaatagcatgtatattcgggtaactgggtttttacaaggagtgaatggtttgagtacatgaacgtgcggtgcactatggtttattggtccaaaatttacttacatttaattgatttttattgataaaatctgcattatgatagaatgcaagtgagagtaaaaagtctcatattggttagaacaacatataaatgacaaaaatatatatactgatgcttaaggttttaagtaaataaatgttaagtattcaattatctgtaattgactcatgattcattaacaaaatttcttcaatatttatctccttgtattccgtaacatattctttttatatatctaatgtaaaatacagatgaatctgttcaaaatattgaatatttcaggatataaaatttgtattcaatattggatattgagtggaaattctcccacacaaagatagtagaagcatattgatctctaattattcttgacaaaagattctacttgactccattgataaagaaaaagcatcatttttattatcaaatatcatctagtcttttgaattctatttttttttttatttctttcccatgtacctaatacaggaaaagaatactactactctgtctagaaagacgtttctcttattacttgaaggcattggcattttaaaattctggtttctcatgtatgacgagagtaatgttgctttacttcaaagcaagcatcacattctcttttgcaatttttttttctcttttctttgcttttcattggaaaagcttcttcaaggcctcaacaccatcaactcagcaaataaagaaaaaagggaagaccagaaaaaatttatgacattgcttgcatttttcaacataatttttcctttttattttcccttaaagagcttcattttgctctcaagtattttccacatttgctatggcttcactaaaccaaattatatacatctacttatgactacacatattcaacaacttcttccttccttccacaatttcatcaaagaaatcatcaagttgccctgttatagtctcaaccccacatctcaacaacccaaagcaacgtttcaagttgtcaacttttgcttggatctcatattgtgcatcataacccaccattctctccaactccactttcaattcctccatggcaatcttggcttgtttgaattcaagaagcagaatccctggctggacattattctggtcaatctcttgtgcaactttctgctgcaatcttgccatagaagccataaaacctgagccataaaccacgtgctccacgtgcccctcatacccttgttggtcaaagcatgaggaagaccaacaatatgcaaccccacatagcaaaatcatcagaagcaatgagctaaccctcatcattgcacaaagaacacctcggaagccattgaactcgtttaactttgatttcatacacatgttctgatttagacattgagacaatgcctgaattctattttccatcaagcttttattttcctctaccaatcctagactctccctttgacaaatatttatggccctaataacctgcaatatatgttttctagaagaatttagtgcatgtttggaaactcataaaaaaaacaaaaaaaatcacatcaatttagcttaatgaaagctataactattagcttctgattaaacatgaaaaatcacatctgaaacgtgcaatcaaaacatgctattagagtcattaattaaataaagttgatttagttttgtaaaagcactaagcttttgactaaaaagtaattttgaacagaatttgaggtgtatatatactatataccaacctgatgtgaaaactctggagtcaaatgatggtagccatccactgaggaagctatgttggagccagttaaggaatagttctctattccagaaatggctgatttgagtacatggcagatatcccaaagccttgagctttcatccatgtattcattcagccattttcctccaactgacaagcaaagcctttggaccaaaatggttaactgggaatggaaggattggagggatgagaagacctctgaaatgaattggattgacatgaagtcatgggagggaaggattggtgaagctcattgagtccttgagtgaggaagatgtagaagccattgacagaagagtttgtgcatgaagaactactcatcatgaaaggttgaagggaagttgatggagattgatagatttatataattggaagattaagttgaaaagagattaagcaatcaagaaagtgggtagcttagaggattctaacttcttttttatggtatggtgaaagttactattgggtgtaattatggctgtttcctatagagtggagtggattttttttttttttttctttccaatttacactatttatcttcaaataattctcaatttacattacttttaatttaattctcgaaatacactatttttgagaagtcatgttttcaggacttgacttcccatctaagtttttttttttggtaaatgttattttattaaatttaatttaaaataataattttgttatattatttaatttaaaaatgataatattttttggtttaataattattagtaatcttaaataattaattaatagtgttaaaataaataaaaagaacaaagtgattaaaaaatagattgattaaaaaatagtgaatatatacttatcaaatctcaattatattatataaaaaattaaaatactcaaataacaaaaaatactaacaattagagagataaacataataaatgaacataataaaacaaaataactaaatgtactaagaataaaaatgaaacacgaaaatgacgatactaatcatagtttgaaagatattatgcatcagacatgtttcttccatttgaatcattctagcaagttgtttattatgcacaacatctgcataggttattgcaacatgttgatcgataattgaggctggtttggttactagtttgctaaaaataactaaaatttatattggacaaaacacttctggtagttggattccggcaacatctttaacacgtcttcatcatcattctattatttcatattcgatttttttaatattttgtatggcctaactgtcgaaagaacaattttctaaccacatgtgattggtgacttccataaggggaatctctaggcacaacttgcttgatgacatccttaagtttttgatgttgcatattgaaggaattttaaatcttttggtttgtttcagtgaaggagtaacccaaaaaataccttgtcgtggtatcttgcacttgctattgtattacaacattgcatcatgagtaggaactagtgatggtgaatcgaagtaggttgagtatagtatcgggtgttctattgatgatacataataattctataaggtcaacaagcaggtattgcttattacacattaacattggggatatttgtgcgaataagtcaagtgtagctgaacgacttgattaattgtacaaaaaatattgggtaaccagtatccttggttaattccatgttcaaaggcacaaaaatatttgtctgtgtcattgtttgttgaggagacgtattttaagaccacaaaactttttgttattagaggtcgacaaatccaaacaatgatcaactccggctcgtagtattccaaagtcgtctctaaggcaataaatagcggtcaacatgaatcaaatacgcacattgttaacaaattgacaaacacaacaacacatttattgtaacagagactcaagtcccacttgaaactcctatatcacctggaaagtttagggttatgttataatcctagaattgcgaaagtggcgaatttcagactaagcacttatcgtgttttcatataatgaatgcctataaatctgttaatgttgatcccataaactatgtgccgctatttactttacaaaacatattgcaccgtctacgataactcctttggtttactgtcacacgaattaatatgacaagaatatgaaggagatcaatgggtcatgatccaaggaaaaggaagagtgcaaaggtagttcagtttcaaattacattcccactgaaaatggatgaagaaattgaacaagatataaaaaaaatgtgaaatatatcaacaataatgtcataattgaaaaagttgttattattgttcatgtattttatttatgatgtattatggataaatataaaatattaaactaaaaatattatcatattctaaaattaaataatataaaaaattaattaaatttaacaaaataacattaaacaaaactcaataaagaagttgggttaagcgaaggtggagaatcggatctgaaaacagaaatttttaaaggatagtatagttcagaaattaaattaagaagtaatgtagattgtgaattattaggagataagtaatatagattgataaaaaacctggagaggatgattgggaatctgctgcaattactttttattcctattgaacaaacaaatgtcaagagagagaaagaggcaaataatcttaagaatatatagtactgtggatcatatgtagagcattaaaaaaatatgcattatgaaaactatataaatagttccccccgaccccaatttctcgtacttgatggtttttctatttcttttgttattccatcgaatcgaggtttcagtatgagattggattctgctacttgttggagtataaaagattgactactttggcttaagattctgcttctcattcttctatttggatttggctcgctagctgttgcatttaaagtgcttcccttcggcttcttttctattttttattttctctttcttctcggcccatgttttaacctcttctacacgagcacactgcaccttttcgttttggtattcttaaaaaacgtggtacgtcgtccattttggtttttctcatcctgtagagaagaataagaatgaatatatcaactgtgatcctcaaattaaactcaaaactattgcggcttttttttttccttttcatattcactacaaacaaatgtctaatgtcatatactaataaaaaatattgatcgttaagcttattcccattaatatattttttagttaattaaaattaaattgttaatcaacttaataaataaatatataccacagtagttttttttattcagtgaaaacaagaacggaacaaaccatcacttacgaataccaacaatgcctaactcatcccctaaaagaagggattaaagacctcaattggaagactataaccgcagtataatacaactatacacccataatataaggtctatatttaattttattttctgataaatggatattatattaatggaggtaagttaataactttgtctttgttaatatatgtaatgtttttgtaatgactataatgttcacattatgttcttgctattgacgttcacactttgaataacaatttaaggttgacttcaatttttctgactgagtttttgttgtgtagatttattttcaccaaatcattgcacacattaagaatagccatttgaaaggctaagttttaacgaaaggataatgcaccaaagcataatcaaactaatctatctgaaaggacaacacttatatatatattgctttttcccacagtttatctgattttaagggtgcaggaaaccaaatcaaatattcatagatattagtcatgtattaagaaaatttctcacttataatcactttttccttgagagtattcaagtatattagtgatgttatttctgatattgactcatcgtcgtcctaggtgtgtggctagttctacgtataattgattcgatttgacacataaattaagaccatattcattttatttagatgatctataacaacattcctatgtagatttgtttttgttggtgtccacacaattgacttgtctagatcttatacatgatttcttttatttgacattgtgaagtctgttgcaaggtatttattattcttgtaattgtcactttccatagttcatgagcacatcatatatacccaaaattgcaaaattagatacacgcgttttcgatagtaagataacctttttattatacaagtgagaatgataaatatttactattaaatcttattataagttatcaagatcaaaatatataaatcacgtgagttcttttttataaaaaaaatcatgatttttaaattttttacataacatcaaatcttaatcattataattgtataattccgatttactgttcttctcacttttatataaacatgactttctcactagatatgttcctatacagtcaacattcatttatatttttaaaagtatacatacactaaattaatataacgaagtatcagataatttttaaatgatattaaaatttatagatttgacctattgaataagaatttttaatttaatgattgaattaataatgtttaatatgtacaatatttattaaaattactcttacagtaagttgaaaaagttgactttttatactatgaataaacaataatcaatttttggttattcttcaagagattatattgtttcattatgaatgctacagttatattgggtctgttttcatctgatcataatttctttattaataaaattatgaatataaattaaagtattttaacagtgcgaaagtatagaaaaaggaatgggtgaatgaatagtagaaataaaaactatttttatgaaaaaattgcacaaattaagtccatgagcacaagattgtttgagcatgaatgaaaaagaattcgaaaggattatgacatatagacagatacacaagtcacagaaagaaaagatttagttcgcaataaaagattatgaaagctaattactagatatcagttagctaataacaaaatagtcttgggttgatcagaatgctctgcttcaattataggtagtataccaagttaattttgaaacattgttaacgtagaagttcactttattatccaaatatattgtcttgttacttaacgtgtttgacaatacataaaaatattaaatccatttaagtaatataatagcgtattaatgtgaaaacttttcatcgatattcaagttaaattataatacaattatagatagaatcttattatgaatatttattatgaatatcataagataacataaaaaaagttatgaataacccaattttacatattctaataaaaatcttttatttaatcaatgctatttaatcaagaacactaattagcatttgccttatacataatatgatgtggttatatgataataattgactttcgtcaaaaattggctggataagagaggttgacaaattcctgtaggtgcataactgtataaatagaaatcatagacaattgtttatagaaaaatgctacatagctatacaaatgataaaataaaaccatagaaatttagcaaaattcagtcaaaatttatcaagagtcgcggttaattattagacataaaagcaggaaaaatacattcctgtaagaattagggtgctgaaagcacaaattcagtcaaaagtaacatgtttcttatattccagtctttaccagcaattcagcaccacaatgtgaaacacatataatcaaaaaaatgttgatgctgtaagcaacttgtaacaagttaacactatcactgtaatatttgacattccaaatccagcattcttcccattgaattaaacaattatcctgagaaaaaaaggtgaggttgattgctgtatataacattaatgaatttagatggcctaataggttactatgtccacagtcatcaaattgaaggtacgattcaaattcactaaagtttcttctaatcagatctcctttgagaccttggaattggcactgtttggatggaaagaagtcatgatgctacatggtgacaaattgctgcaaggatcatagatttcttgaataaatttcaacttgcacaacatctgtcccttgttcataactcggccctggattccgtgtcctcatttgatgaatcttcactattgaagtccttggattgattagggggttgtattgattctgattcttgatcatcgcccaagatttgtgctgtgaatcttcttgcctcaaaatccaggtctggccactcagaaactattcgtctagcaccctaatgttccgagataaagtagtaaaaaaatggacatagaagacagaggagtgcaaaaacataagttgtgataggaaacaagtttccatgaacacaacttaaaacagcaaaacatttacctgcagtttgggttcttttgtcatgggattgttgcacagatcaatggtttttgccttgtattttgtagcattaccacaccatgattcacaccatagccattcttgcggcaaagagaaaataggcacggtatgctgagcgtaattaggaagatcctagaccatttcagggcaaattttagcaaaaaggcacctcaaaccaaaaacaaaagcatgcattcaaaagagagaagaaggctacattggaagtacataaagattaatcttcataataaataatatgaaatatactacgaaactagtaacttgattttacagtcctaagtatccaattttagcccttcatacaatttatgaaattgactctttcaaattctgaaatattttttcaaatttcaaatggtaagaaggaaagacctgattccaacttgcacaaaaatgatattgattcaacactaaggtagtgtttggaccagcttattttgcctttttttctccttaaaagctgggccaaacactcatatatatatatatatataaaagtccttaaaattataagtagcttatttttaagactaaaagatgaaaataaggagcttattaagaagctccttggagtagctttttatagcttgtgcggagcttttctagcaacaaccatccttcgaatcccatctaccggcctttcatgtatttccttttctaaaataaattcatttcctcctttcttatatgtgcgtgcccctgcagcttttctgtggaataatgatgctgctttttttattcttcccataacattgaaatccttatgcttaacaatatatttttgttgttgagaaagtttctataagttgtactttcgtttgcaaattatcactgaaataaaattatattaattgaagtaatttcaaatttttaatatatttattttaatattttaatttacttttattatcattaaaatgatttaatatgaattaaattaatttaacacaatatttttttgttttataaatatactttgataattagtttcaaataaattaccatacaacttttaacttaaaaagagcttttagttagaaaagataaaaacttccaaacaacttttaccttttctttaaagttcttaatttagctttaacttgaaagtaacttttaagaaaaaaaaaaaaaaaaaaaaagccgccaaacataccataagccttgccaacaaggacatgctgtacatgagcagtctttaccagtaaattttttacgacagtgatcacacaatgtttccaacaaatacggaaataccatcttgatcaatgggtataaacatactgaaataatcaaattaaaaagtttctattctctaaataaattatacaacctgttataaatttataatatgatcactcatcaatagtcaccaaagacagattcaaagagcatatcataaagttgctccctagttttcctttcatttttggttaacggattgaagaggttacatattctttaagaattcactttgataaggcatatacatcaaaagttaaaacaactattctttggcccttgtttaacagcatactgttttaggttaaccgttttgtttagagcagtgttactaatcctaagtttgttggtcatgggttcaactccagaaacagcctctttgcatatgcaagataaggttaggtacaatatccttcccccttacctgtgcatagcgtgaaacctctgggtaatgggatacgtagtagtgttactaatcgtaagtggattagagatggttccttatgcctccatcttatgaagttgttggaaagtttccttaattgcggtcatccctacgccaaaaagggctacctaagaccagaaaggctgagtttaacatggtagagtgcagccactaggatgcggctcttaggggattgagatccccattgattagagataaggcctaagtagtgcttataaggcttgggtaatcctcaccttgcaagcaagttttatggggttgagttatgccttaaatccaaattctaagagaaatgttggagataccacatcaactagtgataaggccaaagtaatgtatataagtgggggacaaccctcaccttacaagccccggtcttgtgggttgagttaggcccaaacctaaattgttaaatgctattgagtgtatcctagagattatagttaggcctacctagccatctagtccttggtgaggggtgtgtattggagatcccattgtgggattaagttaggtccaaacccaaattgtgtcccaattctatgggaggattttaggagatacttacgtctttcacttagacaaaaatgatgagtcgggtattgatactcatgaccattataattgttataaagcctctctcccatagaaatatcactagttattggagttagttagacttagctgctttgtattaaaatctataactaagggggtgtatacaagttgatttgattttttctcaataatacaatttcctctatgatttctctatctttaaactctctcaaatctaacaagtagcaaccaaagaaaaccttgcatttaccatcaacattgtatctcacacatccacacttctgcttcttcctaccttcctgtgtacgattgttaatgccactgataaagtgagcgacgtttccacgtttatcagctcagataacaagactttgagaactttctcccaaaagaagaattgatttcttcgggatttggagggagttctggtgatggtaatgacaagcatccttctcaggatgctaagtgtcggaaaaattcacgacctctgatattacataagaaacagaggagattgttaccatttgttcctacaaaagatcctgcccagaccttgcttctgctttaacagcattaaatatggaattcagtgatcacctcaaatgcttgcctggaaaggctcctagatctgtgaatcaagccacactaaaaaacggtggcatgaagattctttccaaggaagacatggagaccatagaacactgcattgctatgtctaaaagaggtgaattccctccctttatggttgtttatgattcgtgtgaaagttatactgttgaggctgatgacctaatcaaggatatgacaattattgctgaatacattggcgatgtggattaccttgacaaccaggaacgtgatgattgtgacagtattatgtccattcttagagcagaaagttctcaaagtgttgttagctgtgctgataaacgtggaaacatcactcatcgctccctttatgagtggcataaacaatcatacacgggaaggtaggaagaagcagaactgtaaatgtgtgagatacaatgttgatggtgaatgcaaggttttttttttgtggttgctactcacgacatttctaagggagagaggctttattatgatcattcaaggtgacagttttaataggcacaacatgatggaggatgcactcttcttatgctggtcttggcttagaaatttagaggacggtttcactctcccttttcacttttggtctactagtatgggagaggcttttgtaactaggggaggatagaaatgagatgttttttgtatgtagacctagttttgatagcagaactcaggggcttttatcatgcttcaatggttcaagcttccttagttctgttatgttattctagggtattgatatgcagtacttcttgtaatgcagacaattcttttgatatatatatatatatatatatatatatatatatatatatacacacacactttattttgctggccaaaaaaaattatgatcataatggtcatgagtatcaatacccgactcatcgttttgtctgagtgaaagacaaatacctcctaaaatcttcctatagaattgggacacaatttagatccttgagaaaggagtctatttatattcttgaaaatttcaactcattgttgttgcatattccacaagttttgatataaagcagtcatttataatgcactgggttttcatgttatattgggactacaaaaaccagtcaaacttgcttaacaacacgctcttttaagtaaggattcatttgcaggtaaaggaactattaacttaaacctcttacctgatccaagttggctagactatttggatccctgcttagtgtttcataaataactctaagattatctccagctgcagtctctcggaacttcttcagatcaacaacatataaagcactgaaaaccgaaattgaaacagtaagcattgaaattatatttggcaatagaatataaaagtagctactaacctaatatggtatggtttcccccgcaaatgatcactccagaaaccctatgacacagggaaaaaaggttaacaaatatttatagccaatactgcattaaaattacacgggcgtaacgaacaccaagagtatcatatagattggaattgaacaataattagaatttcgacagtgacatttacttgtctccaaaacctatatccatccatctccttattattatcgcaaaatggggtatatgccaggggttttcctcttatatccatgtcatagagtactcccatgtctgccctaacaacttgatcagcatccacaaaaatgacctgcatatattggtagattttagacagatttcttgtaagggattttgattcttcattatctttgtcataacattgttattgggaaaaacccaagtcccacattggctagagataaacccaagatagaataacaagtgagaggcaacctcaccctatgagctagttttggggttgagttaggctcaaaccaacatcctaagaattgtgtagtgtgacattgaaattaattgtacaaaagacaaaaaccaaaagtatggaacttgatgcagaagaagaaaccatgataccttctccaaagaaagggggaaaatgacatctaggaataagattttatatgcccaaattattcgctgcttttctttctgcttatgcaaccatgtgggccacttgtacgtgactagttcatatttaaaaccatattctagggccatgtgtggaattaagtcctgtatgttaagtcaaccaaaatggttcaggatgtcaggcaaactcatcattctactttacattccaatatacaaatgaattaaaatgtaagcatatataatttgggtggatatataaccttaaaaggaggagagaggtagttctttatgaaccagaatttaactggacgatgagtattctttagaacacttagaatcataatcttcataaagcgttcatatctggaaattgacaagaagcacaaagtgaagattgcatccctgatgacaaataaaataccaccaggctccaactaaatatgaaaaaatattatagaatccaagtatggagtttaatagttaccatgcatttggaagtgtataacatttgtttgaaagattgtgcttagtaaaacttgcacaagaaattaacgtccataaatttcctattaattacaggcacttgaaactgaaattgtattctgaaatggaaccccaaatcccattccacgaaatctgaatcaacatacatgattgaccccattccatgaagaagcataaaacatcagtaaatgatattttctgctgtacaagacaatttttccaacatgatacgtcacatatagtaatcactgtttaaatttcgaaataaaggaccaaacttgaacaaacatatgttaaaaggcaaaactaaaaggaaagacagaaaggaaaattgtaacaacttataataaggaaccacttacaggtgcccagaagcaatagaaaagatattaatagtttttccatgccgtccaccccttcctttctcctatatgggaaaaaggttcaatctgttcaactttggaaatgatagtacaaagataaaaatggaaggacaaagcacagggtaaacacttaataaggttcaatctgttagggtgtgtttggatacgcgttgaaaccacgttgaacggagattttgtgcattccaatgtaaaaatgccaaatcattacatcaattaaagcttcaaagcctaaaagcaacatcaatctgataaaatcttttcatataacattaacttaagtaccaaaagctaataaggttttcaaggaaatataataaatgatgatttttgtaaaatagacaggtggaaaatgttaggaagtcttacatcgtctgccttaattctcggggtgcagcttatatatttgttgagcaactttacttagtgccaattggttttatttcagctgttgatgacattaattctgtcttccgagatgtatttgtgtcactggaacttgcttctaatttaatttcggttgggcaattggtggataataattgtaatgttaatttctcccagactagttttgtgcaggatcaggtgtcggggaaagtgatcaagaagggacctaaagtaggcagattgtttccatccagtttacttctcctatttttcctcattttcttgtactgctgtcccgtcctcattcaaggattggcataataaactaggacatccaaattcagttgttttgtctcatttaatagagaatggtctgttgggcaataaaactcttgtttctgactcatcctttagtgttcagtgtgcaaacttgccaaaagaaaaatctcccatttccccataatgctactcgtgctaacaaatgttttacaattatacacactgatgtgtggggtgtgtctcctgtcttgttgcattctaagtataaatactttgttatgtttattaatgactatagtcgttttacttggatttacttccttcgttctaaagatgaagtttttcctatgtttaagaatttttttgcttatattgagaaccagtttcagacaagcattaagattttgcgcactgactctggtggggagtacatgtctcatgcctttcaagaatacctacaacaaaaaggcatcctttctcagcgttcttgtccttgtacacctcagcaaaatggcattgcagaacgaaaaagtcaaaatttgcttgatgtctcacgctgattatttcttgcagcctctgtcccagccaattttgggttgaggctctgtcaacagctgtctttctgataaatcgttttccttcccaagttctcgagtttgattctcctttctttcgcctctttcaagttcatccggattatattgatcttcaaccctttggttgtatttgttttgtccacttccacctcctaaacgtcataagcttggggcccaatcagtcatgtgtgcgctcttaggttatagtatcactcacaaaggattcttgtgttatgttatgatgccacctctcgtcaatttcatttctctaggaaagtggttttctttgactattaaattttcttcccatgttttaagtcttcatctaatgatttgttaacctccctaatttttctgatatttctcattctatagaacgtttcaaaccaggtcatgcttatgttagatgtcagccttctttgtcccttttggctgctgatctgccacctgtgcctgctccactgcaacgctcgcctcaggtgtctcgtgcccctgataggtatgaatttgggcctatttctcttacagctactctatcaggcacatctgttcctacatgttattcacaagctattaaagatgcttattgggtcaaggcaatagatgaagaactcactgccctccaagaaaatttcacatgggacattgttcctcaaccccctagtgttaagcccattggttgcaaatgggtctattcagtgaagctgaattctgatggtactgttaatcgtttcaaggcttgattggttgcactaggtaacaaacagaaatacaggttggattatgatgagacgtttgcacccgttgcaaagacgacgtctattcgaactattctttctattgctgcctctcaggcatggtcactgactcaaatggatgtgaagaacacctttcttcatggtgatttggcaggggatatttacatgactcctcctccaggcctattttcctcgtctactggtgtgtgcaagctcaattgttctctctatggcttgtgacaagctcctcgagcatggtttgaaaagtttgactctactctcctttgattttcttttactcagagccggtatgactcctccttattcattcatcgcaaaaatattggtattgttcttatttatgtcaatgatatgaaattactggttatgatcatgccgccattcaacgtcttaagcagtaactcaaagcctcctttaatatgaaagatcttggttgccttaagtatttcttgggccttgaagtttatactgattctagaggtatctttcttcaccagcacaagtatacaaacgacttaatttctttggctggtcttgcttcagccactccaattgatactcctctagaggttaatgttaaatatcattgtgatgaaggagatcttttgtcggatcctttattatatcgtcagctggtgggtagtcttgattatttgacgattacattcctggacatttcatttgcagtccagcaggtgagccaatttatgcattccccatgtcatcttcatttggccgttgttcgccccatcattcgttaattaaaaggcacttcaactcgtggtttattttttcctactgggaagtctcctagtttggttggctacagtgatgcagattgggccggttgccctgatacacgaagatctgtcacaggttggcgcatgtttcttggtcctgcgctaatctcttggaagagtaaaaagcaatcacgtctatcgaagtcctccattggatcagagtatcgagctatgtcaatggcttgttctgaaatcatttggcttcgtggactcttagatgagataggcttccctcaaattgcagccacacctctctatgctgacaatactagtgccattcagatagctactaatccagtttttcatgagtgcacgaagcatattgacgttgattgccattctattcgagaagtattggacgctcatgttatatctcttcctcatgtcacgccacaacttcagcttgcggatatcctcaccaaggttgtacctcgtcctcgacatcagtttcttagcagcaaactgatgcttctagattagccgcatcaatttgaggggggatgtcaataagggattctgttattatgttgtttcttgtaatcagcaaatctgtctattcattgtatattattagctttcctgatttaggttgtataaattaggaaatagaattattgtgtcttaatggctgtaaatgcgtctttaatgacagtaaataaatctgtattatttatggatgaacagcagaatgaagggaaagcattcgagacagaaattctgacagaaaactaatggacaagtaaataaaagacatacttgcgaacttttttcagcctttttagataatttgttgccgccaatgaaaccagaagcccattttaagaagttggaattcaagccacttccctataaaaatatcatgaagatatctgttatggattgcactagctttagcctttaaataataatgtttatcattttatgcttcaaaacatgtttttaaagaacaatttttaatagaaagcactcactttcttctcatcttgtgcattgtcatcaggaagaagtaattcctcatgctccttgcccttttttttcactacttccatatgaaatactttaccccgtaaatcattaatagtaatgagttttgatgattgtttatcgtaacttccatcaccatcttcctttaaaatgtaaagctcggaacttcttccaggagcaagctgcaagtaccaaactccaggtgagactttcatttgccaatatcccaggttggccatcacaagggtatcaactaaatggggagtagtctttgtcccaaggatcagctgaagtccccgaggaggatcgtgatctttctcagaacagtgacctgattagatttcacaagagtgacaatagattagtacacagtgctcattaatgattgttaacatagaagagagacagaattaggaatataataattagagagattttaggaaaattgatagagcctctattagttggtttgggtatgtttagtgaagactggtagaaacaccaataaagatgtttaaccagatggaacatatttcattagttagaggtagaaggagaccaatcccatatttacagttaaacatatgacagtaatttatggcctcgtatgatccctttagccaatccacctagtgggaaaagctttgttgttgttgtgtttgtaattgtaagctaacaaggagaaaacagaagctaatgttatagacataactacacatattaaacatcctaattgcacagaagtgtttaatagaaatttaaccagtgacatgctgctggttcacaggctacaaatggctatattcattttcccttactgtgtaatgagcagagtaggttccccattttcttgttcttaaattgttctgcatctgtttcttcatgaaattgtttgtttcacatttcagtgttgggtgtgcctaggtccatggattagattttgttgactagctttaattgttatggtagaagtaaagaagccaaatttttatggtaatgtgcaatctatgctacactttgatgattatgcaggagcattatttttgtttttaagggatccctttggacaagcatattctttgggataagattaggcatttgaattgtagtagttgtagggacttttaaaagtggtgtcaattacaggaatgttaaggttgggaaactttgcttcatttttttgttgttgtcatttcttggctgttcttttttttttttttaaagagggcctctaaaagaaaaatttcttatataactttttttcttaaaaaagcgttaattatgctaatgaactagactactacacaaatagatgtggcctagcattctaacaagtagcaatgattatttaataatatcactaactaacagcttgtatttctaataaacaagatgcaatcttaccagtgaggacaagagcttcaagctcaaaaactgcttgcaatgtcctcgtgtcaccaaggttctcaagaagaatgttatccaggtcatggctgcagcatgagagatattactaaggactattaaaattcacaaaaagtagtcattacatataaaaactcagaaatgtattacatagacctccctcaaggcatggaaaaatcatatttatttcccccattcccgaaatatcaaagggaatgccttcgcttgacagaaaaatacaaagcattcagagtttataatttaattcaacaatttaagttgattatttatctaccagagttggtgtgtgtcactaattatgagattcattcaaatttagatgccaaaaactttattctttttaaatgttcaccccatttttacgctattaattcaaatttataacatgcttctttattaacaaagacaagggtacatttggactaacataaacattgacattagaatggtttaacgagtctaacagctacttaatggaataggttacggttactataaattttaaatgaggaagaccagtgtaatttattcacaataatttactcgtctccagttacattcaaacaaaaaattgataaaagaatcagtatattaacaaattctaaaataatacatacaatgcaataacgggctcaacaagccaagactcaggaacatcaagattcatggtgagagtcttagacaatggcatgtttgcaaagagtgcttgtgggccatttattgcagagtcagtgttgctaaaatcatcctgcaaaaatcagaaaccctgtgagacctagcatcaaatatcatgtctggaattatcttagagaattaagagttaaataaataagatataccattgttggtaccacatatctgtagtagctcttcagaggaagatcagcaagagaactctgtcataagatgaaaacagcattcaatacaaattagcaaatgtataaagaacttggcaacacattttgctggacgaaaattaaaagaaatatatcttgtagaaaatctcgcataaactatcactagaaatcaggagttcaatccttgttgctccattcttctaaataaaggctaaatttcgatacaagatagattgggccttcacattaatggatcttgcaagagggagtgcaatggatatcaaactaatcaagagccttcacctaaacagttaagcatttgggagagttggctcttggcaggttacaagctaaaaatatttagagtagaacagatgagggatagatgaattaactcctacaagcctattgatcataatgtgaatggactaatacatgcacatttggtttaagtgtaactattgcatcaaggagttcctttggataagcagctactttgggataagataagatcagacaattggttttacttggtgtaaagccgacatggttttttatactaagtttcatttacaactcagttgagggattggatagattttctttctttgttctctgttgtctgtatttcctttttattttaagaaggattttaacctcctgattctttgtaatcatatattctgtgtcaaaaataaaaggcctaaaaataaaaggcctaaacataagactgaataacagaaggccttatgaaagccaaattaggggaaattcacagttccacaacacaagggcaacactttggcttgtctcatccaatcacaatgagagagaaacaatttttttccatcttcttttttattccaaatgcctaaaaagaatcttattgaaggaacaatttcagttgcagaaaaaaaattattatataattatatatgtttgcagaacaataatagatttgaaccaaccactggattcagtacaattctcatgctgggctgaatgtatttccacaaaactcgaagaattccagacaacctctggctggttggacttaaaggatcaagaaccgcatcaatatgaatacttgaatttacattatttagaataatgacactgcacagataaatgatggaaaaagaaatactgacatcatataatacatataaatgagcaatccaaaaatgactaaatcataaggaaaaaaatgtttgagtgcattgtaactgataaaaataacctatgctgatcattcagaatctcaaaacgagcactttcagaattccgctcccgcatggccattgaagatgataaggccatgacaatatcactaatgaatttgctgcaaacaacataggcaacattaaagaattgttaaatattcagtaaacagaagtgattgaacaaaaaatctgtttaagttactataaatcagaggacttatgcacacccaacattctccaaaaatttcaagaactcaacaaatcagtagtagcagaaaaatgtaacaatagatgagcttgcacagcacataaacacatatgggagtttgctatttaaaagaaaagaaaatcataggcatattgaactgaaaccgtgtgtctgaatacaccatggatgagagtttatataggcttatagtattcattgcacataaatagaggatattcagtttcctataaatcagagattatatgcctataaactacaattattacaatgaattcagaaattatattctgattcccacatgcttatgtgacctatcacctatgcactttttaattctttaatttcttgtttctaaacttactttctattcaactgattcccatattcatttgcttgaatataaattctgcagaaattggtctatagctagcatggtttctcaatcaatcattgggaaacaatacttatgattatctcatcactttattctttgtatgatctttgcacttgcgttgtgccaaaaatgtcatgtaacacctcacttttaggctttggttttccagaccctccctccaacattttttagttaaaagaaagcatgtcataggaaggtgatatatgtaatgatccatagagaaatcaaacaaaaattaaaggtgaatcaaacagaacagaaaagttcaagaaaccttgttagcatgtcggggtaaacatcatgccattccacctcttcaataatttccacaatgtgctttgtcctttgtttaaattctattgattccagaagatgcagatcagcactcaaaaatgtgctttcgtcaattggataagttacctattaaagatagatattaaggaaagaacacaagattaataaggaaatttaaggattggtgaaaattcatcagcaaattttgagagagaatatttgtaaacaagcaatggaacaattattcatcagaaatcgttatactatgaaatagctgaagacaccaaaacaatattacccttccattagtgaagacagcattgacaccagattcaagcccaagcaccctatacaaagaattctgcacctgataacaagacgtctaattaatacaaattatcatgattaacagacaaaaaaatattagtgaaaaactctgaaattgtttaacatagtgcaaactaaaatgaaatacataaaagaggagcagaaatggaaaaaaaaagcagcgggaaaccatttccttcaggtattagtatcaaatagaaaaagtaaaagtatgaggcacagggttgggttgttaagaactaaaagcaaatgtccaaatggcaagataaactagaagtaccttagtcaaatgctttctcacttcaccggcaggaaattctaggagggcagacctatagcccttagatggtaacccattggcttcaccaagctcgcaaaccatatcaacaaatgcttgagtgcttcagcttccataggaggtgtaaggatgtaattcttctcatatagtgagcaaagctgatccaagaagtccaatacattcgtcttatgactgcacaccatgcgttcaaacatttgatataaaaatggtgcttccactttggaaaggaattgacaaaatcacagaattgaaattaaacaatctattaaaattcaaccagcttttgaattaaaagcaaaatccaaacacatacctatacaaggatgcagtaatttcaaagaccttaacaaataggaggctaaacaaattaggattccgattggcattaaatagaagacctacacgagcatttttggatccttctatctgtagcattatgttcaaataacaaaaacatcaaatatgcttaaaagcatcaaataaattgctccaactcataataggcattaggcacaataatttaaaaagaaccaagaagatttaaaagaaatgcatattggtattaaccagataatgtatgccttgttgaagtaatttcatcccattccttgaagtgatatcaacagcaagaagatgtgtcacagccttcgtatcatccattgctggtttggatcaaaacaatccacatgtgacaacaaaagaaacagactgtacaaaagaaattaaagattctaatatttaaacaacttacttccaggagaatgcaagtagacaatgtcatttagtatagattcctccccaaaagtaaacattgacagagatatgaaccttggtttgctgtcagaaataatctacaccaaacgattagcattagaaactggttatgagtatcatataaatgttcccaaaatttaaattattaaattaactactataccttaggattataacgttgtataccagcttctgatagaaacttagctaatacatcagtgtcagacattatttgtccaaaatatattgttcctgtattcttggagtctcatcattcaaggcatttataagagcttcctggtaaacacaattgcatagaaataagtagaggaaaaatttattctactaacactattaatacatcacagttatactagacaaagaaaaattgggcacaacgcaccttaaactaaagttgagcacatgcagaatatccaaaattaaacaacacactaacgaaaactacaacagtatggataagtgcaagtagtcaaacaatgataagtatacgaaggggatcttacaaatttatagatagctgtgagtttattagtgcattgtaagagactcatctgcattttactacataaagtgtatccagtgctatttattttattttgttttgggttgccatcattaagaaaaagcacatataaaaaacaaagagaaagaactcattttacaaagaagaccacaatattactgttagatattattacagaaagtagtattagagatcacctctcatgcttgcactgtaattttctttttctgttttgggcttcagttagtggtctgggtcaagcttatcagctagcccatagtcagcttctatcagttgtaactgatttttacaagtgtcaaagatgatatgttttaactacagcagtttagtatgagattatttccattattactcattattttgttttcttattttgtaaacctccttcattataaataagagtatttcgtgtggtctgatacgacaacacaacagtaaataattcttacatggtatcagagcaggttattattgacaaagaaataatgaaagtcgttcttcattggggacctactatcatcggtggacctttatgctcactgcccttcttttgatgaccctttctcctttcttctacacgccaaacagttttggttccattatcactgcagtgtgccttcgttctcgcatgaacagtaccagtaccgcaagctgctgcaaccctctattggcagtcatcgcgccttctatctccgacacaaccatacccccggagtctccacctcccggcgaccagcgtgcaccctgtcatgtcgccgttcaacgacgcacgcaccaccactctccagcgtgtgtgcatcacatgccagctacagatctgtgcatgacacctaccgccaggctgtccacatgtgcaaccaactcaacacaccgccacagcaaccccacgcagggcccttttccagcgagaaaagttcacgcacataacgtgtgacgtgtcacactggaaccgtatccttctgcctcagggcatgctattttcaaaggtgaacaatacccatcaccactacaggctttcattggttgcctccgaggtttattcggcacaaccccatgatcggaatcgtcttttgtttctgttgggtttaccacatttgtaacaagcttggttcatatgatatatatgctccagcttgaggggagtgtcaaagatatgatccgatatgttttaattagagcagtttagtatgggattatttccattattactcattattttgtttccttattttgtaaacctccttcattataaataagagtatttcttgtggtcagtatgacaacacacaacagtaaatcttacaacaagaatcaataatacagtttactttcagttgcacaaatcttttttctctttctctgaattctatcagaattaatgtaaacagagtgattataggtgattatgtaattagtgatatcatgtaattacagtaatcatgtaactataaatccttgtacggtacttattacactctgtatatataatttgctctttaatacacagcaattcatcacatttttcattttctctttctctcaacacttatatcttggccaaccaccttgtacaatataaaatattgtgaattgacagcagaattgaagaaaaagtacaaaaaaaaagaggaaataaaattttaaggcagtggaaaatattaaaaaaatcattacctcagtgggatcaataacaaggccattcatcaacaatgaacattgaagcttagacaaaccaagcttaaatacaaacttggaactttcttgtgacaattccttcaacttttgattcttatacagctttagtaatatctcttgaggtgggaatttacctttgatctataaaatacagagaatatttaattcatgtttaaaataaattagaacgtaatgttactgctaaaatattgaagcactacattagtcaaatgtcagaaggatactaatcaacaaaaatactataaaacttacaagattgtttccacaaacactccttcaacatggtgcagttcaagagcatcatctgcattgccatctgactcgatgtgtaatttgttaacctacaaaaatgtacaatatagttcctttaattgaattgaaaataagattagttttaaagtctcaaaacaactgctaaaatgtgtttcataaaaatcttagatataatagcatcatctatttgtgtatgctaattccaacagcataaacatttttatttttatcaatataataaaaacctctaaacaaacctttcagatttatttttcccttttttgtcatgttaatggggaagagatgaagccacttaaaaggttgtcaaatgttacgcataggttcatgattttttttaaaataaataattgaattcataggaaagtgattatctagaaatttgcatagtgatagacaaggggaaaatttaaaaagaaaaaaagattatgagtcataaggttgaaattcaaagttaagtcaaatcaagcacttggaaggttcaaattttgaactttaatgaatcaaatagatatgtagttaggttcaagatgggtggagtaaaatgaaagaacaacataacaatattaactgcatctgccacttttctttcctaattttggatttaagtcatgtgcttctggcatatgaagttttaacttttaaaccagtcgtaagtaagttcatggaaagacattgaactgaagatgacactaatgactaagtatcacactcatacattgctcaaaaaccggtaagccatttcagcaccataattctcgttgatataactgaagagacatataatctgaaaagagaaaaaaatgatgtcataaacttgccagtgaaactataacatatagaaaatttctatgacatttatcacacacacattcctgaacaacaaaaggtaaaaattaccgtagttgaaatatctcatcgctgtgtcttttgtagcatgattttctaactgtgtaacaaactcgaagaatacaacacaatcccaaacctcacaggaaaattattttcatacaatgatatgatcatatcaatggactgcaaaattccaaacaataaagcaagtgactaagattttgcttggaaacatatacaatgaataatgtgaaaatgttaagcttgaggaaaaaaaacttgcctccagaccacaacgggttgctggatcaagaacaaagacagcatggaaaaggtttttacggatgtaacgtagctgcccagggaaggctggcatcaagaactaacaaaataaatgtaaaatatgttaggttaggctaaatctttacacaaacagtacttcagtcagaaaaatctcttgaacactttgattctatattttttaattaaaaaaataaagctaatccaaacacactaattcacctcttctaaattgttactccaccatttatatttagcatcttcttccaagttgttgagataatgaacatgactagaatgaaaatcaactcgaaatatactggactctggaggaggtgaagttgagagcaatttcttcaaagtgcttgaggaatctgcaaatagtgagaatatcaacaatacagttcaggtgtatgtacatatcacaaatgagttttataaagagaaaaaaatggtagcaattaatagaagtttaaaaaattaagggcttgtccagtttgagaaaaatttatgtttccataaataattacaaaatgccaccttggtaattatttatgaaaataggaaatgaaaaccaaaacattttcttaatccaaacaggtaatcgtgccattttttctatggaaaaaataccattaacttcttcacctcccactcatcttccctcctttcaatacaaattgttttcttgggagactatccaatgttacttttgaaaacaacattttcttaggtaatatgcatcagatgactatttttcatctgtcaattactaggtcagtgaatagttaaacagaaattagtgcaatagtaaaaatatgacaaaatgaaaattagatggcattcaccttcaattttgagaactgatcagtcaacaagagatcctgacggatcaagtcaatcaacctaataaagaataacaggaaaatagtatcagaaattcaaaaatttcagcactgccaaaccaggatcaaaccactgctaaatatttacattcttagaacctaaaaactattctcccaaacataataacaattagttgacaaagcatttacaattatatataggaaatgactttaatccaacataaaaaaaggaattccatacgataagtaagatactttgaataggctcaactcaaataaacacaaaaccaaaccataggtatataaatagacctgggtttggctcttccaatcttgtgctaagtgctaactaacatcaaaagaaccataaatatgagacagcaaagtcttaatgtgctggaggggattgaaaaatactaactctagctataatagaggcacaaacatgaatacgacaagataatgtataaattatcagtaggaaaaaaagttattacagatagaggtcaacatcttcgacattgactaaagcaccattgagagccattaaagacttgccaggtgggaccatccgctggtttgccattatttcatctcgaacagaatcatcaagctgtcatgagaagcagttccgtaagaataatagacatttttttccaaggaaaatgtctaaaaatatgtgagtgcctaacataaataacaattaacaagattatgtaccttcatgcgagacaaggaagaaactatgctagggaagttttgattgatttcctgcattgactgcagaggatcagaagcacggacaattctctgtacagtttgatgtcctagatctgttaccatcagaaagaaggggaaaaaacatagaacactgttcattgaagccaactgcgataggattcagcttccaatctttccaattatcagaggaaaagagaaaaatattttaaataccctttaattcccaaacatcaagtgtgtctgatacagttgatgacaatagataatcccgaaaagccatgacctcagatgttaagtcaggtttacgttcctgtgagtaaacaaaaacaggtaaatttattggtaacactagtgtctggataattttgaggtggggcaataaatatacttcactataaatattaatatacttttataatgttatgaaattaaccaaagcaaataatgagttgacaaccatatggaagcagaaaaaaaaaattaatcccacaaaagagactaggaaataaatttctgattcaaaactatgcactcttttctgttcataacaccacaagtatgcaaaaagtgggcaatgccaaaggatcttagcttccttcatcctgccaaaacctttcatattaatcgattaaaaggcattaaataatatcctacagtaaatatatcaagctgcaaggcagtgagaaggaaatggacacaactttacattatatctcgcaaagcacataatattatcacatttaacactcttttataaaaaaaaaaaaaagaaatgctagcaacacaatctctaacacacatcttctattattggttgaaatttattgaaaattacaaaattctcattatcatgtgtgtgtccaaaaacaaatgtgagtttacacaccagaagtttagagaatatgaatcctctgacttcctggctaagatcttcagttcgaggatcctctaaagtcacacctgcaatcctcactgtgttaatgagagaatcaatcatttaatcacaagtaatctttcttgatgtatataaatatccaaccattttaattggattagcaatatacaaaacaccaaaagaatttgtgaatccagaaataatttaacactaagaaatgtacttttcaattatctatttcaaagttataattaataaaatcttcaaacctgaaactcattgtaggaaaacaagatggagagtctttaacgaacgataaacttataaatcaatgcattgaggtaaggttggagaaggtcaatgctaactaactcaagtaaccagatggaaagaccataaagggtaaggaaaacttctttaaatagcagaattagaccttgagaatagtacatattaccatgcaaaatgaatgaaaggacattgttggaaactgcaacaaatctattgggaatagctgaatttaaagcttagattcatgaaattttagattcatgcaaggtgctttaattcaagtacttaggtagttgcacttgtgcttattcttcttgtaaatgtaatatgcaattaattaattcaaaagtgtgtgtattaactctgctagtgctaatcactcaagcatgtcacaggtttcttagtccaaatctaaaattgacatcgtaaaaaaaaaaaaatgcaagttcaaagaaaacttacataaagagtattgttaggatccaattgccccataccttgcaattggttcctaacaaggataataaattgtcaaatcctaggaatagcaatgcaagcatggaggtcatgaagtcaaagaaaattaaagaaagaatacttttataatttctcgaaaaatatgacattttaaaaattacaaaaattacaaagagtaaaaaattggaaaggatgatcaggcaatcacaatttcatgtactaactttcttctacaattgactcagtatgcaaagttaaagagaactagaagccttcactcaacatgtgtcaatcattctaacctttttttactgtactgtcatccatggccttatattccatattcttcagtgcaagttccacaccataaccacccaagttcactgattcaccagcaccaacagaactacaatgattgatatttgattcacatccagcaggcaacactggccgtacaacatacttaactttcccctaaaattattcagtcaacatattaatatagttgcatgggaaatatattagataagcattacatttttttttcaaattccaatcttaatatatgggacaacaatataaatctgtttaatgatttcatcgtttcacaactccttgactattaccatatcttcaaaaaacattagtgttgcatacaactaacatattaatctaaacttcacttgaagagatatataatatctgggatattttataacacagaagatggacatctcataattcaggtgcaattcaaataatttacattactcttatcagttttaaaccttttgtttcacattcttctctccattgaaatctcctggggttttatcaaaaaatgattatgtttacatcatttgatacttgaaagcaaatccattttggaggcttgtacagcagaatgctaaatgattataatagctgccaaaaactacatcacattatattttctaaagagttaggcaaacgctctgttaagtaaacaaaagtaaaaaagtttttataagaaatgagagcttttattatattgggtaatacaaaaatcattttacatgtgctttttaagtaaatagaagcatttagaaatgcctaaagggcattggttagcaagatcctaaattcctatagttaataccaaaacaagaaataaaagttaaggaatgtacctctttggcagctttaactaaagcaacatgaaactccttaaaacaattggttccaagtgcaccgtaaaggatagcaactggacttccaacacttaactcataatagacgtggtcaaaatcaaatatttcaggtgtctgaaatgaatcacctaccctgaaggcaaaagtttacaattgacaacaacattggaaaatttaaaaaaaataaataaaaaaaaaaaaaaaaaaaacaaacagaagtgcactaatggcaacaaagtactcacagctcagcagagccctgaagccactccagtaattcataaacatccaaaaacaagtgttcaccggtatccacccaacaacattttcctccatggcttttcaggtttacaccatgcaggggatctaattttctcctttcaatcttttctgttagcaacttttcctcagtctcatcatctgaataattttcatcacctaggggaaaagatgcaagagattcttccgctaattgctggtagagcatcagtctaggggatgctgatctcagcataagagagaactcaaataatgattttaatggttcccttagaagagggcgcccacattccaaaattttcttcagacaatctttagctgtttgagatctaacagcatcgttatcagtattaagccaaatctcaacgaagtcccagaaaaggtcctttttttcgttagataataattcactgtttccaaacaataaatggatgttataacatggaaattttacaattggccaaaaattgtagacagatttaaaaaaagaaaaatagtgtatgataatgtaaaagacaatatgtgctgcagtcgaatgctgcatatgaagtaacaaggcatttaactcggttgaaaacagtaatatatgttgtacataagaataagagggaacgacacaacaaaagtatttcacactcatcctcataagtcataactaaccacatgatgtaaagataaatcaaattccatgattttcagttcagccgaatatttccatatcatccatctatatgaatcataagacgagcaccatgtgccaaacttaataatctgatgatctttttgtcatctaaacaatctcttccgaccacaaaagacttcagaaagaaaaacaatcaggaaaagtatcacataatgcttcaaaattccaccacctgacccccacacactactaaatttgagttggaaattctagttttagacactacagtccattatgtcatgtctaactcaaacaaatgacaatgatatcccatttcacactcctttacacgcattcgtatacttcaacacaatttcaacaaaacattagaaacaagtctaaaaataacaccaccccacattacaaaaacacataaaaatgtttgaaaaaggaagagcaaggacatacgcagcttccaaaagcaggggagttccagaccacttagcacggagtgcagtttgaacattcttgggtctctgaggagtgtcagcaatggctgaaccaatattcacaacaccaacacaatgagaacccaacatcgagatctccaaaggcaccccatttgaatttgtggagcgagaatgaatgtgggttcagaattgatgccccatttgcacgtgcgacagctgaggaagtgagaggagcttcgaaagtttcgatctttgttctcacttcgaggactcgcaggttttttgggaagagacgaccaaaggcgacgactgcactaagtacgttagtgcagcgatcccatgttacatcttggttacttttttagataataattacatttcggttactaaaaataaaaaggattttctttataaaaaaaaaatacttttttgcgcctttgataaattaataacaatattagaagttattcagaaaaatgtagtattatattgtttatactttatatattataatatgtcagtttcttaactatttaaatttttccataaaaactatttagagtttttaaataagttcatatatttcagaaaaaaaaatgaattttaacttataaatattttttaattgaatttttttactccagccagcgatgaaaagttcttaatgttaagttgagtgctgaactcttcaatggattggccacaataatacatgttgcttctcctaatttcgcaagtgatcatttcaaaaattattttttatttaaagttgtataactaaatggataaactcacactagctgttaatttggaatcaatttgattccttagaagatatcataaaggaatttaggaatgtaataatattatttggttgatcattttttgagtcagatcatctattggtaagttattacctcacaaattagctaatcaaacacgagctctttttcaagtgaatttcttttttactcctcaatattaatagtcttttcagttgttgttcctcattggattctattaagtataagaaattgattaaaattatagtttaattttgatatattttttttaaagatttttatattatcaactaaaaaaatattattaaatgtgatttttttagtaattatacaaaagtaaattttattatatgtaatagatgacaatataaaaattttaaattgtcaatgtattttaattatttcttaattttttttaaataattcaagaaacctatgaatcatgtcccttgaatctttattctccatactattacatgcttaactcatgaggctgaactttgatatcaactgcaaaacaagagagggaaaaaaaacataagaaaataagaaagaatttaaattatgtttttgagatctcttaaaccttttgaaattgatcaaaagctttttgaaaaactttagcaaccaatgtaagaatgaaagggttttgtgaactaggagatgattcaaatgcaacaaaacattttataaaagcttttttttcatgaaaaatgtttatttcatataataactccttcttcatttgtaaaaaaagacaataaagataagaataggagaaattaaaataaatgattcatggaaaaatcttgaactacatttaattcttgattacttagtagttcatttacgaaaatactaattgataaaaatcttaatttcttacaagatttaaatatgtttttggttttaataagttagcattttttatttattttaatcttttctcccaaagttgtcagaattattcataaaataaatctcaattcactgaatatagctttttataatcaccttaagaccaaacaacttttgtttttccttttagcttctcccaccacctcaatagccacaaacactatgtaaaaaatctcttgcccaagaagcacttttgcctttgatcaataacatcattaagtactttcttcaagtgtaacacttttgtcagatcttgtacatacatcctactaggagataggtctaaactccccaagccctgtgggtcgtcaaccttgggattagagctatggatgaatttgagcctcttgaaaaaataccaaatctatgaaattcttccataaacctcatgatgtcctccttcaagatatgcaaaaagctttaatgaatttaatgtagattcattaactcggcttttagcacttccacattgccatattgcctcctttacctccttctccccaacctctcaaccaaaccaacactatcaatttgtgtgatttggttattttatgtctttcaatatttacaaaactaaatgccaattaaatcttgaattactatattagtattttagtgttaaaagtttaaatgggagctagtgttaaagttgtaaattatcaaaatatcacgtttacgtttctaacaattaatatgttgttaattagaattcattatggatatgattcatgaattaagaaggtaactgaaatatcttattcttactaggtgatattcttttactagtaagaataagatagtgtcaatttcttaaacaaattaatttaaaatttgaatgttatcttatgttatttttttttttcatgtttttttattacattatgataatgatatatatatatatatataatatatatatatatactatcaaataaatttaatttaattattttataaaatgattatgatgtacagtctatatttatgtaaatttagataaaaaaatgatttttttataattttaacatgattcataagaaaaatatttaattttgtaattttttttatccactaatgatcattattatcaaaataaatatcacgtttagtttagccttctttattagttctctgatacgaccgtttaacggcgcttcaatttattcattcttcttagttctttgacgtgaccgtttcgttctttctaacgacgcttcaattattaatctataaatacattgctattgtgtctgattcttccacaatcctactttcatcaaaacaggctttgcattgatttatggttcaggatttctattcaagaaggaagagaaaaaatctaatagagggaagaagatgagagaatactgattttttcttttgacatgcatgcatggcagaaagcatgttctctgcgtcttccttcttctcttatgttttctcttctttctcgcactctttagaacaattgcttggactgatattgaaggtaaggttttatctaatatgtattcatcttttaaggcagagttcttgattgcattgataagatatattgcaggaaattattaaagaaaatgaccaaggtgacttgttctaaagtattgtttttcaagaaggaagtattgttttgtctttagagtcatttgagtcaggtagaacagtttcagtgggtgcaacatcgaaagcaaaggctgggaaatcaactgccattggtgtttcaaaacatggaaatagagctgtatcttctgcatgttgatttttctttggttaagtacttttagatttgttttgatttctaactatttgtttcatcatctcaaaagagagttgtggcaacagagggtgccaagtctgatcaatatctgttcaagatatagcggtccagtctcaagccttgttaagtaccaaggattcaattaaggtattgtaggctgaactggagtataccaaacgttgcttaaaatcttataaatgtggttggactgtcgtctggattttcttggaagcaggaagatcgagagagattggtggtttgaaggtttaagattgaggaaccacgtattgagtaaaatcaagatcttgaggtgggaattttgcattatcaaataatgtttgaaaaactgtgaattttactgtagctttacaagatcatgaaggagcataagaaccccaaggttcttagtgagggaattttgcggatggtttctgctgttgaagattttggtgtctcacatataaagcttaaggtgcattatctgaatttacaaattttttagatattttatttgttgttggaagtttgtatggtttattgtaaatcctattttgcaggacttaattgatttgcttaatgaaattgggctgcagtcaagtaatgctgctactagaaatgcatcaattaagttcttgggtgttctgcatagatttgttggtcaaggtcactttgcattaactttcaaattttgatttctctcaattttgttttcaaggctctaaggtttttctccttgcagacattaaagggtttcttcttactgatgtaaagcctgcactgctcagtgccccggatacagagtatgagaagaatccattttaggtatattatgtttgttgaggttagttctatgcagggttttaaatagaatgctatagcggtgtagcagagcagagtgatcccttcccgctacgggtgctgctgtagtgaatcagtttagtgtagtgtccatagtgaagcaaatagcgggttgaatagtgtctgtagtgggtgctatgtattgattccaaaaaacccctctgaatagcgacattagggcttgttcagagggctatttgtgggatttaatttcctaaaatcatatttgtagatgtaattatagtgaaatgataaagaaggctttgatttaaaaaatgattgttgatgatatatataattcctatctaggaagctcgtatttaacgtttgttggtatttacttgtatgttttgtataagacgtctagactttttgttgttaatgatgaatgtcattggtttttaataatttttattatttttgagaattgatatgtatacagtatacttatataaactataaaaatttcaaaatagtggctatccgctatatgcaatctcgctatagtgttttttgagccagccgctacgctctgctatccgagatttaaaacccgggttctatgtagtatcatgatttcctaatgcggtcatttattttattttgtttcccctgcttcagggagcatctgtagttaccaagagaattgtcagggaaaaagacccatcttcaactgcagttgctggtgcactggatagcttgcctcggaggacatcagtggaaagatctcaccaactctcctgaagagcttggaaagccctgattggaaggtttggttgataagagctagcaatttgcttttaattttgtattcaaggttgcttttagctttcagtatttgaggaagtgtattatggtgctattgcttctaatgttgcagtgcattacttattataggttgtatggaatctgttgatgctgtaaacaaaataatggaagaggctaataagcgcattcaagcaactggaaatgacactccattagcatttttttttataatttttttaaccttatgctctctctctctttactctcccctttcatcaacttcctccccaaatggataagttgcatggtatcttttggtaattattctatatttctagctgattattttgttaattttcctaactgttttattaccaggtgacttgtttggggctcttaggggacgacttgttgataacaacaaaaacatttcatggcttccttgacagcaattggcaatgttgcatcagcaatgggtcaagctgtagagaaggcaagcaaggtaagaggattctgttctgttttcgtatccccccccacccccccctccccatttggtgctgttttgctgtttgaacatttctggaaatggtttgttgcagggtattctgtctgatatattgaaatgtcttggtgacaacaagaagcgcatgagagaatgtgtgctgaatacattagacgcttggctggctgctgtccatctggttgaaatggtctgtattctgtgctggtcctgtgttctttcattcttttgtcttggtatctgtgtccttagcatggttttcctataggttccatatattgcaattgctttgatggactctaaacttggtgcagaaggacgtaaattttttttattggttatcgaggcaactttctgtgttaagtagttttgctgaagctgcacaactgctgaagcctgcctcttctgcaatgatagtatgatctggttactctgcattctgctttttcattttttataccatttatcgaattagttctaatgttccatattcttggaacaaaatgtatgatgacttcttcttaggataaatcttccgatgttggcaaggcatcagagcttgtattaatgagatactaagagctagtagacatgaaatggtatgtgtataagaagaatgctgctttcttcccttgtttccttaatattcttgtaatatcaagcatcttcattgtttacttatttttagattgaaaagatggttaaagacattcatggaccagcaccgacactaattgttgagaagttaaaaccataaggagcttttcaaggcatgttctttggttcattcttctttgcgaatgttggtgaatttgtgcttatatatcttcccttactcctcctttttatggtctttagagtcatttgagtcgggtagagcagtttcagtgggtgcaacatcaaaagccaaaggctggtaaatcaactgccaatggtgttttaaaccatggaaatagagctatatcttctgtatgttgacttttatttggttaagtactttcgatttgttttgatttctaactatttgtttcatcatctcaaaagagagttgtggcaacagagagtgccaagtctgaatcaatatattttcaagatcagtctcaagccttgttaaatatcaaggattcaaataaggtattgttggctgaactggagtataccaaacgttgtttaaaatcttataaatatgtggttggactgtcatctggattttcttgcaagcaggaagatcgagagagaatggtggtttgaaggtttaagtattgagcaaattcaagatcttgaggtgggactgtttgttgaggaataatcatgcataacttgaactatctataagtattgaattataataaatgtgcctgcaattttcagaatgataaagtatttcagagaggaattacataggagactcttaagtgcagattttaagaagcaagttgatggacttgaaattctgcagaaggtgttgttcttttaaccttctgaattacattcttttgaagtgttgagtgcactagaaattgtacaaactgctattgcatatttcaggcacttccatccattgctgaggaagttatagaagttttggacagtcttctgaggtggtttgtgttgcagttcttcaaatcaaacacaatatgtctattgaaagttcaatttatttttgtttttgttgtgatttcagttttcttcttttcctttccttccttttcaaggagatgtctgctgttagtcttaactttattcaatttaatttataggagtatacttacttgatagagtcttatcttttcttaattgcttaggtgctggaatttcttcctgaactgcttgacactttgaaggacgaggggttctcttgaccgaatctgaaggggcagtgtttcttctgtgcctagtagagaaggtttatattagcaactttaatatttgtggcacctgaggatgttgttattccagtgaatctttctgatggtatggttgatttcagcaaatttttggtttacatagataatactagtttgactagtgtacttccttgggtgttacagatgaggaagtcacaattcatttcttattttaatgttgcagttagggcataacattgagaaagtacgagaaaaaatgcgggagctgacaaaacaatttgttgccatatattctgcgtctaaatgtttcccttatatattagagggttttcgctcagagaataaccgaactcgaattgaatgtgccaatcttgttggatttattattgatcatcatggtgcagaggtattgttactagtgctttttaatgaattcttttcctattcagtattttccttgcatagttactccttgcattatgtggacagattagtgggcagctaaagtcgttgcaaattgttgcaagtttgactgcagaacgggatggtgaaactaggaatgctgcattaaatacactagctactggttttaagattctaggtatgccatacactgtagaactccatctttctggtttccaatgtgcttgaaaaatacttgtgcctagtgatatatatatatatatatatatatatatatatatctttgaaaaggaaacttgttaaaccaaaagtacatctgtgttattttgttgaattgggttgtgtttttgcatcagtgtgtaaatttcaagagttcaatgtcctttctatggatgaccacttgaggaacttatggtagagcagtttcagtgggtgcaacatcaaaagcaaaggctgggaaatcaactgccaacggtttttcaaaacatggaaatagagctgtatcttctgtatgttgacttttgtttggttaagtacttttcgaattgttttgatttctaactatttgtttcatcatctcaaaagagagttgtggcaacagatggtgccaagtctgaatcaatatctttcaagatatagcgctccagtctgaagccttgttaaatatcaagttttttccaaatctttataaaataataaaaagttaatcaatttattcatactctgacattttaaaactatatattacattaattatgatatatatatatatatatatacacacacatatatatgaatgaaggcatccaataattttaaataaatataattttttgtatatataatttttaaaatttaaattcagtaattttcagatgaaattattcaaaaaatattgtaaaagatgtttcccgcgtgtagttttcaaccaagacgctgcacgtgaaagatcccttagatttgtcaaacatgagatgaagaacccatggattggatatacaacaacccccttcgttctttacttttcttttgtattttttaggtagaaagtctgcatttcactgctatcgtgcttaatatatatatttactaatttattaacaatataaaaggttgttcataaccataaaaagagaaaagaaaaagaaaaaaggttgttcataattaacaagtcgcatttcactgctaatgttcttgatgtgtctttgaatggaattgaatcatcgaaccgaaaagttaatcttcctttttcaatatataaaacattagttaagaatcaagttttttttttaatgtctctctcggcgtcttctcaattaaattctacaaactcgttaagaaatttaaaaataaagaacctttactgagatataaatttgtcacaaagaaattttttatagaataataaatatttaattgaagaaatatagaagagaacaacgacaaaaaaataaattaatttcattctataaaactattgtcatgatagcaaagttaatttagttaacaaataattgtgtatctcttgtttataacaactgacttgggtccacgtgacttctaaaattgtattcaggcaagcaagcaagctttggtcatcctaagactaatcgtgatattcttaattaattcaaggtttttgtttcaaagctatactaagaataacgtagcaaaattttgtattctacttctacaagataacattccaatttctaaagaatgaagagaagcaggttggagaaaaggaacaaatgacgcgtcaaagggctgctgctgtagtcttaattggccaaattggcgaaacgaaacaccgttggtttagaagacataatcacaaatttcataaaaaaaaaaaagaagaagacatggtcacaaattgggaaagttattgagactcctatgttgaatggactcaggctgcttcattctaattcttctgttaggactgtagaaaggtcattcgagagtaccctggaaaaggaggcagcctccaagaagacaagaacagaagcaaaagattattttttccaagattggtgctattgacaacagatgtactaattcgccgcaaacatgataaagataacaaaaacaccttcactaacagtttaactaatttactagtattatgcatctgcttcttcaacaacaccaataagcgccaccacacaggaagctcaactagcagatggtggacgctgctgtgaaagaaaaggtgcttccaccactgttcccttgatgttgtcaccgacaattacagtgtctccttccgaagcagctcgcctcttgatgtaacctaatccaaagtgttcagattccttccttccagatgtgtagctggttaactttccaacctgcaaaacttgcaaaaaccatcaatttctttccaactcgttaaggagaatgttaggattacagaaagcaacccaacatcacaagcactgggctactgactcagggaaccactattagttatccattttttttacaagatggttctccagagaaacattgtaactggagttttcaccacgtacctgtcatctttagtttcaactgggaattacgctatgcaaatttccatcttcctttttaacaaatacataaggattgaagaaaaaaatagtgaacatttttcaaaagaaattatatagcacctttttcccatcaactgtaataatgctgccaggttctgcagcagcagaaagatgaaatccccataacctctgcttgattccatcatatgttatgagcctagatatagtctcctgacctttgtaacaacctgaaaaattcatagtcagactaattattcagcaagtttcaacttttacgcagatgggtagcggcaaaagaacagttgcacacccttatttagagaaaccgagttccaaagacaggcctccaggacattgaattcatttgtaagctccattccaggagtgggccttcctaagaaatcaagttatgatcaaattagataaaagaatcatagggagtgaaactatatacacaaaaaaaaaaaaaaaaattactcgcatttcaaaaaacttccagtttcattatccaatagaatataccattcaacccaaagcaaatattaaatgcttacaaatcttctagtagttataaaaaccagtcattcattttttggttttacacaaatatcctccataggaagaaatttgcttgacatatgatcaaacacaaaatgagaacctctcccaatagggactgaaactgtagttcaccacgttatggggactatcttccattacttccaaccctcattggtaatactagctattcttaactagaaggaaattgtgcactccacaattgacatctaaatgcatttgtattctttcttgcaccaaaagtccgcatgggcttgaagcattttttacatacaccggaagaattaggttgaaaataacatgatgagaattcaagtaatgtcataattcctaattccagtgtgcaagtgtgcaactgtgcaacctcaattttcattagtggaaaattggatcttggggaaaaagaacaaagatttatttatgccagtatcattagtctccaagactactcctaaataattcctaaattacgacagaaacaatatgcaggaaataagttagtatgctatattattcaactgtagaaaccaatgacagacatagaaatatgcacacaatctaaacaattcagtacctcgaataatccgtaatttattccatgcattagaacccattgggattgctccttgagtaagaatagctttccaaatggatgcagcagccgctggagacatcaataatgaaaaaccatcttcagaaatgatgtttccaacccctatagttacaggctgcttatcaacctacaaattacaatacaaatatatttgagagaatttgttcacaataataacaaaagactatacaggtctttaagctttcaacaaaagggctaaacaattggaaaaaacaattactaggttttggtattgcagttgaaagtttactactttggaagtaacacatatacacatgagaaatgctaacaatacaatctctagcacactcttttgaatacactctctactcttggctaaaatttaatgaaaatcacaaagattgtgtaggttcactacttcactccttatttaatgaagttcattcatgatgttttagttttccataaattttaaccaataagagagatgttgttagcactccttttcaacacattctaaattttgaagttatgtaaaagatgcaaccacaatccatgggaacttgttgccaaaacaaaatttgcaattacaaaatatatgctcgttaaacaaccaaaatatgcatttctgacagtaagaaagttatcagtgagaaacaaatacatgaagcttaaaactagcaaataagacacgattgatcatgtaagttgtttttggacaaactaaataaataaaggcataaacccatgcagtcatcatcaaacacacaagaccatttgtatcttgtagagagaaaccggtgatgaaaaagacaactggtaattagtacacatacttcaaaaaagccagtttcatccagcttacattaaaatgtagatgtgtgccatatggttttccgacaagatcaccaaggttcaagttctccatcacctgcccattcattatactgaaaattaccaactctgtcattctcaacacaaaataggtataattatgtaacttacttggccacttttgggtcccaccaaaacaaaaaaactggtttgcttagttatgtcttgaatctctaccttatcagcaaaaaatatgtaccttaaaatcattacatgtaaaagatttagttcatgtatttgataatattcatcaggaaaggcaactatttggtttctctctttttccttttagttttacttctgttggtaaatccttacatcacaactaacaagaaattacctacttgttcagcatttcagtaatggatgtacaggtctctggtgaaaccactaatgttatcgcatttttctatcaaaaaccaacaagagaaagtggtcagctacatgataattaattatattgtagaaaagacaaacaaatgaattttgtgagaaggataagaaaagaaaatcaccatgagccatgcatgtgcgatatctattgttcgagctgttggtgttacaaaaacagtgtcacatccctaaggatttcagttagagatccaattacttaatcctgtattataatatgaaatataaaaaagaaattgacaagaacttgccaataacacataaatgtagaaacaatgctactttctttcaatacatacttgtccttcatgtagagattcgaagtttgcagtactctggttgtgaaggaactgaatgcgatcttctccactgactttgtttcaggtgagccaaaacatttgcatgtaaaattaagaaaacattgaaatatgtcaaggaccaactcttaatagcctaagaaaagcaagtacctcttatccgaccgaagtgtgaaagatccacaacctatgccatcagatgtcataaagaattaatttaagcaaacaaataaatcctacattatctaacaatatattaatatacatttataaattggtaagcatgcaattataagacttcaaatttgtattagcttttacaaaaacttgatagcaagctatcacataatattttgtagaaactctagaattacaattcaataatctacaaccttgagctaatccaagcccacaaaatacatgtaggttagttcacatttactgtattacttctatttttttaaaattacagactgaataaaagaagttccagagtaagtaatagaagttacaggctgaaaaattaaagtctgtaatttttatgagtttgtaacttttataactcaaaccaggaaattttataagttcgtaacttctattactcaatgtgtaacatttgacataaagtcttcaatttcaaaaaataataccaagcctgtatcttttactatttaattgtagcatatgatataaagtctactgcaatttcaaaaaacaaatagtacagtactcctttttttagagggagcaccaaagtgaaccaccaaagtaaaagagaattaagaaccaacgaaataagcagtgaagatttaccatattttgtttggccaatatgacaaagcatctctagaaccataaataaatcaattcaaagaagcaaacaattaaaacttgcattgattcttgtggtttatattgtttctaccaaatgaagttgttcaagcagagataatgaggaagcacattaagctacaggcgttaaaaaaaaataaaaaaaaaaaaaacactaaataaattacataccacaaccccgttgtccacagcagccagtgctacatcatcattatgaaatgtctcaatgatcccttcaccagaaatctctgcgcctgcagttttgatagtatcctgcaatgagtaaaattaataatttgacagtaaaaaaattgcacttagccacctgatttctcttctctcaagccatatcataagggtattccaaaaaacaagagttattatatatttttagtccttatatgttacactcattttaatttggttcttatatgacaaactttcaattcagtccctacacatatcctttaaatttagtaatcactgtctgttgttgatatgatattgtctgtcggaggtataactcaatgtagtgtagaaccaaataaaaaatgtagggatcagaaatactctatttttttgtagtgacaatcattttcaactcaattgctaggtaaacttattcgtaaatccataccagtctcagtatgaagtggcaacaaacagcaagaacaacattgaaatatattatacaaatagagactaaattgaaagccttttacaattaggaagccttttaaaagcaaaattatctgttttttcttaaaaaaaattgtaaaatcgagttctctactgccataagttatcaatcacaaataacagcgcatagtggctatttctaaaaatgctatagcagcatggtcactattctgaatttttttacagtttatataatgtatatccatataaattctcaaaactgataaaaaaaattactcaaaattcatgacattcataattaacaataaaaattcataggtgtcttacacaaaacatacaagaaaataccaacaaaagtcatggtaattggtaaccactatccactaaggtttaagcctctaaggttagaaataactaaattgtctaaacgtattcaaaataaaagttttctagatatgaatcatcaatcatcatcttctaaatccaagtcaccgtctttatcattttcactactgttacagctgtagatttcttcctcttactcctcttgaacataatcaatttctaattcttctgctgaaggtgcagcacctctcctcagttttatttgatgcctagtgcatgttgaagtctcacccacaccagctaaattggcaacatctcccccaatcaagttgttgtcacagtcaaaatccaaatcatcttcagcatcctcgccatctcctcatttctcccactaaccattcatcactaccatcaatatcatcaaggacaatgggatgacatcacgagtgtcaaagtgttgcttaagagcttggttatatttaatataaaccaagtcttgaatcttttgatgctcaagcctacttctcttcttcaagtaaatctatattataattaaaacaagttagtttcacaatcattgtatgaaaactctatatatttaaaacttctaatattgacgtatgtgctcaaaagtactccaattacgctcaaatccccatgaactacaagttaagctcagtactttaatggcaagcttttgaagatttggagtatgcaatccctcctccaccagtcagctgtaatgcagtgcaacaccttatttattagggcaactaacttaaataaattgtagtgaaattaaatttcaaaaaaaagaaatgcagttttgcacttaccaggagctactgtagtcctttgccttattgccactttatacgtagacaactcgcttaaaaccttatctacaggtttgttattttcactaagcctctcaatgcacctataaagtccttccatcacttcaggatcaagatcaagtcttggatttttgtagaagaactcgggttttagaaaatgacctgctgcatgcaatggatgattgagttgacatttccatcttctaatgattgcaaatatttctttgtacttttcttcattccctttgaaagaactttgaattgtctccttggctctatcaattgctttataaatgtaacccattgcaggctttttctcattattaactagcctaagcacatgcacaataggccgcatagccttaaggatgtaaacagcatcattccaaaatgaaggcataagaacaatgccagctgccctattcacctcacgatctttagcaatattagttttcatccattcatccgaagtgaacattcttctaagattatttttctgattatgcagcctttgcaaagtaagaaatgaagtaacaaaccttttcactccatgtctaaccaattccatcttgtttgtgaactttctcatcatgttcaaagccaatgtgtggttatagataaaactaacaagatagatgcctcttcgtatagcctttttaacttcagccatcttcccaatgtcctctagcatcaagtctatgcaatgggaagcacatggagtccaaaacaaatgctccctcttgatttctaaaattttccccaagactgaaatcaataaacttaatatgagtaacaaactaacaattaacaattaaaattgtgaaattaattaataataattcttacaagctaatacaaaattacttccattgttcgtgatcacttgcaccacattttttctccaatatcctcatcaaaactttccaagagctcaaatagtctcacctgagtcacctcagtcttcatgcacctagaagcatcaacgctcctcacaaacattgatcccccttggaaaatccaccaaaaaattcatcaaggttctattcattctatccgtcaatgcatctaacataacggaacatccatacactgctcgttcttcttcatgactcttaagaaatcgctttgtgtattccaactcctttttaaggagtggacctctaaacacatggcagcaccattggttacaaaggaatcccgtttgtaaccaagaatcgtactatatattgctctagctttcctgtcagaagcaccactggttacaaactttggcatttcgggtcttctttgaagcagataaagagacctcacctgctgttagaggccttttccctctttggagattcgaaatttcctgcatatcttccatctcatgttgcaactcattcccagcaggtaaagagacctcacctgttgttagatttcttttacctcttcggagattcgaaatttaccgcatttcatccaagtcaagtcacggtacagaaactcattgccagcaggtaaaaagacctcacttgatgttagataccttttccctcttcggaaattccaaattttccgcattcttccatgtcacgttcatgcatctcattcccagcatgtaaaaagaactcacttgatgtttgaggtcctttccctcttcgaaggttccgaattgcccgcatttcttccatgtcacattcatgcaaccaattcacgttgcatgtaacatcttccccttgttgaggggaagacgctgatgcaggcccttcctgttgcgaggacgctgccatgacttagaagaaagaggcacgagtcgccggacaaagaaaaactcgccggaacggagagaagagaggcaaagctaggtcgaggctgaaaaacctttttcaccgggttttatcagcaacggtgaaagccctaaaatagccgcaagaaaaccctaacgtgagggatttttcggaatgttacgggtgcagcgcgatagcggcgttacacaccgcgattccggcgacgctgaatcgcgccgggaacgacgctgtagcgacgctattgagaagagtgtagaacaagaaataagaaagggaagtttacaagtgctggaaaattaccaggaagtcatggtcgatgggaggaggagaaaggtcgaaaggtgaggactgggcacaaattgaccaagacattagcttcttcttcttctccttcacgagatggtggtgggaccaaaacgcaacgtttcggggcaacacagagagacgccatgttaatgcttggtttggaggatggttccaccaagttgcagctgctgccaccggcaccaccgttgttgtcattttggattagataatggacaacagaacagagtctctctgtctctctctctctctctctcccccacaaacactactctgttcgggatttttattcttggaacccgtgcacggttttttttagtaaaaaaaaaaaaacgagcgagagatacaaaacaataatataaaatgtttaaatctatagagtaataaaactacattttcctaacctacttcttgcttctccttacttcgcaggttcggttccttacctgcttcttgcttctccttgcttcgcaggttcggttctgcttctctttgtttcggtctcacttttcccagcttcggtccactaccatacctcagcttcgttattttttcttctacaccagcattccaaacctttttttttatttcaaaactgcctctcctctctctcctctgctctgtgctctctctccctccctctgctctgtgggtctctctccctccctctgctcgtggctctctctccctctgctccgtagctctctctccctcgctctgctcggtgccgctctctctccctctgctccgtgcctctctctccctctgctccgtcgctctctccccctttgctccgtcttctcctctcttttctactctttcattctctctcttttccttctccgttccttcctcagcttcttcctttcctttcctcacacggtgctcagctattcctttccttttcagctttttccaaaactcccgcttctcacaagtatcagtgtttctcttctacccatctcctctgtaaatagcaagattatttttctgtttcaacattttttggggtttttgttattcttttgcaatttagaaactgattgatgttgaaacctgcaggtgcatgttgttcttctgcttcactttatggagcatgttcacgtaagcaggtaataacctttggtatttaatttctaaattttagatatttcattggttctactgactcactcctatcatgcttcattggtttttgtggattattttggtaagatttatttgctctctaatattgaaaaaatgaaaaatgcttggtgttgtgtgctgaaatgaacagtcagtttttctttctcgaggaagttctgatgagcagtgacagtgggaatctcacttattagcaagaattgcatttacacaaaaagattttgataaagaatttttccgatgatttttatttttactttttttctgtttacctggaaacactttttggtcttaggttgtgttgaataaaagaaatatgttttctttttcggtttagtgatgaaacaaataaaacatgactactaaagtccatattggagtgcacaaaacaaatcatagttgcatagcttaagtccttaagtcctcacttggttgaaaagcatgttcattgttgcccagtttcatccccaattctttctactaatcaaaacaatgatactaaaggtttagacttttcattcaatgtgaattagaaaatgtaggctgttgttctgagtggagaaaaatttgtttctaattggttttatattcggtgtgaatgacttctataatactatgagaattaggtactgagttgtacctaaatcttttggtttgcttcttctataatactctttgggttccacactctcaaacctctataatattaaggttggttataatactattagaattagatactgagttataagacaaatgatcactaactttacacattgtcttaatattgttatttaaatttatatatagttgatatattataattttatatatagctgatatattattaaaaactcaagaagattttacctctttcactacatttatccagaggtatgattatacatttatacttgctttgaaggtgtgtcttggttatatgcttttgcaattgttctagcacttagccttcaaatgtatggttgctgtgtcatccagaggtatgattatacattttacccttttagctgatatgtatatgtttgaccctctgtaattttctgaatgtcttataatttttcttttgctctttcaattatgtatccctctttacaagactatttgatgctgctgtggctgtttgccaagattttctgcaggttgcattctggagagcaataaatggctttggcttggcaattgtcattccagcactccagtctttcatcgctgatagctacaagcctacaaggatgaagtgagaggagctgggctttatctacttccgcattatggcctatttattgaataaagctagattagtaattcatcttcaaacctctttacgttaaataaagtgatatctgttttaatgaaatcttgggaaattaatttttatattattttcgcttcatttaatttggattttatacaaatgaaatcccactttttttttccttgcaaatgtcttaatgttcggaaggacttacttcccagtgaccatatttaggtatgttctttgacagggattttggtggttccaaattccaattctttttaaatttcaaatcccatattgaatgcaaagctgatattttctttatccatggtcagatagatgcaaacttacttcatctagcaagagtggcaatgcttgattgcagtcaacataaaaagttggatgtttctagagctaaagctgagcttgatatggcaaagaatcatttgtataattccataaggttcggattagtttggcactccagtctttcacaactacttctgaatatcagaactcaatcaatttgtcatgtttgtttcttttttcagtggaaatcattctttcttattacaatgcagtttttatcagagttatttctctgtccatgacatgtggacaggtggaatttgatgtcatacatacaattgttcaatcttatcatgtacaacatttagattgggttggttcacttaaggaaaggataaaaaacatatttacttagttatgaaatagattgattttattattccttttttaacatgattcatattaatgaatcaaaaaacattaattatttctctctactctctgctaagattggatttgtattagtttttaaatttgttatttatttatttttaggaaaatttcacatctgtttatgttgaagttgaaggtatcataatatctcccatggttttgctgtttcggaaaagtttattttttagcttggtttgtgattttttgtttttccatttttgtttgcttatggcattgtttttccattttttaaatctaatgtttaatgggttagatttataatttgttaataaaaactgagtgtagaaatggattcattctccttcattctccattttattgttgtcaagtaagaaaaactatagcaatccattatttacttctcagcaataattatttctttttttatgcttattatttctttcaagatatagcaatccattatttcgagatatagcaatgttgcaaaattagcaaaattatacttatcaacaatataattatttacttctcttttttgctgtatttttgtgctgttagctttccttcacactgcatatttttttcaactctcacaggtgttttcttgagttgctaaagagaagcaagaattatattgtaatagagctatttttctctcttatttctcactttcaacttttttcttgagtggtctttttctcttcttcatatgttagaaaaataaagttcaaatctaatcccatgtgttttttaatttcacacaaatatgtagcaacttattgggtgaatatgcagtgtttgacaaaatgcctcacccaaatttatattgttctgtttataatctttattatatattccatttcattttgtggtatgttactttcaccacctgagaggtatgttgtaaggaaaagacaaagactttgctctaaaatggtacaattgtatattccattttgtaataatttgtattcttcatgctacatattctccttcaccttacacctaatctctccttcactccctaaaaacaacatataattaaatatatcagcttattaagttgtgggctatcattacatataactgcaggtattattttgtttctcttcctcagttttatttttccacatacatgcttggcacttcagaactatctttttagttgctgatagtttattgagttgaatgtagaccagaactggattcttatgaaaggatatttatgcattggtaaggcatttataatttattccaaaatatttcctttatattttaatcttttctttatatttttcactattttttttcatcatggaataggaatctgtaatttgcttttacattagtggttgtggttaattgtagttttcgctttgctgtgattttttgttcctttttttccatttttgaatcagcttttttttttcctattttgatagcactctgcacaccagctagataaatctttttaataccttatcatctctctaaaaatagaactgcatagaggacttagaataacatggtttaaagtaaatcatagattatcaactgcatacattatatttataataattattatgaactgcatacattatatgcttaacattatgagctccacatattggattatatttattcattaaaagaagctaaaagaagaaaaagagaaaaacttttaattagaaatatattttatttttaactgatatatagcctcattcaattctccaacctctttacttgaagctcttttgtttttattctattgtttcagctctccatcaaggttaacttaactaattaacacaatttattttgttaaattatattctaatatcttgagttattatgttaggtatgggcaacataagtctgtgagcaaaagcaaagaacttgcaacattcaggtttttctctcatttatatggatgcccaagcttctatttctgtagcatattagtttgaattctaaatagataatggctaggatgagtgtggaccctaattttggaattgggattttggtcttctgaaacaaatttaagtggttggctttagtttgtgagcactaaaggaataattgccccacatgttagaaatataatatatagaaatcattcatgtgtcttcatctaacaaagcttttgagatagttaattctgattcataagattgtatcaaaaccttcatgaccaagagctctagagttcaattcttgcttcctttattcttctaataaaataattctaattcagctcaaagtaggtgggactatgcaattatacattttccatgcttcaaggatgaaagggctccttatttttaactctttttatttaattcaattgttatgataatcagcataataatgtttagttaatatatttattagaaaataatagtttgattcttagttataagacaatcaaagttaattaagttaaattagtttatcaataatatcataataaatattttttggttataataaacataaaaattaaaattactttataaaaatgatttttgttataagaaagttttaaattacttactcaccatatcataatataaattatttttgatttcatatttttatgtagaaactataattatcatttatgagaaatgattattctttgagccatcacgagcaaatttttacacaaaaaaagtttttgttaaaaattatttaacacaattacatatcaaacaatcaacaatattaaataatatataatttgagataaagtaatttaaactcctgtatccactttctctaaaggattgtaacccaactataacaaaaatataatcacattatccaaatatatttttttttttaaaaaaagaactccaagttgtggttttgtttgttttttaaatttcatttttaaatgatagaaactacaattatcatttatcggaaataattattctctagaaaatttaattaagatttgaaatttttaaactctttatttagttcaattattacgataacaagtagagtaacaattaattaatatatttattagaaaaataatagtttgattatttattataagataatcaaaatgaattaatttaaattattttatcaataacatcataaataatttttttgttataatacatataaatattaaaattaattttaaaaaatatagcggagcggagcagagcagagctacccgtgcatatgcgcatacaataatttagcaatttatcttttacttttaatttttaagtttgcttatacaataatttttaatcattaaacattaaatattaaaacattgctaaatttatcttttacttttaatttttaagtttactttatcaataatatcataaattatttttataattataacacatataaatattaaaatttattttaaaaaatataacggcgcagagctacccttgcgatacatcagtgcttattgattccattcctcaaacaatgcaatgaaacactctctatttcttagtggagtccttacttttttattagctgatatatttagcaatttatgttttatgttttatattttatttttaagtttgcttatacaatataattcttaatcattaaacattaaaaatattttatacaaatctaacatagcacggcggagcgaagcggagccgtcccgtgcgtatgcgcacgggtcctaagactagttttatataatatgtagataaggtgtcgggaatgcagtaatacattttattaccattttttgtgattttttttaaaattattatgagaaaatacatccgattacaaactaataatacattataatacttgtttaatgtcttttttattattatgaaaaaaatcaattacggactaatatgtgaatatataattattaaactcatttattattaacatgttggctaaaaagaaagattaagatgtcatgctaatgcttgattttaaggagggttcaaccaggttgctagtaccatttttgtcattttggattagataattaataataggctatctcaaacatgcacgttattctgctctgcacggtggacaatccaattttaatataaaataataataaatacaaaacaaaaaaaaaggtaagtgcatgaggtagagaaatttgaccaaatgaattgcacaaaaaggacgcaaaaaaagttgtttgaacattttgatttttttaggaaataattgaacatttgataattaataaaatatattaaattaaattaaatagaatcaagcgcaataaataaaaatcaaatagaatgatacattacgcatagcaaatttcattcaattagaggcataatcacatatagagcaaaccatcacaggaaacaacacattgattcaactattgggctaatagaagaaacagggtgaacagaataggcactacacaattctgcagcaagatgttgatgtgattgaggcataaccactgcaaaaattctccagattttttatgctaacatgtagtcaactaaactatgcactctagttgggtcaaataaataaataaacactctagtataatttgatttttggtagtagtctatacatgattaaaccggatcagacatgccaaatccacctccttcagtggccccgagtcttctttgctcagattcaatcacgcgtgcaatcgggttcgcatagttgtgaaactgcgacaattcacacccaaaaattcaactatttctctattataacaataagcaaaacacgcatcatcatgcaatatttacaaccaacattataacgctaagagcaaggattgaagcaagtccatcaaaaaaattaaaacaataaacttaaaagtagagttcaagcgaaagttgtattggctaactttagaaacttttaaattttaatttttctttcatggaggaagtatgggtgcaatttaaagatttttaaaccaagcatgttgattagatcacgcaggtttcaagaataggataaatggccatttaccgcttcaactagctcttcacatttgcgcactaacagtgccactttaacagctccagcttcttttactgttataattttactacttatggcatcgacctgtcatttttgaagataagaaataacaatttattctttcaccaaatataattgatatatcatgaaacttaaggaatgccacctcagataaaacagcctcgacatttctctgccttgtttctgtaacagatctcttagattcaacatctgattttgtactacttaagtatttagttgcttcttcccgcataatattgcactctttctccaattgcttccatgattcttccatctgctcaactaaggagaaacaagtcgaaaaagttggaggtaaaacatgctagtaacaaatattcatgcttaaagagcagttatatgtggcatgaaagtttccaacaaaaatcattaaaaaaataatgtggcgtacaaatgtgctggttttcaatcaccaaatgctgttaaaaaggaaaacaaaattattggacaaaaatcatgcaggttacttgtgaacaggttttacagaatgtgtttcgtaaaaattatcattactcattcttaaaccatgtagccagaaatggagacacagcaaggcttgcacaagaacatacctttgctctgtttttcaaccaatttggcctcaagtgacttctccaatatttcttcatcactaagtttagccttcaatgctttaagatccttttcaatagatttagcagaatttacctatagaaggcacaactgacatcaaacaaggtttgcacggtaataatctttgaagtaatgtgaagaagtgcttcttgcacatgagtctcaattgagaaatttcacaagaaaaatgttgtttccattgatgttgcaacaacatcctctgctcctctgatttctaatttggacactgctcaagttaatttgaacactgcttaagctaattttgtgcaacagaataagaattctatttctaatcagagtcagtccacaaactactcaaacttaaacatatctgaaagtaaatctgagagaactaaattgaggtgaaagagtattgtattcaacccaaagagaaactgagtccaatacagtttatataacagttacagatatgtaactgtcaactaacttgagtgtcagtcaatttgccaaagataactctgtatattttgaatttcatcctaatgtttgcttggtgaaatctcaggtctccaattctcaaaggaaatctaggttctgatgaactgtacaaatttcccagtttgctgtcaagttcttcatctactgtcaagacaggctctcctaggcctacttctatttttcctaattctgttgtaaattctgtctctgtaaaatccattaattcaagcgcttggcactctaggttaggccattctagtgttgatgttcagaaaattgcaatccaactttgtaagattccatttatcaataaaactgagcttgactttttgttgttcatgctctctaggtaaagctcacagattacactctccctcttctctcacaacttataatcaacctcttgaactaattttcagtgacctttgggaaccagctccctttgtttcctatacagggtatagctattatgctacttttgttgatgcctatactaggtatacctggatttttctgcttaaaacaaagtctgaaacactatatgttttcaaaaagtttcaagctatggctgaaaggcaatcaagtctacctattaaagctgtccaaacagactggggggagagttcagaccttttactgcctttttacagcaattaggtgtaactcatagggttatttgccctcatactcatcatcaaaatggtgtggtagagagaaaacatagacacatagttgagcttggtctcactcttttagctcaagctcttcttcctcttacctactgggatcatgcattcttaaccagtgtttatcttatcaatagacttcccacctcttcccttaattttgatataccctttgtcaaattatataaacagcaacctgattttcactttcttagagtgtttggatgtgcctgttttcctctcttaagaccttacaacaaaaacaagtttcagtttaggtcccaagaatgtgcttttctagggtattcacctggacacaaaggatgcaagtatctttcctcagatggcagaatttacatctctaaggatattgtttttaatgaatctaaatttccctatcctaacctattttcatcttctacttcttcacactcttctttagagtctcatgttcctatcaccactatccctcttgtgtctgtacctcccacacaattacataactcttcctctgttgcttctccagccagtacctcacaaatttcaacttcttctctacctcaaaattctgtctctcactcacagtcatgtcaacctgcccctcccctttcagttgacactcacccaaagcttgacactcaaccagagtctcaatcgtctactgctattcatgtagatgagtctcaatcatatactgctgtaccctgcagatttttctgttcccagttctgacatacagcaactaccactcattccctctattcctcaaaatactcacccaatgcaaaccagatccaagtctggaattgtgcaacacagaattcatcctactcttcttcttgctcacatggaacctaagtctaccaaacaagccttggctgatcctacatggctagctgccatgaaagctgaatatgatgcattgattaagaatggtacttggtcacttgtttctttgcctcctaacagagttcctattggctgtaagtgggttttcaggattacaaaaatccagatggatcggtaaacaagtacaaggccagattggtagctaagggatttcgtcagcaatatggaacagattatactgaaactttctcacctgtcatcaagcccatcacagtgagacttctcctctccttggctgccacctatggttggcctcttcaacagttagatatgaataatgcttttcttaatgccattcttgaggaggtgtatatgcagcaacctccaggttttgaatcttccaccaaatccatgttgtgcaagcttcagaaggcaatctatggtctcaaacaggctcctagggcctggtttgataaactaaaggagattctactgaagtttgagttcaaatccagcaagtgtgacccttcactctttgtttattccaagggatcatccacaatctacatgctagtatatgttgacatcataataacagggaatgatactcctttattacaacaactcattctaagctaaatacagtattttctctcaaagaccttggattacttcttaggaattgaagtaaagcatctatcagatgactctattgctctaactcagcaaatatattagagacttactggccagaaccaacatgtcaaatgtcaaacccatctcttcccctatggtaactggttgtaaactcactaagtgtggttctgatcctctttatgattgttatatgtataggacagttgtaggagcacttcaatatgctactataactagaccagaaataagtttctctgcaaacaaggtctgcctgtcaattcatgaaggagccccttgaacatcactgggtggcagttaaaaggatcccaaggtatattaaaggcactctctcatgtggtcttcatctaaaacatgcttctgccccttttttcatcaatgccttttttgatgcagattggacctatgatcctgatgacaggaggtccacatctggtgcttgtgtttactttggatctaatctaatctcctggtggtcaaagaaacagtcagttgaggctaggtccagcacagaagcagagtacaagagcttggccttggtcactgcaaaggtgtcttggcttcagtctcttctaactgaacttgctgtcccacacaagcttcctgccatccattgtgacaacacaagcactgtatctcttgctcataatccggttcttcatgctcataccaaacacagagttagacttattttttcaagaaaaggttctgtacaagctgctgtgagtggtttatgtgcctgctataagtcagtatgctgacattcttaccaaggctttatctttggggggggggggggggggggggggtattagagtttcttactccactaagtaaaatgtatcggttttttacttggtggaaattgtcaactgcaatctgttagtttgttagatgttactaactataggttctgttgacatggacctttgtaacttggcttgatatttttctaatcaatttctatcagttttacaatttctcaatttctatcagtccataatagatttcatatctctaactctaagacagcattccaattatgagttccatccaaaaaatttataaaaaaaaaaaaaaaacttcttgccacagtatacatggtgaattgatagtaaattttcaatcattatgataaacaccagagcagatgtcaactaacaagagtatgttaatacctgttcttgtatatcctgcatcagcttgtagtgttttgacattttcttgtacacctaagaaaagataaaagataaaaagatctaaattcaagaacaaaacatcatgaatttatccatgagttacagctgtttacattgtagctttccttctgaaataatgagtaaaaaaatgtccagaaaatcagtgcataaattattcaagtattgtagatatgacagaatgaacccacagtatgcatatcaaattcaatcagtcaatccacattggcatttgatcttccagtcaatattcaagggacgatttggcttgcataagcccaatccagcttcagcaccaactaattgacaactcagttgatacatgtgccataagactcactagctcaaggcttcacaaaatttgaatttatgatgcaaattgcaattgcatcctaaagtaaatctcgatggaatatttggttggaagaaaacaaaatagagtgaaagtaaatacaaataactacatattttcttttgtttgattagagagagaaagtgagaagaaaagaagttcaaaaacaaaaattcaaaacttccattttccttttaatttcaattcaaaatctccaatggaaaatttgtgtatatgtgtgatgatataagatcactttaccatgaccaaaaaggataaaatgcagatgaaagggggataaaaaagacccagtctttgacaatgtaccttggaaaaaacttcaacaagggcagtcttctcatgaaaagcttgcattgctaatctttcagcattccttgcctcctcacgagctaatttcttttcctctaaagccctcttcatggaaaatcagagataaaatttacataagtactggcagagaaaaatgagccaatgttttttccaaaactagtatcaggtcaagttgtggaactaacagaaggaagatagtccaataatctccaatataatattcacacaagcagattgtttggagagaaatgcaaagtatgccacatttttgtagctaaaaacataaataaaaccaattaactttgattatgcctacaacataagagcaaataaacaacataaatgaattgggattgctagctacaagggagaaccacataaaagaggggaaaaaatacctgtactttatcaggtgattgaccgatttttgaacgtagatttgcattttcttggacattttgtaccaatgtaaattcagcatttgaaatctgggatacgaaaaggaaaatagaatgaataagaattcacataatccatgcatcaaggagtcaaattttcagaaggaaagggaattgatgttagttagtagacaaagaaaggaatctcaatctccaaactaaaaacagcgctaacaacagtcagaccacaatgtaatatgcacaagaataaagacctactcatcaaaaccaaagccatgtccagtgtctacacaaatgaggaaacactaatatccaacaaaatataattaatctgattaaacataaatttccaattgtcacagcagaaaacgaacaccatgtcaatccattattggcgaaagacaatcactgaccttctcatccgtttccccggtcttctccttcaacttcctcaaagtacttcttagagaactctggttgctgttcagcaccgcaatcatttgcttgagctctttaactttggcctccacctcctcaacaagaggcatctccttctccttcgcctcattgcattccgaaatctccgctttcaactaaactcagcaaaacacacgctcagttaaaacctcaacgagtttgaaattgagattgagatgagatcccaatacaaacctgcaaaatcctattctcctccaactccgttcgctgcgcctctagagcgttcacttcctccacaatttccgagacggagttcattctcgcgtccctgagataaaaaataaaaaataaaaacgattaggttttctcccagcgaggcaataattaatccaagaggttaaaagagagtgacctatcgagacaaaaattgagaagagagccaaggaagagatcggttcggtgaggatccggcatgagaagatcggcgagggtgaatttgcgcggacactcgagtgttgtgagaacctcgttgatctggttgtagagtttcacggcgcgaacggaatccacgtggaaatcagggttttcaagatgctctagagcgtggaactcgagttgctcgttgtcttccctgcggaaaatgaaaagaataagaatctgagcgaggaatgtagaatcgaagaaggtgcgaaaagagaagaaaatagaaagagagagagactcaaggagaatgtcgagatgaatgaggacgcgagtgtagagatcggagatgaaatcagggttagggttggtgaagtcctgctccgtcacgttcgcgatctgcaactgcgctaagattgtgactatttccggccgccggagccttgggtactcgtaattcgactccgccattttcttcttctccaaagtcaaaacgcaacctctactcgagagaattcgggcttcgactcatacgagacgagactataagtacaaccgcgaaattgaattaaattgaaaacaaaattagtggccattttcccgcccagtactttcccatggaggctgattcaacaagttctcccaaaattacaaggaaaatactaaaattggattattgcaaaatataggggaaattgtatttagccttatgctttttttaagaggtaaaataccactctttttattctttgaatgagataaattaacatattgtatgatccataaaattaagtgttttttcaataaaaatgaatttatttcattttattcataataagagatgcaatatatgttagaatgtaatcaaagatattaatgttaatataggatcttgttgaattggcaagaaagttgataagatgatttgaatcattttaatgttttgaataggttaattattttaatatttgtcatatctcatggtttaaaattgtcctattatttctaataaaaatcttttgttttgttagagaaaaaaagtaaataaaaatccaacacatacaattttttataacatcataataatgtgtaagtcgttaatatttcatgcatactgattttataattatataataaattttcacacttttttatatgaaataggctaatgggacaagttgagcttatataaaggcaaagtttagacctaaaaataagctgatgacaagtagcatattcaaactttggacataaaaatataaagtaggtaatatccaacttaagtagaccctgactcggctcaacccttgcctccttaccagactaaccagatagtttgaaaaataagaaagcctatatttacaagctgaaataatggtgtcaatttcagtgctggatggaacgtcgttgttgaaaagcatccatgacggtctcgcaatctaagtcaatctcaatgccagtgactccaaagtctgataggtaactaattgtctacatgaaaccaatatccttcaccttttgagctgggagaactccattgcacagataaatttgaatattgggccataactcagtagccaaacaaacactaataagtaataacattagggcatccaaagaaaacgtgtcagtcgttttcaacacttgattcgcaattaggacaaatattcgggcaagagacacccttcgcgaaggtagacaaccccgaagaattctccatagaatatgtttgattttaggaggaatattcaaacgccacaattgtatccaattactaggaagtttcaaatttctggtatccatagttacctccatgatgttgtggtatgcggatttgacctgtaaaatctagtttgactcaagtttcaaataagcttgtcattttttagtataaaattaagttaaacaacattaatattagaataaatttatgtgtggagtttttaaatctatgtgacattataggattcataaaattaaaataagcaaccctatttaaacaaatatgtactgtggaagcacttaaaagtttatcttaaatgagagaattttagtatttctctaattagaaaagtgatacctgttttctcttctcatcagaaagaaagtatccaaattaattctctcggttttgatgtctcggccaggtcgttgatgcacctaaatccccttattgttgagttcaattcgttgcttgttcatagtttctttctttgattagttatcttcaaatacaaagacggattgagggaagtcctcgttatattttttctccactagttcacaggtaaatacatggcttactatgaatttgtaactacatgttctgatatttaatttgttgtaagataaacagataataattatatatatatatatatgggtgtgtgtatgcgcgggtccactttttgagtgcaagagtagtcttaaatcttaattatagctttggacgtactagatatgaaatttctaatattgattaatgattagattaattgcatgatacagaaagttaagaagcataagttaagttccgtaagtttagctaagggaactaaccatgtatctgcctagctttgagattatcaacctagcaatactagtataacttttcgtttttgtagactcacaagacatgaaagttataattttatgatgtacatgtaatcaaaccggctaaatatatacgttctcatgaatgcctaattttatttcaataagtgtttaaatatctatcacttctgtaaattaatttttgtgttggagtggtttatttagcattacaatttctttaaaacaagtgacactactaatgctttatgatcatgagcaaagggaagattaaatcagtggagttggacttaacaccgaagacaacagaagcattgtttgagggagatggtggaggttactacacttggtcaagttctgaagtgccaatcctggctaagaataatgttggtgcaggtcgccttgtgcttcagcctcgtggcttcgcccttcctcattatacagattcatccaaaattggttatgtcattcaaggtcagacccgcgcgtagatatcatcatatcttttctattttttaattttaatttcccctcccatttctattacaagttatacatacgagtttaatttaatattcacacacttatgagttatgacataccaacgagtggttggtttgaataaaattaggcttagaatttttaattaagattttattttcgaacatatatagacgaaaaatatgtaattaacaaaaaagatctcattaaaaacaacagtcaattaaattacaaaaatatcattattgttgtgaattagtttaattttttttccttttttaattagtgacatccataatataatggtattatgcattgaatcgtacgtgtaataaacttaaatgactcgtggtgttagttttcttagaactttggtgatcatcactgtctcctattaaatttctcaattttatggcacacatgcatgcagggactgatggcgtagttggaattgggatggtactccccaacactaaagaagaggtggttttgaagcttaagaagggagattttataccagtgcctattggagctgtctcgtggtggttcaacgatggagactctgatctcatgcatcattgcttttcttggagaaacttcaaaggctcttgttcctgtccaattcacctatttctttctaactggggctctaggacttataggaggcttctccaatgagctcacaagcaaagtatatggtttggacaatgaggtggaaaagctcataaagccaaacttggggttttgatcatcaaactagacataagtcaacccatgccttaagccacaaatgaacatgaacaaaaagctactctataatatagatgctgcacgcccagaaaatgttgtggaaaatgctggattagtcaaaaccttaacggagaaagattttccttttattggggatgttgggttaagtgtgattagagtgaaacttgaaccggtagcaccctcatacccaaccaaccttacggttcagttgatttacattgccagaggagaggtggcaagattgaaattgtggactttagtggaaagagtgtattaaacactcaagttgaggctggtcatttgcttgtcgtgccacaattctttgatgttgctgaaattgcgtgtgaagaaggaattgagagttactccatcgtaataactataaagtatgacttaatttatacaaaatatattcatttaatccaagaagtagcacatggcatgcaatgacattaaaaatgattgattatattactttaaaatatgacatagtataattaagtgttaacaaaattaacaaaaaaatgattgattatcttatttacaggccattgtttgaagaattggctggaaggggatcaatttggaacgccttttcgcctacactgcaacaagtgtctcttaacgtggattctgattttcaaaagtttttcatatccaagatcaaggaatctaccaatctcatccctcctactgtttagttcgatgcgtgtgatgtacgtactaccgtatttgtttatgtataattttcagatgatgatattgatgtaagataattctgaacttatctttctaaaagttatgtcgttgtattgcttttgttttaaagaaaacattttcgtgagaatacttatttaagttttctatattgagcaataaatgaatggaaggatttgaatgctagtctataatatagacgctgcacgtgcacaaaatgttgtggaaaatgctggattagtcaaaaccttaacggagaaagattttccttttattggggatgttgggttaagtgtgattagagtgaaacttgaaccgggtgctattaaggcaccattataccctacgaacactgcagttcagttaatttacattgctagaggaagtagcaagattgaaattgtgggcttgaatggaaaacgtgtattagacactcaagttattaaggctggtgatttacttgttgtgccacaattttttgtggttacccaaattgcaggagatgaagaaggaatggaaagttactccattgtcacaactactaagtaagctgttgggattttatataaaataatttttatagcatgcaataacattaaaaatggttgattatatattatttgagagtatgtcccagtatgattaattagtactactaacaaaaatgtttgattatattatttgtaggcctttgtttgaagagttggctggaaaggcatcaatttggggtgtgttgtcatctactgttcaacaagtggctcttaacgtggattcagaatttcaagagttgttcgtatccaagatcaagaaatcctctaatctcatgccacccacgtcctactagttagtctgacacatgagatgatgcatgcgtgtgaatgtatttgttttgtaaaattcagatgatgttatacatatgagaaaatactaaatttatctttctacgtgaaaattcttagtttgatgttgattcaagagacagggatggagaagaagtcgatgtgtatgtcattgtattgcttttgttttcaatttaaaggatatactttggtagcagtaaaattctttatatatgttctgttatgaacgaaaagtattcatgaagctagtgattataattaaaatgtttacatgtatggtcttacattgcatagtggattagagtgtagaattgattttgagttaaatatttttagataatttttatgctaaagataaaaatttatattgaatttttcaataataaaattaaaagtattaacgtacaaatcacttcatttcaaaattttaatcaatttcttcaaaatcagtctagacttctcacacaaattaaaatgaattcatccacttcatcttttgaagaatttattgagaaagtttatataaaagtaaaaggcataaattttattttaatttatagagaaatttaatttatttttttcttttcttatacgtttcatgttagataagcttctttaatttatgaaacacttatttggaagaaaaaaaataagaaaataaaatatatttaacttctctatatataagcttaattaactattttaggaaccttagctttttagaaaaatcaaatgaaaataatttttataaaaagtaaatagtacataattaatttaaacttatataaattacaattcatttattttgtatttttttctcttataattatttatgaaaaaatttattcatataaaacttaatttcttataaataatttcatctaaacaatatacataacttatatgtttcaatgtaataaaatttaaggttcaaaactcatatttgataaggacatgcggaaagtgcttcttagaatagacataacatatatgtttctcatttccttttattataataaaaaatttaaatatttataatttacttgattaaaacatattactacttaaaaaaatttgtattctactacggtgaaataatgacagttttccaagaaccatcttaaattcgattacgacttcaatgatgacaaatttacaaaaatcatcttaaaaagctgcgttccataatgattttttgtaaaaccgtcgtggtttcatttctcttccagcaaaaacgaaaacgctcgccactcaatcactcaatcactcaaactcacaccagcgtatagagattagagagagaaccctaaaattcggctgccgcgatggacatgcatcgacgacgacaaagacctcaacctcgacctcggcgacattgatctcgacccgaccaacggaatcatgcccaaccacataagcaagttttgatttcatttcaacttcatctttcatcttcttcccctgtcaatctagccactctctctgaatttgacggttgtgccgcatagtctcatcagtttctcacttgctcgctcagtgactcgctcactcttcttcagatttgatcgaagaaagaaatagaggaagcactggaactgtcacgcgtgaaggacacgaaggagaggatggcaggtgtggagtgcctccaccaacttctagaagcttctagaaagagcctatcctcttctaaggtcacctcgctcgtcgacatatgcatggatctcctcaaggacaacaacttttgtgtcttccaaggcgcgctccaggccctcgcctctgccatcatcctcgccggcgaacacttcaagctccacttcaacgccctcctccttgccgtgggagtagcagagggtgttgaagtgtcgacaatgcactcagtttgtctctcaaacttagaattttgaaatataattaccttcaatggttttgtgagtatatctaagatctggtcttcattccaactcttaattatccatcattacttgatgtctcaagaaatgacatcgggtctctaatatatttactcctccgattgaatagttggatgctttgccaaattaattgcttatttgttgtctatccgtagcttcataggtcttattgtttccaaattcatctctcccaacaaagtttcaagcttggcagtaagacagtgccaccatatactactttttgaaacactaagaaatgtattatgtatccattgcatttgcagcacatgaaaatataacaagttgtattcttttgatcatcctaatctccacaccaaccaaagtccatacatccaatctttacacttctacactgcatctcatttgaaaacagcaacccgaaatcaatcgtccctttgatgtacctcagtatccgtttgtttgttgcatagtgagatgttcttggcttctccttaaatctacttatgaagccaactccatgccagagaatgatcacactgcattcatcacatcaacttcttttttatacatttttcatcacaagtcccacatcaaccaactaatggagttggttattgataactggtaaccactattaaaagtaggatcttggtaacctgtgacataaaaagccttaaagacgttgtgactttgtgaacacaaagtcaaggaaacagaggcttgcattaattgcaactattctaattcaataaaatgcatgttgcttctcatacaaagacaatcctccaccatcaaaagaagcaaaccagagttaacactgactaaataaaacaaaacacacatacatgcacgatccaccttaagaatactaacttcaatgttacattggcattttattacacaccactgcaaatttctttttcactggagacaattttgttccagtaagataggattataccttcgagtacttaacacatctgcataaccaaaaccaagacttaaaatcgagacctttgattaagttggaccaaccccacgccaattgatccacgtgctcggtggtacaccactgcgaatttcattcattcattggttgattcatcccattgatcctctcaattacagagataatcccttgcccgccaagcttcccctgcctattagccactgttctgtatagtttctagaacacaaatgtacagcacgaaagcgctgtatgattactgtttgatcactctaactccgcaactatgaagatatcgatggtgaacgatatcccacagttgatgatcactgagatacacgaaattggggtgaggtgtgtgctcagtgtaattgaaagagagagagagctagagtgtgtgtaccttttaagcgcctatacccgtgtatttataggcacattaccttgcggttagatactccaactgcacgcgcaatactccctatattcttggcctcaacctgcacgttcataactgctccagtagaccaagtcatagtccacattcattgaatctgttaacacacgtggtattaaaggaaattgggcttcgatattaggcccaactattattccataacagttgccccccagcccgagtatcaagttgccttgatggtcgggatgtattatgttaaccgcctccgaccatactaccaaactagtcgtctccgagcagaaaattaatctgaacagcttcatccgagcatcgaggtccaaataaaatcccgcgtttattataaatcggccaggagtcattccgagtaaccaagtaggatctccccagtatatttctttggataagtactcctggtcggttaatctaatactctagtttatcacatcaattatccgaacagggcaatccgagcaggaccttttatccgagctcttgactgatcgtactttgttgagtagggtttgtccgaataaaggcttattttgctattcctttaggtcgcacttgggtggaaaaagtaaatatccctcgagtggcgactggcctccttgctgtaggatcagttactattcccatcattaatggcagcttgggcattaaagacctgtcgtttcattccctttggtaatcattacgaccctagtgtttttactttcttgcccccaaatcaacacgtccttttaccgttctgtccttgcgtcgtttcgttttgtgagtggcggttcatcaggccgttttgttttccttggcggttactgtgggttattattgcatttcaaatttatcctttaatttctggacctccttttctttatattgtctgcattccttctttcctgagttttccccttttctctttcttcttttgaagctttcgcaaacttgcctcttcgtcatccctttcgatacaccgctattcttgctaccaggtacctttctttctttttgctatttttacttgtgcattctgttgcttgcatttctgtaagggtagtgttgctttattcttttccattcttggccgctgtcctttcctctgttcttgtatatcttcatgaaatttactcctgaggaagaggcggagttgcggcggagggcccctagggcctcgtggttgttgtggggtcttcccctccccgatggaatgagcgagaccgaccctttgcgtggtcataccggaggttcttccatctctaggccacctaaaacctccgccgtgactctcccttcagaccctttgttgccacctatccgccaccgcgagtctgactctcgcggtgttcctccaccttcttctatctcttcttctagaaatgactctattccgggtactagtcatcctagggctcctcccattttgggccccaggacatctgggcccacaaatgcaatcagcccaacaatctttcctttgaaggtctcttgtgatccacttgacaacctgtcgtcctcgtcttcggacgacactctttcatcatcctcggataaaatgatgactttttcatcgtcctcggatgaagtgatggaagttcggtacgatgcctgcattaactgtgtttctgatgccgtgtaccatactcagcatggttctgatgatatcgccgactccatcttgggattatgtcggcataaccccatcttctcatccgtcaaaaaacccaaccgaggccgtacaccaaatgcatggttccggtctcgggctcttctgcctttaatgcgtcatttccaggtatgtgtactaactctggttctctctttatattttggtaggtataatggacaattccgtggaggttgtggatgaatctctgtctgccgagtccgagtcgggcgcggttcctgcgttggcctccatatttcattgggttacctacgaaattcttagaaccttctccaccctcgaactatccactatagcctcactccccttaggtaaacaagacgggtttggggtccgggctccctactcgggtgagcccatttgtgcccatagagagggcaatgatcccaacttctttttcttctacgagggggtagtttctcaaatagggtgaccttccccttcacctcttttgagatggacgtattaaaccatctccgaatagccccttctcagcttcatccgaacagctgggatttgtgaggaccttcgaattattctgtgaagagcttcggatcccctgtacagttccactctttttttattattattacccgaacactcctaggacggggaaagaaccgcccgagcgtaagggatgggtcgccctgcggagtcagaataagcggaaattaattgttccgtttacagagtccttccggggatttaaagataaatattttaaagtcgcagccaatcccgggcagcgaccattttttctgcggggggatgagtctgctgacgtagagtggtcgtttcccttgtattggtcgcaagaccattatcaggataaagctaattataagttcatcgaagagtcattgtccgatgctgaagcctctgccatatctgtgatttcggagtatctcgacaccaagggccgccccatgcggccgtttatgtccgccgtgctcgcggcagttcctccgcttaccgtaattatagctctcgacgagttttgttcggtatgtatcttgaatgttatatctgatgtgtccttgtttatttcagtgaacatgggacaaccagctggttcagccgccaccgacccgaagccaaccgagcctgcaaataaagctccacaaaaagggcaaaagcgggtcctccctctttccgggcaatgttggagggagaaataaaagagctaaggttcagaaaaaatttgttgctcttagaccgtctactccaacggctgctcctcgggggatcccgtctgcagtcgtccccgtctctgctgcccgggaacgtgcttccccgtcgactgccgccttgcagaatgagcgagctgggtccttagccgcgacggggaatgtttggagaagggggtaaccgaggagctggtcaagcttaccaagcctcccagttatctcctcgaaccgggtgcccccgtgggagacgagctcgcggcattggttcgcgttgaagagaacgcttatcaatgcgcttctctagtacgggcctttgccactgttcggcacaggtaagtattcaccaacacttcatctgtattcttcatttttcaggttctaattgatttaatgtagatatggggtggcggtagaagagaaaaagaaatccgaccaagctctcatggccgcccggctgctcatggagaggacaaggaaaggtcttccgctgaaattaggaagttgaaggaggacctactctccgtgcaagccatagcggcgtcgctgcgagcagatctggggcgtgcccaaggtgacctcgaggcttctgatcagaagatagcgatgttatcctccaccatcgactctttgaaagccgagcacgaggaaaagctttcagaagtgaaggccgcccttgctgttgccgtcgaggactctttcaataacaccttagatcaagttaagtttttgaatcctgatgttaacctttgcacaaccgggatgcattacttagcttatgtagacgagggccgtttggttcccccatctggtgctgaagattcctcgatggtagccgccgaggaggcggtacacgtagatgaagcttcttctggtgctgcacccaccgtcctcgcgccgcctcctacagatcccgttcctgtcaccgaggatcatcctcaacaataaagggccgggatgccggtttaacttgtattttacttgtatttatttttctttgttgggcccggtgcccggaacaatttaatttcctttgttgggcctggtgcccggaacaattgtttaacttggtatatatttctattttcaagctctctacttgattcgtaaaatatcatgtgcgcacatctttttggttccaacgaccacatattcgaatgtattttttatttcgtatatatccgaccacaaacaactttgctaacgaggcctgatcagagccgggtagcatatcatttatagccgttatcacactttgaaatcgtcatgactcaaaacgtataataaaatgtttgcattgataatcgttgttacaataatatgtatgtccgagtaccgggtagggtcggatcgatactttagtcaacgatacaatttattcaatgataaacataatgtgctcggaaagcaatgtttccgagtgaacaatttcctaacaatgtcttcatcgtgaaaaaggaccgtatggactcggattactccgttccgagtccttaccctcgataacgaaatttcattgtcgagctgcctcgtacccctgatgaataaggaccatatgggttcggatacaacaatccggacccatacccctattaaaaaggaggtcgacgtcgttagctgtaatacttcttcaacttgtcagcattccatgttcgtttgaccgtcttgccttgtaatgtttccaacgtgtatgctcccttgtctagctttttagtgacccggtatgggccctcccagttagccgcgaattttccgtctcgggcattcttgtttccgatgtcggcacgtcgtagtaccagatcggtttcttcaaattcccgcgggaccacccttttattgtaggcgcgtgccatctgttgtttcagtttcagttctctgtcgtgcgctgctgcccggatctcctcaacgactgtcgactccaggctaatacttcattatttgtttcctccccggcttgcaatgtctgtctccgtcgccatgattgctgtccgacctcgacggggatcattgcttcgtttccgtatgtcatgcggaatggtgtctcccggttgatgattggaccgaagtccggatcccccatagacataatataattgttccacccaagtcgatccggcctcgtgcattcgtttccgtagggcctccagaattgttttgtttgcggcttcagcttggccgttggattgggggtgctcgacagatgcgaaccggtgtcggatttggaaattagccatcatctcctgaaatcctctgtcaatgaattgggttccgttgtcggtaattatttccccagggattccgaaacgggaaattatatttctttcgaaaaatttctgtactcgggccgacgtgattgtcgttgaggggctgcttcaatccacttggtataataatctacagccactatcagccacctcatctgtccttccgccggcttgaatggtcccaacagatccatgccccatttgtaaaatggccatggcgccgaaatggactgcaattcctccggcggggataaaatcctggtcgcgtgcatctggcagctttcacaagatctcacgtgatttgtggcgtccgcactcattgtcggccaaaataaccagcccgtaacgcctttctcgtcagtgcccggccccccatatgctgtccgttgattccttcgtggatctcggataggatatagtcgactcggtttgggccacgcataccaataaaggctatgtaacccccttcggtataattctccgtcgaccatagtgtacatggccgacgttcttgtcagacgcgggcttctatatcgtcgtctggcaagattcctctttccagaaaatttactatgggtcgcgccagtcctggtcggaggtaatcatcattacgcacgtcggctgcatcgtttgctgttgaattactgtgcggttgttcccgggctttttggtgctcgccaatttggacaggatatccgcccgagtattatcttctcgggggatgtgactcacagaaatgtcgtcgaactcggacatcaattcttttactcggctcaggtatttggccaacaaaggcccctttacctgataccgtccttcaatttgtgatgcgaccagtgggagtccgtgtagactttgacgttacgtgcctcctgctctttggcctgcacgagtccggcgatcaacgcctcgtactcggcctgattgttcgaagtcgggaaacctagttgtagggatatttccgtagccactccatctgggttctcgactataattccggctccacttcctttcttattggaggacccgtcgacgaacagggtccaccatcatccaccctcggattatgaggggtgagttctcggacgaagtctgccagcgcttgggacttgatcgcatgtcgagcctcgaatttcagatcgaactcggacagttggactgcccaatgggttagtcttctgccaagtccggtttgtgtagtacctgccggattggctggtctgtccgtacaacaacagtgtggctctgaaaatacggtcgtaactttttggcggcgacgattaaggcaaaaacaagtttttccaacttctggtacctcagctcggagtcgcgtaatgctcggctcacaaaatataccggcttctgtgtagtgtccacctctcttaccagggctgcgcttactgcttcttcgcctaccgacaaatacatgaccagcacttctcctgttttcggtcttgataatactggtggcgacgataacgatttcttcatgtcgatgaaggcggcctcacattccgggctccattctatgacggcctgcttcttcaacatcttgaagaatggcaatgccttttccgctgacttcggcataaatcgggtgagggcggctatccgacccgtcagttgctgaacctccttcttgttcgtcgggaactgcatgtccagtacagcgcgacacttatccgggttggcttctattccccggtgtgttagcatgaaacccaagaacttcccggctccgactccaaaggaacattttaacggattgaggcgtatgctgaatcgtcgtaatcggtcgaaagtttcttcgagatcctcgacgtgcttattgatatcttcagatttgacgatcatatcatcaatgtagacttctatatttcgtccgagctgtggttcgaacacgctgttcatcattctctgatacgtggcccctgcattcttgaggccaaacggcataacattgtaacaataattggccttgtcgccgatgaacgccgttttctcctggtcgtctgggtgcattgggatctgattgtatccggaaaatgcatccataaacgataatactctgtacccggatgaattatcaaccagctggtcgatattcggcatgggataggcgtccttcgggcacatcttgttcaaatccgtgtagtcggtgcataccctccattttccgttcggcttccgcaccatcacaacgttcgacaaccaagtggtatattgaacttcacgtatgaaacctgcccggagcagttcatcaatatgggcccgtaacgcctgtgccctctccggccccaatttacgttttttctgttccaccggcttcgatcccgggtacatggctagtcgatggctacagaaagctgggtcgacgccgggaatttctgatgccttccacgcgaatatgtcaatattcttcttcaggcaactgattagcctgtcccgtagctctggtcctaagtcccccccgatgttagtcacctggccggctgaatctccaattacgacctgttccactttctccacgggttctggccgccactcgtctggggcttctcgcatatcaagctctacgacattaacagaacgtactcggtttgatccgttgtcgtcaatatctttctcgcttctacggaccgtgtcgtagtaacactgccgcgactctttctggtcgccgcatatggtcaccacctgtttgttgttgcctacaaacttgagcttctggtgcttggtggacattaagatgtcccacctgtgaatggtcggtcttcccaatatcatgttgtactgggatggaaaatctgccacgacgaactccacttcttcggatttataagattctctcgttcctagtgttagacgcaggcggatggatcccatcacgcttgtgttgccgccattaaaaccaatgagcattgtcttgcaaggctttaagtcttttacgtccaacttcatcttacggaacgcagtcaacataataatgtcggcggaactcccattgtctacgtacattcgtcttacccgacagtttcccacggttgctgatatgaccaaaccatcttcgtgtccgggtactactccctccatatcctgctcggtaaagtataggagtggaggttctggctttccggcccgggctttgaatctaggttgtgcctggaccgacaatacttccttcaagtactttttccgttgagtggaggtgtcgccgccgccgcccatacctcccgagattacattgcattcaaattcgggctccgggaactcgtcattgtcttcccggggtttctttccttcttctcttcgttgactttcttctcctttgcgtttattttttcgcccctgtgttcggatgacatactgcttcagccttccttctcggataaacttttcaattgcgtcccgcaagtcccagcattgatcggtagtatgcccgggcccgttatggaactcacagaagcgtgacttatccagtccagccttgttgaacacagggcgagggcgttccactttcttcatttcagtgaatgcgacttccttccaaatttgtgaccgggacacgttcagtggagtgtacttctcatatttattctcgtatcttcctggccggggcttttgttcgtgattccgagtacgattctccgggtaacctctattttttgggggcggacttctcctatcatgtcgctcctttgttcgtccagggttgttgacaacctccatttgttctagctccaagtacttcttcgcgcgagcacggaattccatcaacgacttcaccgggtctttgtatatagacttggcgaatctcgacgaaccatcgagtccagctgatatcaaatacacatggactctttcctctaatccttcgacttgcagggctgcctctttaaacctatccaaatagctttgcaaggtctctccgggtagttgcctgactttccccagcgtgaactcggacttcggctgctttttgctggtcgcaaaattcaacaaaaacttctgtccgaagtcttcaaagtttttgatcgacctaggcggtagggtgtgaaaccacgtctgcgccgggcctgtcaatgtggtgacgaagatccgagaaatgatgggctcgtcaattccccggacgcacatctgcaaatcgaattcatcgatatgcacttgtggatcctgcgtcccgtcgtattttgatagaaaagatccatcaaagtcgtccaagtatcgagctttcacaatgtcgtcgacgaaagggctgttgttctgatgtccccgactgttcttccgacggtatatgggtcccgtcttttgatagaaagtctgttcgcccttcttgccatttccatcttcctgtagaactttttcaccattcattcgtcgactagggctgtcatcggggattcgtcccgtgccgacgtcatcacatgtctcatttcgtgcccggattgggctccgacctggctcatccgttctcctgtggtcttctgggtcggcgtcgcgtctctgagttatttgggtcctcaggtccagtggctgttctgtccgcctttggtcttccggatctgtactcctccgctggttcaaccgtgtcctcaaatcctgtgtctcgccctcaggattcgacgactgtgtgcggttgattaaggtttgtaattgctgctccaattgtgccattctctgcatctcggcacgtctccgttcttcattgtgttcctcgatttgacgagtgatgtttctgatgtcgtcttgtctctgtaaagtctgtcgcctctccatgttctcaattcgagtcaaaatcgaattgaggacattgccgactagctgtcctccgagctcaccctccggatacgttctccgtgtgactggagtcctctgctgatctgtttgggcgggcgaggaagcttcgtcggaaacggcttcagtcacgtgtacttcttctcttcgtgccacgttctgactctccggtaggaagatttccctattcggcatctcggagcgcggtacggaatggctgtttcttgtgttaaccattgttgcaaggtgtgggactcgaaatttatcgtccccacagacggcgccaatgttctgtatagtttctagaacacaaatgtacagcacgaaagcgctgtatgattactgtttgatcactctaactccgcaactacgaagatatcgatggtgaacgatatcccacagtagatgatcactgagatatacgaaattggggtggggtgtgtgctcagtgtaattgaaagagagagagagctagagtgtgtgtaccttttaagcgcctatacccgtgtatttataggcacattaccttgcggttagatactccaactgcaaacgcaatactccctatattcttggcctcaacctgcacgttcataactgctccagtagaccaagtcgtagtccacattcattgaatctgttaacacacgtggtattaaaggaaattgggcttcgatattaggcccaactattattccataacactctcaatagaaacaaattttcaatctagataaacattcagtgtgtaacttaaggctattagtaactacaatgattattatattgaccatttctcaaagcatctgggtgacataattaggaagtaattgcaatcaatttggtgattatcatgattgagactgcgagagcaaggaggggtgggagcaatgcatgcatatgaatgtaacttttaaggttatgttgttaatgtcctttttatttatataaaaaagatttggttagttgaatagaaagttcacaagagtcatgacacaatacttgaaaattaataacaatttttttatatattaataacaagatttaaacttgcatatatttataggatgagtcatgattttttatctaatgagcatatatcttacaagctaaaaaatatatcaaattatgttattggtaataaataattattaatgactaatttatgtcgaaaaaaaatttgtttgatcatttttagtaaggttgtttttttctaattagattttttttatttacaaatctcgaacttgagatcttaagaagactgagtcaaaaattatttggattaatgactttttaataaagattggattataatgcataagcacaaaacgtggactgcttattattgactgtaaacatgcatttaactactaataaatcataaatggtagtgaaatggagtggttaataacagagactatatgtgagctataatttgttagaagcttagctgattaccttcattctgttactggaattgtattcaccttccactttcatgttgtaagtacagttgtacacaaaattaatcaccgaatccaatacaatgacatcccatttctaatcctctgttaagagttatatgatatgtggtcacttttttcactatattttcttggataatacttttttcttttttacttaattggagcaatatataaatgatgaataactaatctttatttgattcatgttacctcctcaaatcttcttaatttctttttcttaaagtgtatgtaacagcaactgaactcacatggggagaagatcctgactcagaactcattgaccccacaccagatttctgtaataattctgtccctcaaccccttcactgcttcacagctcacagctaagagctaatgagctgttgcctgttggtgtgcctatacgtctgttactaaagtttcttgttataagtcaagcaaagtacaaagataaaaaattaatttccaaagcattcatccgcgtaatgataaaaaattaatttcaagtagaccatatcccccacttggaattcaacctcccttctgttcttattggcttgttgattcatttttttgaacttacactaaattctcgaggttttggagaaatgctataagcactgaacagaatagcagaaaaattgcccgtcccaattaaatttggacgcctgtcaactgactattaataaatttcaactttttaaaatgtttctaggtttaaagagaaaataattaagtaattatatgtagagaaaaattagaaaagtgttttataaaaagacaaataaaattttaaaaagagtcttataattaagagaaaaaagtattttaactaaattaaatacattacgatcatgttttgttttttttttttttaggtaaaaaaagaagatgctttaagcattgaatcaaaagtgtaacatttatttagtattggaattgattgatattcttaggtggaggaacttgtttatggagggtggtggcagataaggatctaaaaaccaactgtaatcgcaatagcatatttatttgataatggatgattctttcagaccgagattggtacaaaaatgcaaagtcaggcatcaactaatctcgttgcctacttttgggtttatgaggaaagacagcgaaccaagggatggaaacgcggcttgccattgatgagtacaaagggtaaatttcagaaaataatatttctttaatatatttaaattaactaatatttgattgacaggtttagcaatttcattggacaggccatatttatttgtatcaaagtttgatttgggaccaacacgccaatcatttattattataatccaataattattattataatccaactaagagtttctacgtcttcaccgttttttatttttgagtgatatgattgatttgtggagttggatccatgattaaagaagaataggtattagagtaatttttgtgagtattatttttactctttacatttttacaaactgaaaataaattaacaattaaaacttataaagtcatgtaagtttttttaaaaaaattacaacttttttaaatggtaattaaattttaaaaagctattaattttgttatcgttcattcataattgtatgactttttatttttttattctataatttaatatttatctttgatatgcacacagaaaggaaaatatagatttttcggttaagttgtttcgtgcaataattaacgttattttgatgggtccgcgactcggcataataatgtatgttttgtttggtattccgcgttcactttactcttgtcaccttcatattttaacgtgaatctggagacccaattaacaagcaatccacaatcatactaagttttcttctatatatataggaatttttattggaaaaaaaaagcataattctacttgaaatatgagatataagattgattgcatgattaaaaattatgaatttgatctctcctgttaataaaaattaagaaattaataattaatatttattgatataaaaaaattaccttttaagaactttaattaattggaaactcttataagattcatccactaaacaacttagaaagagagaagaaaaagagatatatccgcaatccacctaatataaagactctatgtccgcgtaacattgttgtctatcattcaaagtcaacccaccacccatccactcaaagttttatatagaatgacttttttaagtcatcattaaactttaagatattcttaattagatcattgattcgtagttatatgaatttttgtttttacttattattaattgtgcatgttttctataattttatatttacctatattattttattttcaggtaaacatacgttatttataaccattttttcaaacaatatactttggattgagtacagaggattctgactcgaaaaattaatatcccttattcaaaggatgttctaaaaaacactaatttcatcactggaaataactttatcaccaaaataatttcttaaacattcaatttcttttatcattcaaaaataaagtcaattttaatattttgatacaatatttataatgcaaatatatgtaatgataattaaatattactttaagaatacatgcatctactaataaaaaaattaaattcatctaactaagagtaaaacaacttattatatatttagatatgattaattttaggggcaaggatactttttaggataaaaaaatttaacaacaaatttgttgaagttcatgaataaaacttatcagcttattttttagttaacattcactagtatttttttttattgctaacaattaactttttggggggatgtaccattataaatagtcaattattttaaatatagtgccaattataaaaattgacaatatactttattaatttgtaatgattcattgcaaaaaaaaagtattttttgtaacacagtttattttatagaaattattgtgaaggaatctttctttatggttgtttgtgtggtgtagaacgtataccacgggttaggcacagtcaaaggttttcacttctaagaaagagagacgaaacagagagagattttccattaagttatatgtccatgtaaatgtaataatatatatgtttggtactgagtgtaattaacacttatcacgttcatatttattcaagtttgattttggagaattcacattcatactaagatttcttatcatggctttgggatcacgttcctcttcctgcaattacgatgtgttcctcagcttcagagggaaagacacacgtcatggttttactggccatctctacaaagctcttgatagcaagggaatccacactttcattgatgatagggagcttcaaggaggagaggaaataaaaccagcacttacgaaggcaattcaagagtctagagttgccatcactgtgctctctcaacactatgcttcttcctcgttttgtttagatgaacttgcaaccatccttcactgtgaccagaggaaacagtcgttggttatacctgtcttttataaggtggatccttctgatgtgagacaccagaaaggtagttatggagaagcattggcaaagcttgagaggaggttcccggagaagttgcaagaatggaagatggctctggagaaagtagctgacttgtctggctatcatttcaaagacgggtatacaaccatactaatctttttactttatagtttttgttggattaacttttacttgtctgattatttgacattaaatctaaagggaaaataaatgcttgttgaccttgacaatagacgtatcaagacttggatacatgcaaggtgatatgcatccagcatatggtcctttccaagcttctaaaagcctagaatcattgataaacaactcagaattgcacataattatgataattgttgatgattccattcctttcaagtgtcgtgctaatttgaaacttgttttgtttgaaacagagatgaatatgaatacaagtttattgagaagattgttgagcaggtctctggggtgattgatctttgtcgtcctttacctgttgccgattgcccagttggactaaagtcacgagtttcagatgtaaggaaacttttggatgctggatctgatgatggtgcccacatggtagggattcatggaatgggcgggataggaaaatcaacacttgctcgagctgtctataatgaattgataattgctgagaagtttgatggtttgtgttttcttgcaaatgtgagggaaaactcaaacaaacacgggttagaacacctccaaagaaaccttctttcagaaataattggagagaagaacatcaacttaacaagtaagcaacaagggatttcaatcatacagtctaggctcaggggaaagaaggttctcttgattctagatgatgttgacaaacacgagcaattacaagcaattgctggaagacctgattggtttggtctcggcagcaaaatcatcatcacaactcgggacaaacaattgctagcatctcatgaagttaataaaacatatgaggtggaggaattgaatgggaacaatgctcttcagttgcttacatggaaagctcttaaaaaggaaaaagctgatccaacttatgaaaagctcttgcatcttgcagtaacttatgcttctggccatccattggttttggaagtaataggttgtgacttgtttggaagaagtatagtagactgggaatctgtcatcaaacaacataaaagaattcccaagaacgaaattctagagagacttaaagtaagctttgatggtttggaggaagaacagaaaagtgtttttcttgacattgcttgttgtttcaaaggacgtgatttgcaagaggttgaacatatacttggttgtctttatggtgactgcatgaaacataatattggggtgttggttgaaaaatctctaataaaggggagttgggatggtgtagttaacatgcatgacttgattcaggacatgggcaggggaattgaccaacaagaatcgtcaaaagagccagggaagcgaaggagattatggttaacagaagatataattgaagttttagaagacaactcggtaagtgagagtatggtttcttatcttgatcttttttatttttgtctatcgtatctttatatcatagtcaagtttttcatgacaatttgtaaatttctttaaacaggtgaattgatgtcttacatataacttgtattgtggttgatttgtaccttttttcattaacagggatctagaaaaattgaaatcatatgtctggatttctccttatccgagaaagaaacaacaatagaatgggatggaaacgccttcaaaacgatgaaaaaccttaaaatactcattattagaaatggtaaattttccgaaggtcccaattattttccagaaagtttaagagtactggagtggcaccggtatccttctaattgtttaccatctaattttaatcctaaggaacttgtcatatgcaagttacctgacagttgcattacgtcatttgggctccatgactcacggaaggcaagtttaaggagtatattttcttcatcttgttaattaataaattcactttaaatttattcatttggttctttttttttcttttttctttttttttctttttttttttttttttttttgcagaagttcgggaatctaaaggttttgaattttgacgcgtgtgaatttttaacagagatatctgacgtatctggtctcccaaatttggaggaactttcatttaatcggtgtgggagtttaattacagttcacccctcaattggtttactaaataaacttaaaatattgagtgctgatggttgcagcaagcttaccacatttccacctctgaacttgacctctcttgcaagtcttgaactttcaaattgtttcagtcttgagaactttccagaaatattaggagagatggaaaacttatggaaactttctttgaaaaaccttaccctaaaagaattgccagtttcatttcaaaatcttggactcggctggttaaacctggataattgcgaaattggttgctttccaagtagcattttcgtgatgcctaaactgtttgttgtgaaagctacaaattgcaaggggttgcaatgggttaaatcagaaaagggtgaagaaaaagtgggctcaagagtatgttcaaatgtatttgaattcagtgtcgatggttgcaacctgtatgatgatttcttttcaacaggtttcatgcaggttggtcatataaaaactttatgcctaaggaacaataatttcacattccttcctgaatgcatcaaagaatttcaatttttaagaagacttgatgtgagtggttgcttgaatcttcaggaaattaggggggttccaccaaactcaaaagatttcaatgcaacagaatgtatatccttgtcttcctcgagttcaacaagcatgttgttaaatcaggtattgtcttgtttttaacgtatatatatgatttgataatatattgcacacttgatattaataaacttatgatatctttatgaaatatgaccaacagaaattgcatgaggctggacaaactgtgtttcggtttccaggagcaactattccagagtggttcaaacagaaaagtaggggaccttcaagttctttctggtttcgtaatgaattccctgacaatgttctttgtcttcttatagcacgtctggaatgcaaaacaaaatttggacttgaacccaacgtgttcatcaatggcaaacttcatgaaaaattctctcatcacactagcgtaaaaaaggtgaaattgtattatacatatctatttgacctcaaatcagcgtgtctgccatttgaagtggctttagaaaaggaatggacccatgtggaaattacatacgcaggtgtgatggagacctcactggttaaagcaaccggaatccatgtattgaggcaggatgatattcgatatgataatccttatggcaagacaaaattagaccatgatctcaacagctctgaatcacaaccactcattaaaaagcataggtatgtagacaagcaagtttcataattatgttatatatgaaaattatacttttaaattgtaataaagtaaaaaataccaatattataaatataaagtcaacatatgagatggtgtgactgaagagaagatataataggttgttttgcaggatatcgaggtgggttggccctgaaagaattagaaagcttctgtggaaagctgcagatggagctttgattcctaatgcccttactattaagaacttcccttgtcggcgatgtggcgtgttggaggagacatgtctgcatactcttcgtgattgttttgctgtgatagcgttttggagaagtgtgttacctaagcaattagcaccaaagttttttaaaggtgatgtaacagtgtggctggaaacaaatttatctttttcagaggcagctttttttggccgactttttttgggattgcagtggaagtggtcttggaattgcgcaataaccatgcgttctatcataaatacaatgtttacggttcccgtaatatgatgtatgttgtctttaagcgttataaagattttatgagagcccatgcttctcacaatttgatgacgaggaatctcttgaagtggaggagtcccgaacatgatgatgaggaatggttgttgaggttaagagtgagtggtgcatttgatccctcttctggtactgctgcatgcggaggtatattcacagacaattattatagatacgtgcttgggtattcggttaaggttggggaatgttgctcaaaagatgaggctgaaatatggggtatttatcatggtatgaagattgcaaggcagtatgatatttggggtgtttatcgtgataaactaaggcagcgtaggattccaatcagacctaagattgcaaggcagcatgattttggtgaaatttgggtggaatcggggtcgcagaaagctattgagtttgtgttagatggatgccctacatctgcatctacatctagatctagatcgctgcagcattgcttccctctctgtcctgaattgcaagctctgacctctgctactaatcacttttacttcttttgcagagcgagcaaggctgttgaatcgtttgccaaattcgggagtatattttcttcatcttgttaattaataaattcactttaaatttattcatttaattctttttttttcttttttcttttcttttcttttttttttttttttgcagaagttcgggaatctaaaggttttgaattttgacgcgtgtgaatttttaacagagatacctgacgtatctggtctcccaaatttggaggaactttcatttaatagttgtgggagtttaattacagttcaccactcaattggttttctaaataaacttgaaatcttgagtgctacgtgttgcagcaagcttaccacatttccacctctcaacttgacctctcttcgaagacttaaactttcagattgtgtcagtcttgagaattttccagaaatattaggagagatgaaaaacttatggatgcttaatttggataacattcacataaaagaattgccagtttcatttcaaaatcttgttggactgcaatttttattactgcataattgtgaaattgataggtttccaagtagcaatatcgtgatgcctcgactgtcttgtgtgtgggctgcatattgcaaggggtggccatgggttaaatcagaagagggtgaagaaaaagtgggttcaatagtatgttcaaatgtatgtgacttcagcttcagtggttgcaacctgtatgatgattttttttcaacaggtttcatgcagcttgatcatgtggaaactttatccctagtgaacaataatttcacattccttcctgaatgcttcaaagaatttcaatttttaagaagtcttgatgtgagtggttgcttgcatcttcaggaaattaggggggttccaccaaacttaaaagatttcagggcactagaatgtatatccttgtcttcctcaagttcaagcaagttgttaaatcaggtattgtcttgtttttaacgtatatgatttgataatatattccacacttgatgttaataaacttatgacatctttatgaaatatgactaacaggaattgcatgagtctggacaaactaagtattgttttccaggaacaactattccagagtggttcaatcaccaaagtaggggaccttcaagttctttctggtttcgtaatgaattccctgacaatgttctttgtcttcttaaagcacgtgtgggatatgaacttgattatctcatgcccacggtgttcatcaatggcaaacatcataaaattcactcttgtaacactctagtaagaaaggggaaattggattatacatatctatttgacctaaaatcagcatgtatgcatgatgatgtatttgaagtggctttagaaaaggaatggaaccatgtggaaattacatacgcaggtctcatagagccctcactggttaaagcaaccggaatccatgtattcagacaggatgatattctatatgatgattcttatggcaagagaaaattagaccatgatctcaacaattctgaatcacaaccacacattaaaaagcataggtatgtggataagcaagtttcataatcatcttatatatgaaaattatactgttaaattgtaatccatgtattcagacaggatgatattcgatatgatgatccttatggcaagagaaaaatagaccatgatctcaacagttctgaatcacaaccacccattaaaaagcataggtatgtagacaagcaagtttcataattatgttatatatgaaaattatacttttaaattgtaataaagtaaaaaataccaatattataaatataaagtcaacatatgagatggttggtagacgtggtgtgactgaagagaagatatagtaggttgttttgcaggatatggaggtgggttggccctgaaagaattagaaatcttctgtggaatgctgctgatggagctttaattactaatgcccttacttctaagaacttctcttgtcggcgatgtggcgtgttggaggagacatgtctgcatgctcttcgagattgttttgctgtgatagcgttttggagaagtgtgttacctaagcaattagcaccaaagttttttaaaggtgatgtaacagtgtggctggaaacaaatttatctttttcagaggcagcttttttttggccgactttttttgggattgcagtggaagtggtcttggaattgcgcaataaccgtgcgttctatcataaatacaatgtttacggttcccgtaatatgatgtatgttgtctttaagcgttataaagattttatgagagcccattcttctcacaatttgatgacgaggaatctcttgaagtggaggcggctcaaacttggtgaggattggttgttgaggctaagtgtgagtggtgcctttgatccctcttcaggtactgctgcatgcggaggtatattcatagacaggggttatagattcgtgcttgggtattgggttaaggttggggaatgttgctcaaaagatgaggctgaaatatggggtatttatcatggtatgaagattgcaaggcagtatgatatttggggtgtttatcgtgataaactaaggcagcgtaggattccaatcagacctaagattgcaaggcagcatgattttggtgaaatttgggtggaatcggggtcgcagaaagctattgagtttgtgttagatggatgccctacatctacatatagatggctgcagcattgtttccctctctgtcctgagttgcaagctctgacctctgctactaatcacttttactacatttgcagagagaacgggtatgctgaatcgtttgccaaattcggtttatccatgaaagagcaggctgcctctattttttctgagtggccctcatttttatgaaatctcctgtactgtatcaaaattttatatttttgtattttcaatttttatgtttgtaccaattcacttattttctgagaggccctcattctcttattttaatatttatatctcttatatctatgtgttaaaattcattatttttttttgacttttcttatatgtttattattattattattattattattttatatattgatttgaatttcttttatattttctcaaataaagtgtgtaactttttgtttcttatctcatattgttttataacatttttatcatattttacattgtaaaattatttattttttcgtttgggtctctaaaagatcattgatgttgcatcgaactgagtatccttatgtttgccaattgcaattgggcacgaaaacgttcaattgaaaacaacatttggctacatctccatcaacgttcactggatcagttagaggggtaagattttttatttttaatttcaacaacttcttccaacattacccactcaacaaccagcattaaaccataaatgcggtcatttttatttctaatattaattaaaatgtatttttatatgtacatattttaatatatttttttttgaaaacttgatatatttttattttataatgtaacaacaatttttaacaagatgtaataatatattatcaatttaagtatccatttttggtataaaaaaagagaaagataaaactaaattttctaataacttcccgtatgtatatttgtgaatataataagagatttataaaagggaagatttaggaagctttgattactaaataaataacttatctatgaatatttttctgtggtatgttttaattaaaaagtaatgaaataaatcatagtattatatttaaaattctattcaaacacttaatgtttaatttagtaattatataattaacttacttttcatccaaattatccaaacaagtttaattttgataaaagtacttttatttttataataaagtatctaaatatacaacaaattatatttaatttacttttatctaaactaaaaagttaaattacattttaaatttacaaactgtaattcaaacacatatcagttcaggaatctaagctccaaccacaatggacacattaccaaataagttggttgtaacccatgttttttttaattgttcatgaacgttttgaagtaaacatgaataatcaaattggtcgacaatcaaattataaaatataggatttgatatttttatataaattttaattttaatttttttattaatatatatatatatatatatagaatgataatatatattttaggttagttataattttgtattttaattaattttaaaatcattctgcttttcaattacagatcaattatttaattatattttttagttataattattatattttttcatattatgcattctacagttaatgttatattatatattaaaatattcgcaatgatgtttaaaataaattaaattaataatcttaaatagatattatatttttattgtgtcaattaacgtaataattaaaatatcttaaagtgtaatgttaaaataatataataaataatatggtattactcatactcgataagcctgtcaaaaatggtagaaacaaatataaatagtgtaatgtaaaataaatagtgcaagaaaaaaaatactttacttaaaaaaaggaaataaagagatttattaaatattttatgagtaagaaggaaataaatataaaaagataaaaattgtcattttgaaaattgtcatgaggtagcatctcaaattgttttcaaattattaaaaaaacttgtttgtcaaacactgtttataaagttaaacaaattttgtagttgttaaaacaattagaaactaactagaaatatttgtcaaacataaactaaaataatattttaggatcaaattatattgaccagtgtttcaaaaattataagtaacacgttagataagaagtagatctcataaaattttgtaatttttaataaatttaaattaattcatctccatttatgtgattgttgatgaaatgaatactctctgcttgtgaatgtttgttgggactttgttattattttatgatgttacattataaaattataactgatttttaacattacttttttgactctctttaataattggttttaagtgaattttaataataaaaaacctaaaataaaaaaaaaacagaagtaaaaaaatgtccaattaaattgtatttttgaattgaggttaaataaccttttctccttttgttgttttaaagaacttttagtacttataaaatgtgatatttttattttagttccttaaagatatattttattttaattcctgcaaatttaaaaatttaactttaatctctactcattgggaaatgtttatactcctagaacttggaaagaacttctaaatattccatatctaaagatagaatgaaattatttagttttagttatgcatctttattcttaaaacaaattatttgatgtagttgttaagagattagaagtgttattaggtaatttagactctttcacataagggatcatgattaggatatgttagcggatgaaggtaataattgtaataacgttaaatggtgaaaaatctctaccattgtatcaagagtagtttcggtaggtcaaacacttaacacgtccatgaaatcatgcatcaacaggcaattaacaccccaagcaaacatgttttgtctctttaatattctgcttaattatctttatttatgttgaattttacatttttcgcatcattactagataaatactgaatttagtcaattatctgcttaaaattagaaatatacaaactccaagtcgattagtcaaagtctttgtggacttgacactcaaacttactctagtaattactacttggatgctggatctgatgatggtgtcaacatggtagggattcatggaatgggcggggtaggaaaatcaacacttgctcgagctgtctataatgaattgataattgctgagaagtttgatggtttgtgttttcttgcaaaggtgagggaaaactcaaacaaacacgggttagaacacctccaaagaattcttctttcagaaataatcggagagaagaacatcaacttaacaagtaagcaacaaggaatttcaatcatacagtctaggctcaggggaaagaaggttctcttgattctagatgatgttgacacacacgagcaattacaagcaattgctggaagacctgactggtttggtcgcggcagcaaaatcatcatcacaactcgggacaaacaattgctagcatctcatgcagttaatgaaacatatgaggtgaaggaattgaatgagaaagatgctcttcagttgcttacatggaaagtttttaaaaaggaaaaagctgatccaacttatgtggaggccttgcatcgtgcagtaacttatgcttctggccttccattggctttggaagtaataggttcccacttgtttggaaaaagtgtagaagaatgggaatcttgcatcaaacaatatagctgaatgcatcaaagaattgcaatttttgttgctgtgttttatttgtttgtgcatgttttggcgattgagggatagagacgtgtgattatgtgcttatttatttatttgtaatggttgtgttcacattagtgctcagacggcctctactttaggttgtgccttttctaattgtttataacattttcttgtacgaagatctgaatttcaattaagattgccttaaaaaatgaatactcaggttttggtttaaatgcatgcaaggacaccctggacgtgtgaatttgctggttcttggtgaagttgaaaacacgtgtgatcagcaacaatgacattggctttgggacggctctagtagggaaaaagctcaagcgattggcagagctagatgatcaatttatatcaagagtgatgatatatagatattcataaatcataaatacctatttgatattatttttttacatgattgataattttttaattattaaattaaatgaatcctcgttgatgaggtatgtaatggacatgagatcatcctttggagagtgctgagtgcactgaatgcagcaagatagttgaaatcaatattttccgcgggaggtttagtcaatataaaaatgtaaaatatgcgaccatttgaaggacacttaattttctcattagtaaaaaaaaggaaatgctcataaaaaaatattaaaaagaagttaagaacaaaattaaatgtgtttaacttcttgaatagtgttagagggcaaggccatgcagaaaattcttcatcatgagaagtttagtgtcacgtgagataattcaggaatctggaagtgtctctagaaggagtgatcgaaattgaattgtgatggtgcatattctcgggcagccgatgttgcttcatgcggtgttgttctttgcactagtcgagtaggcaattttattcaaggaggcttggacattgctctatctatcctgaaagtggagcttttggccaactatttttgggattgcagtggaactgttgtgggaattcggcaatgaccctgagtcctatcttgttagccgttatgtttacaattcccgtgatatcaagtatattgtctataggcgttataaagattttatgagagcccatgcttctcagaatttgatgacgaggaatctcatgaagtggaggtggcccgaaattgatgaggattggttgttgaggctaaatgtgagtggtgtctttgatccctattctgtttctgctgcttgcggaggtatattcacagactacaaacgtacattcgtgcttgggtattgggttaaggttggggaatgttcatcaaaagatgaggctgaaatatggggtatttatcatggtatgaagattgcaaggcagtatgatatttggggtgtttatcgtgataaactaaggcagcgtaggattccaatcagacctaagattgcaaggcagcatgattttggtgaaatttgggtggaatcggggtagcagaaagctattgagtttgtgttagatggttgccctacaactacatctgcatctacatcgctgcagcattgcttccctctctgtcctgaattgcaagctctaacctctgctacaaatcacttatacttcatgtcgtctaatatttgggttggcgactatccaatctttagacagctggctgctaaatcgtttgccgaattcggtttatccattgaagagcaggctgcgtctattttttctgcttgtccctccttttgcaaaccttatgttcgggaaggattgtatgagttacattactttaaccattggctacttctccatcaaagtttgttggatccgttagaggggtaagtgttttttttcttaaaaaaaattcaacaacttcttccggcaattaaccctcaacatccaacataaaacccatgattgggttcatttctatttctaatattaatacattggttgtaacccatatttttttttattgttcaagaacgttttgaagtaaacatgaacagtcaaattagtcaacaatcaaattataaattataaaatataggattgatattttcatataaattttaattttattttattaatatatatatatatattgatagaatgataatatatattttaggttagttataattttattttctaattaattttaaaatcatttcacttttcaattacagatcaattatttaattatattttttagttataattattatactttttcatattatggattctactgttaattttatattatatgttaaaatatgcttattattgactgtggtaaacatatatgcgtttaattacaaataaatcataaatggtagtgaaatggagtgattaataacagggactccatgtgagctataatttgttagaagcttagctggttatcttcattctgttactgttgtattcaccttccactttcatgttcctagcacactagtacacaaaattaatcatccaatccaatacaatgacattccatttctacatcctctgttagagttctatgatctgtggtcacttatttccactttattttctttgtgaatatctttttttttttacttaattggagcaatgtgtaaatgatgaaagtaattttaatttgattcattttacctcctcaattcttcttattttcttttttttaaaagtgtttgttcaaaaccaaactagccctaaattgtctggcaaatggtaaagaattactattttttagtttgttcttactcattctatgatacaactttcttaatttttcttctttaattagttacattgcagcccttttgggtagtgaggccattgttgttactgatctgccagataggccgaggctaatgagaaagaacattgagatcaatatgaaacttacatgttctctgcagggttctgtaacagtaactgaactcacatgggcagaagatactgactcagaactcataccagatttcggtaataattatgttcctcaaccccttctcagctgacagctaagagctaatgacttgttggtgtgcggatacgtctattacttacgattcgtttgctagaaaagaaaatggaaagaaagaaaatagagagaaaaaaaaaatgaaacattttttatacttttttgagaaaaaataaaggcaaagttaatttttggataaaaaatttaacttttttctcctttttttcaatttaaatttaatttttttcttctccttctagccaaccaaacatagggtaaagtttttgttaataaggtaagcaaattacaagaaaaaaaatgaatttccaaaacattcatccgcgttatgtacgatatgtccgcgtacactttagtctattaatttcgaggaaatgctataaccaccaaaaaagaatagcaggaaaattgccagtaccaattaaatttggaccctgtctaactattgattaatttcaactttttaaaatgtttctcagtttagagagagaataattaagtaattatatgtagaaaaaaaataactaatatgtttagaaattagaaaagaattttataaaaaagataaataaattttaaaaaaagtcttataaataaagataaagaagtatattgactataaattaaagacattacgatcatgtttttttttcagggacaaaaagaagatacttttagcattgcgatcaaaagtataacatttatttagtattggaattgatttatattcataggtggaggaacttgtttatggagggtggtgggcgataaagatctaaaacccaagtgtaatagcatatttatttgataaatggatgataattttggaccctgattggtacaaaaatgcaaagtcaagcatcattatgagggaagacagctaaggaagggacacgcggcttgccattcttgagtacttaggctaaatttgagaaaataaaatttctttaatatattaaaataactaatatttgatttttaacaatttaattggacagaccatatttatttgtatcaaaggttttcacttttgaaaaagagagacgaaacagagatgaaacagagagacattttccataaagttaatacatatgtttggtactgagtgttattaacacttatctctttcatatttattcaagtttgattttggagaatccacattcatactaagatttcttatcatggctttgagatcaccttcctcttccttcaattacgatgtgttcctcagcttcagaggggaagacacacgtcatggttttactggccatctctacaacgctcttgatagcaagggaatccacactttcattgatgatgaggagcttcaaagaggagagcaaataacaccagcacttacgaaggcaattcaagagtccagacttgccatcactgtgctctctgaagactatgcttcttcctcgttttgtttagatgaacttgcaaccatccttcactgtcaccagaggaaacggttgtcggttataccggtcttttataaggtggatccttctgatgtgagacaccagaaaggaagttatggagaagcattggcaaagcttgagaggaggttccaggatgacccggagaagttgcaaaaatggaagatggctctgcagcaagtagctgacttgtctggctatcatttcaaagacgggtatacaaccatactaatctttttactttaaagtttttgttggattaacttttacttgtctgattatttgacattaaatctaaagggaaaataaatgcttgttgaccttggcaatatacgtatcaagacatggatacatgcaaggcttttagttttaacttgttaaaacttgttttgtttgaaacagagatgaatatgaatacaagtttattgagaagattgttgagcaggtgtctggggtgattaatctttgttgtcctttaaatgttgcggattacccagttggactaaagtcacaagtgctacatgtaaagatgcttttgaatgctggatctgatgatggtgtccacatgatagggattcatggaatgggtggggtaggaaaatcaacacttgctcgagctgtctataatgaattgatatttgctgaggagtttcatggtttgtgttttcttgcaaatgtgagggaaaactcaaacaaacacgggttagaacacctccaaaaagaccttctgtcagaaataatcggagagaacatcaacttaacaagtaaggaacaaggaatttcaatcataaagtctaggctcacgagaaagaaggttctcttgattctagatgatgttgacacacacgagcaattacaagcaattgctggaagacctgattggtttggtccaggcagcaaaatcatcatcacaactcggggcaaacacttgctaacatctcataaagttaataaaacatatgaggtgaaggaattgaatgcgaacgatgctcttcagttgcttacatggcatgcttttaaaaaggaaaaagctgatccaacttatgaggaggtcttgtgtcgtgcagtaacttatgcttctggccttccattggctttgaatataataggttcccacttgtttggaaaaagtatagaagaatgggaatcggccatcaaacaatataaaagaattcccaaccagaaaattctagaaaaacttaaagtaagttttgatgctttggaggaagaagagaaaagtgtttttcttgacattgcttgttgcttcaaaggacataaatcgaaagagcttgaacatatacttagttgtctttatgatgactgcatgaaacatcatattggggtgttggttgaaaaatctctaataaacgtttgggatggtgtagttaacatgcatgacttgattcaggacatgggcaggcgaattgaccaacaagaatcgtcaaaagagccagggaagcgaaggagattatggttaacaaaagatataattcaagttttagaagacaactcggtaagtgagagtatggtttcttattttgaactctttttttgttatcatatctttacttcatagtcaattttttcatgacaatttgtaaatttctttaaacacgtgacttgatttgttacatatatcttgtattgtggttgatttgtaccttttttcattaacagggatcttgtgaaattgaaatcatatgtgtggatttctcctccttatccgagaaagaagcaacagtcgaatggaatggaaacgccttcaaaaagatgaaaaaccttaaaatactcattattagatatggtcaattttccaaaggtcccaattattttccagaaagtttaagagtactggaatggcaccggtatccttctaattgtttaccgtctaattttcatccgaaggaacttgtcatatgcaagttacctcacagttgcattacgtcatttgggttccatggctcacggaaggcaagtttaaggagtatattttcttcatcttgttaattaataaatccactataaatttattcatttagttcttttttttttccttttttttgcagaagttcgggaatctaaaggttttgaaatttgacgagtctgaatttttaacagagatacctgacgtatctgatctcctaaatttggaggaactttcatttgatcggtgtgggaatttaattacagttcaccactcaattggttttctaaataaacttaaaatattgaatgcttatggttgcagcaagcttaccacatttccacctctcaacttgacctctcttgaaagtcttcaactttcagcatgttcgagtcttgagaaatttccagaaatattaggagagatgaaaaacttattgacgcttatgttgtttgaccttaacctaaaagaatggccagtttcatttcaaaatcttgttggactccaaattttatacctggctaattgtgaaattggttgctttccaagtagcattgtcgtgatgcctaaactgtctattgtgagggctagcaattgcaaggggtggcaatgggttaaatcagaaaagggtgaagaaaacgtgggctcaagagtatgttcaaatgtatatgaattcagtgtctatggttgcaacctgtatgatgatttcttttcaacaggtttcatgcagcttggtcatatggaaaatttatgcctaaggaacaataacttcacattccttcctgaatgcatcaaggaatttcaatttttaagaatccttaatgtgagtggttgctttcatcttcaggaaattaggggggttccaccaaacttaaaatatttcactgcaagagaatgtatatccttgtcttcctcgagttcaacaagcatgttgttaaatcaggtattgtcttgtttttaacgtatatatatgatttgataatatattgcacacttgatattagttaacttatgacatctttatgaaatatgactaacaggaattgcatgaggctggacaaactatgtttgggtttccaggagcaactattccagagtggttcaaacagaaaagtaggggaccttcaagttctttctggtttcgtaatgaattccctgacaatgttctttgtcttcttatagcacgtgtggaacgcacagatggatttgatattcccatgccccgggtgttcatcaatggcaaacttcatgaaaaatcctcttttaacactagcctaaaaaaggtgaaattctattatacatatctacttgacctaaaatcagcatttaggaatcctgataacaatctaagtgaagtggctttagaaagggaatggaaccatgtggaaattacatacgcaggtgtgatggagacctcactggttaaagcaaccggaatccatgtattgagacaggatgatattcgatatgatgatccttatggcaagacaaaattagaccatgatctcaacagttctgaatcacaaccactcattaaaaagcataggtatgtagacaagcaagtttcataattatgttatatatgaaaattatacttttaaattgtaataaagtaaaaaataccaatattataaatataaagtcaacatatgagatggtgtgactgaagagaagatatagtaggttgttttgcaggatatcgaggtgggttggccctgaaagaattagaaagcttctggggaaagctgcagatggagctttgattactaataccgaaaggagatataggcatctttctatggactcctcttgtccgcgatgtgggatgttggaggagacatgtctgcatgctcttcgtgattgtccagatgtggctgcgttttggagaagtgtgttacctgtgcaattacagccaatgttttttaaagttggtgtcacagtgtggctggaaacaaatttatctttttcagaggcagctgttttttggccaactttttttgggattgcagtggaactattgtgggaattgcacaatgaccttctgatttatggtggagactgttatgtcgagttccgttttatccagcgtactgtctttgagcgttatcaatgtattatgagtcgccatgcttctcacaatttgatgacgaggaatctcttgaagtggcggacgccccttactaaatgggattcgttgttgaggttacgtgtgagtggtgcatttgatccctcttctggtactgctgcatgcggaggtatattcagagactacgatgatagatacgtgcttgggtattcggttaaggttggggaatgttgctcaaaagatgaggctgaaatatggggtatttatcatggtatgaagattgcaaggcagtatgatatttgggctgtttatcgtgatcatctaaggcatgaatatgacattccaatccatcctaagattgcaaggctccagcatgattttggtaaaattggtgtggaatcggggtcgcagaaagctattgactttgtgttagatggatgccctacatctacatctgcatctacatctacatatacatccacatccacatctacatctacatctacatatacatcgctgcagcactgtttccctctctgtgctgagttggaagctctgacctctgctacatacttctcttggatgtgggaagagagcaaggctgctgaatggtttgccgaattcggtttatccatgaaagagcagtcgtctatttttgatgcttgtccccccttttacaaacgttttcctcctcggaaggaatggtaaaaagaaatagtgaaaaataattcattccaatcagtcctaagattgcaaggcagtatgattttggtaaaattggtgtgaaatcggggtcgcagaaagctattgagtttgtgttagagatggatgccctagatctacatctacatctgcatctacatctagatatagatcgctgcagcattgtttacctctgctactaatcccttatacttgtgttggggagagaacaaggctgctgaatcgttagccgaattcggtttatccatgaaagagcaggcgtctatttttgatgctgctccccccttttgcaaaccttttcttcctcggagtacatggaaaaactagtttcagtacccgttcattggatcagttagaggggtaggattttttaattttaacaacttcttccggcattaccctctcaacaaccaccattaaactcataaatgcgttcatttttatttctaatattaattcaaatgtatttttatatgtacatattttaataaatttttattattaacagtattgtctatcattcaaggtttattaacacattacttatccattcaaagtttagacttttatatagaatgactttttaagtggtcattaaactttaagaaattcttaattagatcattcattcatagttgtatgaatttttattttttcttttgaaaaatgaatttttatttgtatgtattattaattgtgcatgttttctataattttgtatttccctttgattaatttatttccgcataaacatacataggagttttttcaaacaatatgctttggattacataatgaggattttgtttcaaacaattaatatccctcattcaaaggatgttctaaaaagaaataatttcactgaaaataactttatcacaaaaataatttcttaaacagtcaatttcttttatcattcaaaaataaagtcaattttaatatttcgatacgaaatattacatatatatttaatgataattaaatattacttttacaatacatgtatctactattaaaaaaaattaaattcatctaacttaagagtaaaataacttattataaatttagatatgaataattttaggggtaacgatactttttaggataaaaaaaatgtacaacaaattttttgaaattcctgaataaaatttatctgcttactttttaattaatattcactagtattttttattgctaacaactagtattgggacccgtgcggacataggggtcacgcttcactacactctgctacatttttataaattaattttaatttttatatttaccataacaaaaaaatatttatatatgataatattgataaaataaattaacgtaattaactacgttattcttataactaataattaaattattattttacaataaatatagtaactaaaatgttattatgttggctatcgtaacaattgaattaaataaaagagtttaaaaatttcaaattttgattaaatttaaataataaaactataattttttttaatttatcaaaatttcaccattttattttacttttatttacccattatttgatatgacaaaaatttaaaaatgaatgatatatttaataaaaataaatattgtaaattgtttgacatgtaaatgtgtaaaatactgtaaaaaaaacattttcccatgacggtttactcatgatgacatagagaataattatctttcatacatgataattataatttcaaacattaaccaataaaattaaaacaaatttacaatatgatatagtgaataagtaattaaaagctgtcttataacaaaaatcatttttataatgaattattattttgatctctatcataaatatttttttatttatgatattattgataaagtaatttaaattaattaactttggttgtcttataacaaagaatcaaactattaatctttaataaatatattaactaatatcattatcttattatcgtaaaaaaagaattaaataaaaaatttaaaaattttaaatattcatttaatttaaatgataaaactaaaaaaattttgttttaaatgtcaaaatttaattttactattatttacacatttttcatatgttgaaatattaaaaacaaataataaatttaataaaaataaatacaattgattgtttgatatataaatgtgttaaaaaattttaataaaaaaatattctcataacggttaactcataatgacatatggaataattattttccataaatcataatcataatttctatccttaaaaaatgaatttaaaactaattcctattataatatagtgagtaagtaatttaaaactattttgtaacaaaatcacttttacaaattaattttagtttttatcgatataataattaatgataattttactaatgattgttgattatttgatatgtgactatgttaaatactttttgggaaaaaaattttccatgacagttgacccatgatgacatagagaataattaatgttggtaaatgataattgtaatttctaccataagaaaatgaaattaaaattaatttacattatgatatagttaataagtaatttaaagttttcttgtaacaaaaattatttttataaattaatttattttttatctctatcataactaaaaatatttttatttatgatattattcataaattaatttaaattaattaatttggttgtcttataacaaagaaacaaataattatatattattatgctggttataataacaattgaattaaataaaaagagtttaaaatttgaaattttgattaaatttatataataaaactataaatacttttattttttaaaatgtgactatttcattttattcttatttatttattttttatatcataaaaatttaaaaataaataatacattcaataaaaataaatattgttgatcgttttatatgtaattgtgttaaatacttctataaaaaatcttttccctacaacggttaaatcatgatgacccaaagaataattatttctagtcaatgataattatagttcctatgataaaaaaaatgaattaaaattaatttacattatgattatgatatagtgattaagtaatttaaaatttttttgtaacaaaaataatttatacaaattccttttaatttttatttctgtcataactaatcatatttttatttatgataatattgataaagtaatttaaattaattaactttagttatcctataacaaaaaataaaactatttttataataaatatattaactaaaggttattatgctaattatcataagaattgaattaagtaaaaattcaaaatattgattaaatttaaataatgaagctataatttttttaaatgtcactactttagtttatcatctatttaattgaaatttttttatcataggcaagctcaattttattaaactcaaatatgataatacaatgagtgtcaacgtgaagaataaaaaaatgtaaatatgttttttatttcttaaatatgatgtatgatctttttagtatctcaaattttaaattttttttatttcttaaaattgataattatttttttagtatttcatcacatatgacattaatataatatttttttgtagtccttatataatttctagggactaaaaataataattttaaagtaacaatattttgcaaagcttgttccactgtcacattatttggttaaaaaaaaaaatatgattcacagataccaacttacccgtgaatgaatgaagttatgacatcataaatgagaaacataatgaagaatttatataagattggtatttactatatagctagccccaatgatcataaaaacatgattggaatagtattataaataataaataaagtatgaatctctataatattaaatcaagtttatttggcatgattggaatttatccgatcactggccttgatagaggttcaaaacaaaaaataaatacacaaaaaataacatgaaatgcagaagctacatcctttatcacgcagaagttacatatgacagattccaaaacaccctcgatttcaaaatttgagttggatccagttagcctaaatcagaatgtccacaataacaggtcaatcactgtaaaataatagtatttgtgatattattgatttggttcattaaaataattaactttaatgatgttataacaaagaatcaaactattatttaataataaaaatattaaatagatattattatgttgctccgctatgctccgcatttttttaaaataattttaattttatatatatgataaataaaataatagtatttgtgatattattgatttggttcattaaaacaattaacaattaactttgatggtgttataacaaaaaatcaaactattatttaataataaaaatattaaatagatgttattacgctgctccgctactctccgcattttttaaaaatgattttaattttatatatatgataaataaaataatagtatttgtgatattattgatttagttaattaaaataattacctttgatggtgttataataaagaatcaaactattatttaataataaatatattaaatagatatgttgctccggtacactccgcattttttaaaatgattttaatttcatatatatgataaataaaataatagtatttgagatattattaattgcttcattaaaatgattaactttgatgatattataacaaagaatcaaattatctatactataataaatatattaaatagatgttattatgttgcttcactgctctccgcatcttttggtcattaaaacttttaagcttttaagtcagacataaaatattaattacttttggtcattaaaactttattttagtcctataagtttaattttttatttgctctcttataaaaaaatcatttgttattagtccctttgaaaaaatttaccaaagagtaaatacaaaattcgagtatttattagaaatcgaaaacatattttagccaattaagaaaaataaaacaatttcaagattggccagaaaagggtgaagctgtttcttggtacaaaatttgtagctttcgtttgccaagtcaaaacctgactcaacagaacaaaatgatggtgctcaatagcttagaatatctcaatagctttgcatctctatcatatgataggagctcaattaaataaagttatctgtatgtcctaataaactgattcatgattgatggaatgttaataggaaaaagaaatcgaagcctctgataagaaatcgaagtttctaattggtctatacagttattacagttaaatgatttggcgtaaccaagatacattgtggaagtacaaggttgtaggatatgatgatcctttgcatttggacaattcacaattgctatcaactcagtttttgtttcggaactttttagaggatcatttatattaggaatcagtaatactttgtcatgtgatataatgtcacaatatcaataatataattaaatgttccttgaaaatccttggcagtttgtttagttcttgcctagaagaaatcggagatggaaatggttttagtagacacgctttttagttccaaaatgcatcatcactttgctaagatcagctgcttttaagattagaaaaaaaaaaaaaaaactgagaagattgaggttttctcatgaggaattctgtttatcttgaaggaccaattaatatagagtataaatttattttcatgacttgtagaacatacttggtttggttacttaagatttgttgtggtgtggagcattgattcttttctgtccatgattttacaatataaactctgatttaccctgttatgactgacaacattaacatagagcctcatgaaaataactcaaattttattataagccatacatatttggtttcaaagtagactatataggctgagtttagagaacatcaaaatataacgtaatgcataggtgccctataatatcacttccatgcttcaagcatagacctcagggtttgccacaagataggcatccactaccttgaggagagccaaaccttcctcccttgcagccttgaaatcctcctctttgacatcaacccctgctttgggatgatacttgctgacattcttcatcttgcaacctccctcttcggtggcctcgaacttaacctcatgtgcaattgaatccactttttccagtgcaccatccccctcgatcactgcatagctgtaatttttttttgtagttactttggatttgttcagcattggcctcttcaggttagtttttgtttttgtgtatatttttttacatattggtaatttatattattaatttttattatatttttttatttatgtagtttttggttgttaaatattatttatattggcgatttaaaatattaggtttgagaatatttaagattagtttataattacttaatcagaggatacatgaaatataagagttttttttgttaaaatgcttcatttaaaatattttaataaatttaatttataggaaccttattcaaattaagtgtataatatagttggtaaatataatttgtaagatacaaatttattaaaattaattatatgttatagttgataaatatatattacttatgtagttgttttgtgttaaatagtatttatttggaacatttaaaacatgaggctaatttttttcattttttatttatattttgtatgaattggtaatttatatttgatttaaaatatatttttgatttatgtagtttttgatttttcatttgattttaaaattttatcataaatataatttgatggtttatattttaattttgtaataaattgttaatttattaaaaatacatgtttcgaaatttttgttgtgtgtatatttttaatttatacaggtacttatttacgagcaaatttgttacctgtcagatccacagatttcgctattgggtaaagctgattatgttgaccagtaattggctgccaagtcagctaatggaatccgctgcggtgacttgcgaactcttctccgtggcagtttgacaatttttccttacggcctggcactttcacatttagtttcttcaattgtggccttttgacgcttgtctcgcaagtgtttgatcttatcacctccattgaaggcattaccaataatgatctctttgttagtcatttcagtttgaaacctaccaaaagatatacggcattatggttagaatatatttagaaaacgaaatctttaggacataaaggtgaaaactaatgactggtgagctttacctcacatggtatgagaaattattatatgatctagaacaaccatgtgcctataatctcaattaatctgcacttgacatgtaaccaagtttttaaatttacgaaaaagagttaataaaactcgtagtgagaataagagaataacaagtctaataaaaaatgaccaaaacaataatacagtcaaacttgaaatttgaaaatggaacaacttgtagtgagtatttaaaaaaattcaactcaagtacttaatataaataaaacacgtgtaagagaattcataccacaagtagttcacgtagtccaaggggtgcagttacaatgtatgacacatctgggtgttcctttgctgcctctgcacttaaggaaggaatatcctgcataatagtggagtttaaatttttttgcctattttctatcttcataagtcaaagaatcattttgacaatttatagaaaagtaggagagaattctatgcagacctacctgactccaatgcctcccaggaaagagaaaaaagggactaacaataatgcaatgagcaccttgttaaacgcaagattgaaaagcatctcttattgatggttctgctaattcctgtaaatgtaaaatacaattatgaagcatcaagaatttgctccatagctacaattctctcatgaaatgaaaaggcaaagacatggctagatgcacaaagaaaattgtgttactaaaattgttatttctgccagccaaatctagattccaggtcagaccgggaaataaagggtaagcagctcaactatatttcctcatgaaggaaaatcatgtattattgtgcatgccaaacaacccaaggaaaatgcaaagaatcctaaaataatgccagacttgctcacatgctcgcaagttcttttttaagacccaggaagctttatccttaaattgaggcaagagatggcaaatagcctataggctgtagcagctcaagtatgaagtatctacctaccatcattcagatttcatttttcatcttcatatggtctttgggcacttgacatgatgaaaatctcaacagattacagaaattaccatatgagcaggctccacaatttcatacccagttgtatgcttaaacatctccacaaattcatctgacattcaaaaccagataacttttagacataaaatttaattatgccctagtaaccaattttaaaaaactcatctgtgaaagtaaactcatcagcttggggatgaggtttggagcatcaaggaccaaagccttgaacaaccttcctggctggacagtgctagtaaactcagtggtgaaagtaaaaacctacatgttaagtttggagtaaaatacaagatatggctagaaaattaagtatagagagcacttcgaattgcagtgatgtgagatatcagagatgtgtgtacttatgattgaagaggataaataagcaattaatgttacatttgacaatatttcaacaaacaaccactattgtgaaatggaccatccccttgcatgccttattaattccatatttccaatgaaagtctttgtttcctttacctatgtaaacatctaatcaaacaatgcaacctgtgagcctattactcctaatctatgcagtgataatacaaatcacacacattgtaggctaattaataatatactctggtctgtttttttaaactacttcgaaagctttgaagtctataatttaatttttctgtcagtactaaaaccttagggtctagctaatcacaacaaatgtgtatttatgagattctttttaatgaaaactttcaaatttttatttcgtaatctttggtctgaagctgaggagtgaagaatccaaacctgggagaagtcaagaagaagctgcagatgctgcgaagcaaggagaagcaacaaacgaacattgtttcattttataattttgctaaaacagaggtcagaaaaattcccaataaaactgataagagtgtaaatgttgaacataaagcagaaccatgaaacattaaaaaattgaaagttaaaatattaaaaacaaaaaagataaaaggaaatacaaagtatgagctatacaaagtatggattaaatatactattaggagtcaaattaacaaaaacattattattgtgtgtaacatcatttagcctgtaaattgaaatgggcaatgaactactgttcaagaattttttttggaagcaagtgttgatcacaaaactagtttggttataaaaaaaataatttatacttttgctcctatctttattataagatttaattaattatatcattagaattaattaaggaaataggttgatttttagttgagagcattaaatttattctaaatttatatttttttcaaaactatcccattgagaaaactaataaatattaataggtttcattgttacaccagtactctaaaattgaatttaattaaagattttttttaaagaaataactaatgcaaaagacaatttagattgattatataaaggatcgaattacacttttaaattggaataacaatttgtataacatttttgtatatttatctcttttacacattatttattacattttataatgatagatataaacacacacaaaatgttatacgaactgttatataaattacatactgcatatattacatctcataataaaacttgaacaaacttttctctgtttcttacattttcaatgtgtgtaccacttccacacatttattttccattgcaaaagaattggcctggcaaagtaaatcttttgctttgatactaaatttgagtcaatcattctccaaccttcaaaagcagttgataaacgtaaccaaattaacattaaagactcgttaagcaaaattaaaagagaaaactgtaaaatgcgtatttaaataaaatggagttttattttcgtacatggttaatctagagattttacattatatatcaactaataaaaaattgtcttaattataactttttaaagtaattaatacaaaaatccacaatgttactatatttgtacatgttcatgatagataaaaaatatttatactgtcgatgcattttaattaaatatatgaaaataatattacatgtttaataggagaaaagagtgggaagatttacattcatgaatacggtttaacagtatattattgcaactcatcaaatgtatcgctttcataataatttactcttatgttctgtttaactttgaaacttgagtatagatgaaaagaaattatccaaaaaagttgtcacagtcacacatgaaatacctctttataatgcatcaaacagtttcaaccaaagcccgtcgcaacctccctttactttctttggcacgttcaaaggacgtactgcatggtgtcaacatgtggaacaatatacaaacagagatagaaaaagatgtccattaatgatagcaacataaattgacgcttccatcaaataatattaaaagacatcacagaagaaaatcttattataaaatatgaaaataattttaagaactaatatatatatatatataatcatttggatgaacaagatatctctttgtcgaaagtttagaaataatcaagcataatactaaggtcgatgtaagaaattgatctttttcaataatacagagttaagaataaaattcatgattatatatttaaaagattaaattatctactaaccatgtttgcacattgatagtatctatatatataatcatagtattaatgaataaattaacgaaagtcatttacattacctgcaacgttgtggtacgctccaagtaagatttgactgttttttgtcaatttcagacaatgacatatacttcttccaatcctcaagcaaaattttaagatcattgactttgttgtctatgccaacacaacaattggcatgcattgttgagaccttgttgaagtccttgctaggctcacaaaaccctccaaaatagttagtgctaaggaacctaatcttcagcttcatgtgggaaattaaggggtgtattttgatcttgttgaacacagcctgctcacccaaccctgggtactctttgctagagttgaaccagaacttattaaaccaaatagttcggttattcgattttatatatttaaaccctccatttggatagttgtgtatgtcagaggagttgccattgaaagcatcacaagctatttggaaatctgcatcttcataaaattgcttgaagggatctctaagccacattatatcagtatcctgcaaaggaaaacaaagaaaaacaaaccctttaacttgcagttggcttgtgtggtagagtatgtgcattgtaaagatcttaagaagctttttttttttttttgcaacagaaagacatgtataattgtatatatatatatataatatatataccgtgaacacaaagttatatcccatctcaagaacagaggtgaggaattcagttcttctccacatcatgtgtaggtatgttggggtcatgaaaaatacttcaccggtgaaattggcatgcacctttagtttcaacttggtaacaatgtttgtgcaaagcaaggcaataagcatttgtcttttggtcccaagttattaccaccatgtgatttaaaagccattgtgtctcattccctaggcgaaaactctccagaaagaggtcaaatatggaacctggctttgcccatgtgatatgcatccagcatatggtcctttccaagcttttcaaagccaaaatcattgataaacagcttagaattgcatatgatcatgatagttgtcgatgatttcgttatttttaagtgtcatgctaattggaacataattgcagcaggaaaacacttcattcaagccaattttgagaagttcaggtcacccacgccccaagcttgaagacgcacgctccaggcgtgggaaggagcttagtttggcaattatgactggaagtccacgccccaggcgtggggagccacgccccaggcatgggaaaaggcctccatcactgattcttgctgccaagccacgccccaggcgtgggactctgctatctgtgcaatttcgaagctaatgaagggcagtcttggattttcacttcctacttcataaataccctcttcctcagacttgaacacacgattttggagggagaagacactattctagggtttagaagctttgggcactcttagtctaaggttggaggttgaagaccaaggtggggttcctccttcatcttcttccttcttgcttcagctaggaatgttcctttttgtaactcaaccacccattatgaggtgtggctgagcatttattgtggttagggccaaagcacttaatgtaaatctttattggatgtattgaatgctattgttcatttattacaagttattttactacactttgcatttctcttccttctcttgcctagacttagctaacctagttaagagcttagagctttagttcacaatagacatattgggactttagtttctgacctaagtgtggtaacttgctaacattgcctagacataggggtgggtgcttgcaactttactcatttatgtgtttgcttaatgcttaacttgcttaagatcactaagagattagggttggatggtaggttaaagaactaagtggaagagacatcaaagcttagtcaacataaggaaaacacattggttgaataacttggataatagaacgtagtgttcaatatcatttcatagagaggcacattgagtgtgggttgccctagctacatttccttacacatcgttattttctcacttgctttgatattaatttccgcttgtttttagttataatttccttccatcgattcacacacacacaaccacaacattacttcattattttggtatccaacttatcgatcgaaattatagtctatttggccaaacaatcctcgttgggaacgacaaatccctttcttccactttattacttgagcgaccggtgcacttgccgtgaacgcaacaagtttttggcgccgttgccggggattgttttagccaaattcattataactttttatccttaagattggacttattttgtttctaacctgcttccagagtatatgcgaggtactgttagccctgaccatcttcagtttgatcctgaaatcgagaaaaccgcaaggaggaatcgaaggctaacaagactaagaaaggaagcagaggggtctagttctcaacctcaagaagaagaaatatttgaagaggaactagacatggctgagaacaaccgtgagcagccaaggccagaggacgaattaatggagaacattcttgctccattgtttgtccgtccagctcccagcatagtgaggccaccgattcaagctcatcatttcgacatccacccatctcttatcagcttggtggagaagaatcaattcggtggtgaggatgatgaggatcctcacagctttgctgatcatttcatgatgatttgcgacaccatccgccatcagggagttacagatgatgccattcgactccgtctctttccattcgccttgaaaggaaaagcactcaggtggttacaacgtcaaccatcaaatagcataaccacttgggatgagttgatggcaagattcttcgctgaatacttctctatggagaagtataatcgtttggtgaatgagatcaccaactttacacagcgagaaagagagactctgtgtgcggcatggaagaggttccaagagttgatccgactttgtcctcaatatgacatgtcggttgggaagaaggtgcgaatcttcttcaatggtttgttgcctgaatccaaattggtgattaacggagcagctggaggaaccatcagatcaaagaccgctacccaaacatatgaattgattgattccttggcacgaaccgaaaatgaaagcttggcaagtcagccgaagagggaagtcattcatttgggtagcacggatgcaatgttggctgagcaaaaactcctatcacagcagctagctatcctcaatgctaagattgacaagcttgaagtctcaaaagcccaagcttcatcgatcaaggcaagcacagctgtatgtgaatattgccaaggggaccacgagtctaatgtgtgtccaaccttagtgggggctgatccaattcaagtcaatggggtatggtatgaccaaaggccaccacaaggttaccaaagaaactataatcaagcttctgggagcggaagcaactatccgagaagaccatatgggagtggtttggattacaagtccaacaattacttacaaccacctcccatccctcccaaagaaccatcggagcttgagaaagctatgttgcaattggccaagaccaccaataaccacatacaaaatactgatgcttttatgaatgagactaggtctcagttgaagaatcaaggagcttctatcaggaatttggagacacaaattggccaaatctcaaggcaactagctgagagaccaccaggccaattccctagtgatactgttgtcaatcctagggaacatgctaaggccatcactactaggagtggcattgttattgctccaaaggagaaggttcaagtggtaccaagagaagaggagaaggggattccacacgccaatgcagaaattgaaaattctgcagtagaaattgaaaattctgcagaatttgagaattctgctacatcagaggttcctcacaacctcaaggagcaggagaagaagaagggaaaggagaaagccacatctgagtctaaaccacctctggatttttccagatttgagaagcctccctatcccttgaggacgaagcagcaaaatcaaaaaaagcagtatgccaacactactacagcaagcattttttacgtcaccaaatctaagtcggttgtaatatagccgatgttaaatcaagttcagtggcaaaatcataataaattgtattttgtttgatagacaacgtcgggttttaagtgaccgtagttgttctttaagaaacgaagtcggtttgcaaaataaccgacttagaaaggattaacatttaaaaaaaaagattaaatttttatttgttttaaaaaaacctagtcggttttctttagcaccgtcgttgtattatgccttggcaaagtcggttttaattttaaccgactatgaatttaataatacaatttttttttaaaaaaaagtaagtaaaataaaacctattataagttggcccttttcccccggatgccctaaaagctcaaacgtgcccgtgccccttcgacctaagctcaagagttggtgttcaccactgaagcctcaaagcccccttcgacgccgcgattgatcaaaaattacgactattgcatcctcaaaggtaagttttaacttgtattcttcagatattgcggattccttcatcgtcattattgttgtttgattttatttgcagaagctggttcgaagagtgtaggttggccaccccgacaacgaatatcaacatcagtgccgacggcgagtggtttcgccatgtagtctgccgcaagtgacaagaggtcagggatccctggagctagggttcacctttcattcgaactcctgttggagtcagacgggttcatttgcaggtaacattctacacttagctgctcatctggcacttcaattgaaagcattgtccagttttagagcaaccattgaaatgcaaagataggtcgcatggttcaagctaggtcaatgttttttatttttaatatcttaactacaaacagtaattcgcaagtcatttcatacacacacagtaattctctgcaaataaaaatgaagataaaacagatcagagaagtaaaaagagatgaactcatgctgccaaaacttcaccatcctaaaagtgaaagaaaaaaactaattaagacctcattcggtgttgcaatgcatgatgtaagattgcattacacaacattaaatacattatatatatatatatatatatatatatatagcagctgcatccatttcctcgaaatatagtaaaacaataaaaagatttaattcaatcagttaaacatgatgtattataaacagactttaattcctatgatcaaacaaaaaatatagtaaagcaagaccttactaaatcataaattcactccttttgtacgatgctaattaatctacactaacttttagttttccccaatctaaatagttgatacttgtggtccagactaaatagtctatctaaagcaccttctttaatgatgacttaaaatcttcttcatattcaagttaaaatagagaaaaagatatattataactggttttcattttgatttgcttaatcataaatcatcagatgataaatatttcagtggtccaactagcagaaatcaaccaaactcttgactgattccaagatgaaccttccttattatttcatactaataaaaaatattgtaccaaattttaattagtgtaaggccatttcgaagagtacatagcaggcagtttcactaaaaatatatcaggagctacatgctatagactatagactatatagagtatatagtatagaccccaggaaaaagatctgttgggccaataataaagcatttataaattgtgagaagggtatgactctgataaattatatattaagatagacaaagtagcagaatgcgagtaaagttaatggtggatccaacccatttgagtttgttccaaaccacacacattattgtcatcttacacttcaagtctacctatttccctcatgccaccgtctctcacttttcttagtgtcccaatgctttctctttctgaactgtgtgaaaagggagtactttgcagccactttggggaaaaatatttccccaatgtggatgtggctttctcaacttttagtacaaaccctctagtttcctactgccgtgaatgattagtggaaggagatttggggaagatccctgtgcatgtttattactttaatctgaatagtttactataaaaatgtttgtagagctcattcttttttacatgaaccaattataaaatgagatatagttagctgtatagtgtatatattccaaccatgacctttcaccaaaagttttttttttttttttaaggatccccaaatgttttagtaatagattaatcaccattcatatgcatataaataggaactaccccccttcttcttctggggcctaaagagaaaggctatgccaaaataaacacatacacaccaactcttatataattactttagtttctcttttattccatgattatttcacatattatgtaccaaccaattagggttgttttgacaagtgtggaattaagcaagaagtttctcaatttatcagacaaaatctctctacgcgtttgaggtttttttatgtcaccgctgaggtgagagtttagtgattcaattgattaaccagctaatttttgtgcatggattattattattgtttcactttcatgaaaaaaccaaagactattgtcatttttaacaatcattataaaatcaagtctggccaagacggttatggtcttgatgctattttgatgtattatcgtcaagaaaatgatgggtcggggaccatgaattgtttcatcaatgaattgcctacctcgtgtcaaattctgtggtcaagaaaatgttggattatatatatatatatctcacaaattggcaaggaaaataaagtcctcctcggtgccttaattaggtggtagcattggcgtagcagaagggattgagagaagagttttggtaggattgggaaaagggttgggactcaataggcatagaagagggcaaaggagagaaagggaaggaagagggtggtgtcatgttggggttggtcaaggaaaggtttctggtataagaagatgggattgtttgggaggtgtttgtggcggtgcttgttgctgaacaaacttgcacaggctttcttgaacggtttctgcctctgtgcatgtgtctttcacagtacttggagtctggatatgcctcctttgagcatctccatttcttgccatctgttcttctgcacctccctggctctgggtctacttttctgccaaatcccatttcaaaacatccccacccaactgcagccagagaattatgacaacaaaccaggctctaaattttatttgtccctcataaaaagtagacatatataataataacaactagtgtattttatttttttttaaaaaaaacagaaaattatccatggccttaaaaaaacatgagtaacatgctagcaaaagcacttactgtcttacttggatgatgtgggaagagccttgaagaaattgaagtgtctacatttcttttaatagagtagatgagatctggtgggataggtgttcctgtaaccatgtacttaaaaacaagagcttgatgctcaagctcttgccactgagtttgcgtgaaaggagacctatttcttgcacttgcactcatcattttgagacaacaaaaacaaggaagagtgtgtgtctctctctaaaatagtggtgaagtgaagaacaacaagatataagatttcaaagagtgaaataaagactaaagagggtttaattttatttctctagatggggtgatagtaatttggactttggagggtcattttttttttcaagggtagatagagattcttctcctgtgcatggataacactaatggctctgagagtctgatgatgctttctggctttgctgccacctcctctctatttctctaatgtgctggatgatgggtgagtgagtgagtctgctcttataatgattgcacctctgtcgcttctgttttttcctctgcaattgccttggttgctgcccttgtctctaacatctttacagaaatccataaacaaatgtacaaaggaaaagaagaaaaattaaattcaaatgcatgttagtccatgcacctttggttttgctgtctccccatcacttcatggaaaacagtgtcatgccatccggttatgtgaagtgtaagctgcttagcaatagtggccattagtatatcaaattatcaatctctctttgcaatggtagtaactttttgaatgaaagtctcgtacgtgtcactttttaatcttttttggcttcaagcatgcgtggcgttatctcattgatagatttggaggccaaggctagagctgaatcctgctttttttggccactgattgatgctttctcctttttttcatttcaccccccaaaacccaaacatctcactttcatcagtggaattagggttacagtcaatttggcctttaactcttattgaccaccgtcttgtcaataggccatcataaccctttacatgtttctccttaatcattttcatgaccacaaaatgtcaaaaccaatattcatcaaacattatggtaattgaaaaacacagaatttcaatgtatcttttcatgcttgagttagagttttaactcaatgataatcggaataatgaatgttttctaagatgaaggtctaataatgtgtttgaatttacagtgaaaagtttaaagtcaggtgaaataattaaatgcctgaagataattatttatccttttttacatgtatttttaataatattatttaaattaaatatgattattttaaatgataaaattattttttcgaacattttaaatattcaggacttgaatccaaaataacttattaagttataataatttcatataaattaatccatattcgtgataataaaattggaattgattatgaaaaaaaaaatctaattcaaacactattttactttgtctttcgaaaaatttgaattgatgttgacaaaaataaagtcaaattaaacatgtcataattataatttagaaagcaacaatcaaaatatttcagataccgcatctgaatttctcgcaattaaaaatcccaaagaaatgattaactgtaacaatgattattcagcagtttaaacttcacactcccaactttttggcaactaaccacaataaaaaatgatagtgtattctatgtaattagaagtttagaatgacttacaaatagaacaattcaagtcaagcacaatgataaattaatcatgtcttcggagactccaatgcatgttcaaattaaaaatcagtcaagttaggattatgcaagcaatacacacatagttgtaattttaatgttatcataatttactattaatattaatatctatattgggttgattgaattaattggatatgaaactcataaattcaatatccagcctaattattattggataagttaaaataaacccaattcatctttctaatccaatccaattctgaaatgttatttagataggtagagtttatcagatttccaggtcgattcataccagtctacacccctgttatttgcatttattcccatattttcacagttttaaagatggcgacatcaccataacttaatacactttttttattatatgtaattcattgttggttaaagttgtatcaatattttgaattcttttccatggaaaaactaaactttagcatattctttgatggtgagatcgagacccattctagccggcatttgaagaaagaaaaaatatcttcaattctttgaccttaattatctcccaaggtgcgattttcagattttgcaatgagatttattattgtttcagtttatatagaattatatactaagtttctcttacattagaatatttttattttaatacctattatataagaaaaattagaaatgttttccaattcctattagtcacattattactcaactagaaatattgatgtcatagattaaaatgaaaaaaaaaaatattaaggaccaaaacagacaaacaaattttaaaaaaccaaggcgaaaaccattatatatttttgtcgcgtgatttgaatgttctcattattaaaattgtgtaagcaaaagttttcccaacattctctgttgatatactttttttgattttttaaagcatatactttaaatgataagaattcaaagaggtgaatggaaaatcttataaaaagccaaagaaaaaacgacttatcttttagttcatatattaaagttgcaacatcaattttttttatgatctacttaattgcatcacaattacaatagatgttaggggcacgagtaagtcagatttggtctattttatgatccaacctaataaaatagaattgagttcggttgggtcaaatttgttctcttttgtaaacaacccaaagcaaatctagctgtttaaggttagtttgggtagtttttcttttagtatgacaataaggtaagattacaaatgagtaaagagggtgcctcattcatatgcagcataagtatgaattatggcctctggacactaggagaaaacagtaaagacatgttgagatgaagagcctttctttactagaaaatctccatagaaattccttctcgcatagtgtgttgaaactttaattgtcaaagcatttgccattgtaaatgacaaataatttcacattcatatttgttgtaaaacctggacactcttctttttttttttttgtgttcttttcttgttgaaatatattttcttttcttattgtgatttgttaaaatctgttctgtcatagggtatgtgggatgttacttgcacccaatgcctgattcaatattgttcttcaaatcaaattacttatgtccaaattatacatcgctaccattttgcatctcacttaaaacgaatggcagttgttgtttgcattcaagattttttttcctttgtgaatgtttgtgggttgctcatttgtttagcagctatatatgcctttggatacatgcatgtttcccaattaggtccttcttgatttaagttgcttcttaggtattatgtactttgccttatagttaatgaatccatgagttgaggtttagacttcataacactctgtagtatcatatattttaggggttatggaatgctcaataatataagtgagttaggaagaagcaaaaatgatttgtaaatttttgtgcgaatctgtcagaacttcgatggctttgctagaaatctaagatgaaggtctgagttgtttcagctgttttgtatcttgaccagtactccttgtactgtttctatatatatatatatatatatatatatatatatatatatctatttttgctgatcaaaaaaaaaaaaagaagctattagggtaaccaattcccattaggattgtggacaaagaaacaagggtgagaagttgcaaaaagtagtggtattggccttctagtcccatgtgatccctagagtgaaggtggatgagaagaaattgttgtgcaaaagctatggctcctaacaaatgagttaactgatattgagctttggagcataattgtcaagaactatggcaaaggtgggatagaccaagaaggacatagccatggaggagtgttgaaagttgtggacatgatctgagggaatggatccatcagggttgaatggatggtgacaatccggagagatgaagagctccaaggcaatgaagattgtgcagcttgttattatgaagttgagctgcaagtatctagattttgtggtgggaaaccataggcttgatgtatgttaggtactggtacagaaaagaaaagagaacgaaagttttattcaccacacacttcttgcttacactgtcacttcgagggtcaccacctcctaaagaattccctcccctgatcccctctcagtgatcccctttatacatttctctctcccctgttagttataactaactcaacttagttatactaacaattaaattgctatctaaaccctctttcataagtttgaccccacctcctatcaatgtaggacttggaacaaagggcgtggagcttgatgtgcttgaacaagtgccataaaccaattacaaagaagccaaaccccaaaacttgatgtccctccaacatagtgcctgttaggccaacacaataaaaagaaacttaggttatgtttcgatcgataatagttaggaaaatgttttgtttagtcagtaaaaagtaaataaatataatgaatttataataattcacacattgtattcaaccaattaaataatatacatttacttgatacaaaaaaatacttttaagaatttcaatatatatttcaaatatatatttgggaataaaagtattttcaaatttttccgacaaaaataatctaaacatgtacttagttgtacttagctggtattcttgtcccacagcctgctcacccaaccctgggtactctttgctagagttgaaccagaacttgttaaaccaaatagttcggttattcgattttatatatttaaaccctccatttggatagttgtgtatgtcagaggagttgccattgaaagcatcacaagctatttggaaatctgcatcttcataaaattgcttgaagggatctctaagccacattatatcagtatcctgcaaaggaaaacaaagaaaaacaaaccctttaacttgcagttggcttgtgtggtagagtgtgtgcattgtaaagatcttaagaagctttttttttttttttttttgcaacagaaatacatgtataattgtatatatatatatatatataatatataccgtgaacacaaagttatatcccatctcaagaacagaggtgaggaattcagttcttctccacatcatgtgtaggtatgttggggtcatgaaaaatacttcaccggtgaaattggcacctttagtttcaacttggtaacaatgtttgtgcaaagcaaggcaataagcatttgtcttttggtcccaagttattaccaccatgtgatttaaaagccattgtgtctcattccctaggcgaaaactctccagaaagaggtcaaatatggaacctggctttgtccatgcatcgtttaaagttgtgattatcactgtcttatccttcatagacgcggttctaagaacactctctagcttcgattcataactaacctgacgcataaagccaaaactacatcaaacacttggtaacccaagttcatattcacagatgaaattttcatgagacaaatgcaaagttaagattaacaaataacaactagtttgccatatgcttgtcaaaaagataaaatagtacaatcccttagtgcaaaagcatcaagtgtgcaagaaatcaaattatctgagatttatgtaacaaataataatccacaatggttagaaaaaatccaaaaaaaaaagggcaaaagttgcaagacatcaaataggaagtgaaaagtaagtgatgtacacaaacttctaaacatcaatataacaaaatggtaccctccatttacatatataacaacaagactagtgacacatatagctattttgggtgaaaattgtatacaaattctacatttgtagtgacctccaagtcctcataattatgcaaagtatatatacaaatacagaatggtagcagacagtgtgaaattagcacgtaaattatcattattgatcatggcatccacaaaagaataacatctccaaaaggaaaatgcatatttattctttttccagttatgcatcaataatcaaacaattaatgcatcaataatatcagaaatcaaaggaactaatattataatttaaacaattaaataacataattaactaagtacatttccaccaaaagaaaaacctaaggtacgtttattctcatataaatgctgataattcaaaaacttacatgcaacggggaatcagacataaccgatcaagtagagaaaatttgttgtcgctatcttaaattacgaaaccagaatgtcaatgtcaatagttgaagtttgtgaatgtttgttcattaataaatgattttcttcaatgtgttatttaatttcgaattgattagctgtcccacgtcggatgaacttctttcttgagcatccttgaaagcttatatatatatatatatatatataagaaacttaagtaaggctttaagatctatcccatttatcttataatagctttcattgttttttctctaagagaaaaattcggagaaaaaatatagttttcctatgaggtcttttaagtattttattttcttatttttaaaagagattgttaatatatattctctcattgtattttaaagagaggtcatgcaatctctttcagatggtgaaaatctcttatattcttatatgtgggttttccacgtcacgttgttactcaaatacccaaataatacaacccacttggtcaatatagtcaatattttggtatatagtattgtttcaatatacagtatactatccacggtgtggatattgttcacgattactacgcacatgttctttagcagagattgtcaacgcacaccatattaacttgttatagtattgtatatacagttgaaaaattattttgtgttaattaaaggaaggtggaagttaaggcattaggataagaattacaagagaattaaggatgacaaccaatacgatttactatagaatttattctcgtgcgctgagctcgtttccattaagctggaattttatccattatgaatattttttacaagtacttataggatttagtaaactgtcatccctagacaataatataaactaaataattcattcttgacttttcaactaactgaccaagagagtttatatatgactttcttaggacttcaataggacttgcttaatcagtcaatttcctaattcatagaattttaaaactatcttaattgatctgattgtgacctactttccaaaatcaaactaactcaaaagcttgatcacagaatttgatttttaatcaagtttttcactaaaattattctttgaaggagtggaaatccaagatattctcatgaaaaaacaaattatatatatatatatgtataatttgattctttctggaagtaattactaacaacactttttaatttgattcttataaataagaaagggaagtacgtttatgaaaatgataaaaatgtcatttcatttttatttggttgattgcttttaagaatttacccaaaaaaagaattattcttttaaaagaaagatttttttatccatttgcatttttccataaactaaaatcatattaattcctaaaaatatctctttattcagtttcttatttttaaaggtttcttattaaataaaactaggttaaatttataaaaaaaaacaatataatgtctttgtaataatttaaaaaagtgtatcattaagaataaaatcataacgaggatcccataaaaaagtaaaatagataaagcacacgtcaattaccgagtggaataatatatatatatatatatattatatatatataagaaataaactattatataatttaaactttgtgaaagaaccaaattaaaagaaaaaatattttactgaaattaaaatatttagattatgaaaatgctaacatcaattattagggttgataatttttaattttaaaaattattttctaattatataaaaaaattggaaccggacttggatctttaataaggaagatttcagatttgagatggaaaaaattgttactaaaataagagacattgaagatagcaattatagatacttacaacactaacaaaggtgactaaaaaaataccaatatcaggagagagaaaaaaacaacaaaaagaatgaaatattagctctaactttgttttgaaaaaaattaccgtaaataaatatattggaaaaaatagcataacaacgtaacccacaaagcataaatatattgaagaataatccaatatgacccacaaaagcaaaaaagcttgatcaacccaaatcagaagcaagcttgaacgcaagagcaataacaaaagcatcaaaaccaaaaattcaactttttgattggtttgcaagataaataagcaaaggccaacacccagattcactcatttcattctcctctattttcaccacgataattgcaattgcaaaaggcaacttggcatgcacagactcacacaaacacacacatatatagtatagatagatagaataaatagagagagagaaagagagagagagagagagagagactcacctttgttgactgagctgtgaagtaatgtgagaaggtatggaattcaatggaagaggcagagttagagagaaacacccacaacacagcaagcccagcaatgaacatggttaattgcatcacccttctcaccaaaagctggtagctaccggaaccccatgccttgatgccaccggcattctccaccgcagaggtgtccttcttcatgttgtttcaagagctgatcaattgggttgcaaaaatagtctctctttgactattcttaaagaacttgcttctactttgtttcttcttcaacaaaacagcaactaatatggttgtactttttaagatacgttattgtttgactgcattcacaataactgttaatctattattacttttatatatctttcaagtatatattgtaaatcaatcttttatgtaaggtaaattaatacaatttatattatttcatacgtaccattaattgttgtgtattaattgttgtgtcttgtataataataaaaaaatcttcatcatatataaaacttcgttgtgattaatgctactgttttgatattaaataagttggttatttgtttaatctttatataataaaaaaggaaatttgaacacacttttttccatccagaaacactttagacatttttttagttattttttttaacaatagctcaattagagtgtgaatctcaattaagaacacttgagctttttttaacatttctcttgtacgaagatgtgaatctcaattaagattgccttcaaaaatgaatactcaggttttggtttaagtgaaaggacaccctggacgtgagaatttgctagttcttggtgaagttgaaaacacgtgtgatcagcaacaatgacattggctttggacggctctagtagggtaaaagctcaagcgattggcagagctagatgatcaatttatatcaagagtgatgatatatagatattcataaatcataaatacctatttgatatatttttttacatgattgataattttattattaaattacatgaatgctcgttgatgaggtatgtaatggacatgagatcatcctttggagagtgctgagtgcactgaatgcaacaagatagttgaaatcaatatttttccgcgtgagtttagtcaagccaaagggcatgcagatgaaagagtttttcctatcactaggctgcaattgcatacttttggtgtaacctatttactaagtattaatttactatatgtattaaaaacatgtcttctttttataaaataaatgccctctttaatacacatgtcacggttatgtactttatgttatgtactttattttttctcgccaaaagaatctctgaaagtttaccttgtttaaaatcctgataaaagcaggtatccattagcttgtgatcatgtcctaagtccaaccacaagtaattactattagcaaacaactcttaattggcacaagataaatggtctggacaatgcttcattgagttccaagtactaaatgcatgtacatggtaggcataaaattaaagttattacttcgtcttgcatttattacttacgagcaattcacgcaaaaaaaattctggtcaacttgcaacatctcatgcatacatcatatgatttatttttaatagctgatcttataaaataaataaatatatatataaaacgtaaaacacaccctattgtcgatatcctctatagtcaatcaaacttaataatcaacaagtcattcgtccaaccctttactatatgttcaggagttaaatcttgactggcaaaatgtaaattaaattagtcaaaataagtaaatatcgtttttatttaatttaattaggtaaaaatataaaaatgttaaatatgcgaccatttgaaggacacttaattttctcattagtaaagaaaaggaaatgctcttaaaaaaatattaaaaagaagttaagaacaaaattaaatgtgtttaacttcttgaatagtgttagagggcaaggccatgcagaaaattcttcatcatgagaagtttagtgtcacgtgagataattcaggaatctggaagtgtctcttgaaggagtggtcgaaattgaattgtgatggtgcatattctcgggcagccgatgttgcttcatgcggtgttgttctttgcactagtcgagtaggcaattttattcaaggaggcttggacattgctctatctattctgaaagtggagctgttggccaactatttttgggattgcagtggaactgttgtgggaattccgcaatgaccctgagtcctatctt

SEQ ID NO: 41 - DNA, 2515428 bp, Glycine tomentella; identical to SEQ ID NO: 2
  misc_feature (2518)..(2998): n is a, c, g, or t
  misc_feature (36286)..(36599): n is a, c, g, or t
  misc_feature (36872)..(36881): n is a, c, g, or t
  misc_feature (65098)..(65189): n is a, c, g, or t
  misc_feature (91979)..(92044): n is a, c, g, or t
  misc_feature (103399)..(103465): n is a, c, g, or t
  misc_feature (108489)..(108498): n is a, c, g, or t
  misc_feature (109073)..(109082): n is a, c, g, or t
  misc_feature (110439)..(110448): n is a, c, g, or t
  misc_feature (114969)..(115015): n is a, c, g, or t
  misc_feature (117523)..(117532): n is a, c, g, or t
  misc_feature (119983)..(120104): n is a, c, g, or t
  misc_feature (147407)..(147539): n is a, c, g, or t
  misc_feature (148147)..(148147): n is a, c, g, or t
  misc_feature (148448)..(148543): n is a, c, g, or t
  misc_feature (151690)..(151746): n is a, c, g, or t
  misc_feature (152026)..(152272): n is a, c, g, or t
  misc_feature (155219)..(155271): n is a, c, g, or t
  misc_feature (160392)..(160454): n is a, c, g, or t
  misc_feature (171648)..(171859): n is a, c, g, or t
  misc_feature (177208)..(177279): n is a, c, g, or t
  misc_feature (178199)..(178208): n is a, c, g, or t
  misc_feature (191490)..(191619): n is a, c, g, or t
  misc_feature (194974)..(194974): n is a, c, g, or t
  misc_feature (196069)..(196069): n is a, c, g, or t
  misc_feature (196368)..(196600): n is a, c, g, or t
  misc_feature (208015)..(208015): n is a, c, g, or t
  misc_feature (212728)..(212812): n is a, c, g, or t
  misc_feature (213179)..(213270): n is a, c, g, or t
  misc_feature (233294)..(233303): n is a, c, g, or t
  misc_feature (252827)..(252827): n is a, c, g, or t
  misc_feature (259658)..(259791): n is a, c, g, or t
  misc_feature (262066)..(262133): n is a, c, g, or t
  misc_feature (262439)..(262704): n is a, c, g, or t
  misc_feature (269209)..(269218): n is a, c, g, or t
  misc_feature (270030)..(270039): n is a, c, g, or t
  misc_feature (270849)..(270858): n is a, c, g, or t
  misc_feature (271823)..(271844): n is a, c, g, or t
  misc_feature (277888)..(277935): n is a, c, g, or t
  misc_feature (278275)..(278284): n is a, c, g, or t
  misc_feature (278614)..(278630): n is a, c, g, or t
  misc_feature (283365)..(283365): n is a, c, g, or t
  misc_feature (292154)..(292154): n is a, c, g, or t
  misc_feature (294898)..(295033): n is a, c, g, or t
  misc_feature (303145)..(303509): n is a, c, g, or t
  misc_feature (327149)..(327149): n is a, c, g, or t
  misc_feature (345182)..(345191): n is a, c, g, or t
  misc_feature (345689)..(345698): n is a, c, g, or t
  misc_feature (347234)..(347243): n is a, c, g, or t
  misc_feature (354646)..(354974): n is a, c, g, or t
  misc_feature (355279)..(355288): n is a, c, g, or t
  misc_feature (366049)..(366049): n is a, c, g, or t
  misc_feature (387264)..(396263): n is a, c, g, or t
  misc_feature (401298)..(401307): n is a, c, g, or t
  misc_feature (404653)..(404702): n is a, c, g, or t
  misc_feature (411793)..(411845): n is a, c, g, or t
  misc_feature (414129)..(414129): n is a, c, g, or t
  misc_feature (424879)..(425053): n is a, c, g, or t
  misc_feature (436381)..(436381): n is a, c, g, or t
  misc_feature (438890)..(439012): n is a, c, g, or t
  misc_feature (445443)..(445813): n is a, c, g, or t
  misc_feature (446434)..(446520): n is a, c, g, or t
  misc_feature (448528)..(448528): n is a, c, g, or t
  misc_feature (449746)..(449755): n is a, c, g, or t
  misc_feature (451579)..(451618): n is a, c, g, or t
  misc_feature (451827)..(453537): n is a, c, g, or t
  misc_feature (453971)..(454045): n is a, c, g, or t
  misc_feature (454682)..(454729): n is a, c, g, or t
  misc_feature (454995)..(455028): n is a, c, g, or t
  misc_feature (458579)..(458801): n is a, c, g, or t
  misc_feature (471895)..(471896): n is a, c, g, or t
  misc_feature (473644)..(473695): n is a, c, g, or t
  misc_feature (475540)..(475549): n is a, c, g, or t
  misc_feature (476056)..(476297): n is a, c, g, or t
  misc_feature (476716)..(481095): n is a, c, g, or t
  misc_feature (483544)..(483583): n is a, c, g, or t
  misc_feature (494682)..(497556): n is a, c, g, or t
  misc_feature (500976)..(501680): n is a, c, g, or t
  misc_feature (509293)..(509775): n is a, c, g, or t
  misc_feature (510125)..(510134): n is a, c, g, or t
  misc_feature (511429)..(511438): n is a, c, g, or t
  misc_feature (512071)..(512080): n is a, c, g, or t
  misc_feature (520829)..(520829): n is a, c, g, or t
  misc_feature (535872)..(535872): n is a, c, g, or t
  misc_feature (548634)..(548716): n is a, c, g, or t
  misc_feature (550234)..(550445): n is a, c, g, or t
  misc_feature (556363)..(556825): n is a, c, g, or t
  misc_feature (561399)..(561399): n is a, c, g, or t
  misc_feature (563228)..(563396): n is a, c, g, or t
  misc_feature (569719)..(569972): n is a, c, g, or t
  misc_feature (571088)..(571199): n is a, c, g, or t
  misc_feature (571558)..(571610): n is a, c, g, or t
  misc_feature (574171)..(574171): n is a, c, g, or t
  misc_feature (582944)..(582946): n is a, c, g, or t
  misc_feature (584002)..(584056): n is a, c, g, or t
  misc_feature (595096)..(595105): n is a, c, g, or t
  misc_feature (598699)..(598791): n is a, c, g, or t
  misc_feature (599080)..(599089): n is a, c, g, or t
  misc_feature (601036)..(601036): n is a, c, g, or t
  misc_feature (603263)..(603301): n is a, c, g, or t
  misc_feature (605068)..(605725): n is a, c, g, or t
  misc_feature (612683)..(612791): n is a, c, g, or t
  misc_feature (613113)..(613122): n is a, c, g, or t
  misc_feature (624207)..(624794): n is a, c, g, or t
  misc_feature (627447)..(636305): n is a, c, g, or t
  misc_feature (637524)..(637692): n is a, c, g, or t
  misc_feature (643932)..(644116): n is a, c, g, or t
  misc_feature (646255)..(646264): n is a, c, g, or t
  misc_feature (655076)..(655353): n is a, c, g, or t
  misc_feature (655764)..(655773): n is a, c, g, or t
  misc_feature (664924)..(665368): n is a, c, g, or t
  misc_feature (665811)..(665897): n is a, c, g, or t
  misc_feature (684898)..(684955): n is a, c, g, or t
  misc_feature (686088)..(686097): n is a, c, g, or t
  misc_feature (686785)..(686794): n is a, c, g, or t
  misc_feature (687013)..(687452): n is a, c, g, or t
  misc_feature (696202)..(696211): n is a, c, g, or t
  misc_feature (697137)..(697146): n is a, c, g, or t
  misc_feature (697505)..(697530): n is a, c, g, or t
  misc_feature (698828)..(699334): n is a, c, g, or t
  misc_feature (700134)..(700134): n is a, c, g, or t
  misc_feature (701663)..(701779): n is a, c, g, or t
  misc_feature (705994)..(706003): n is a, c, g, or t
  misc_feature (706275)..(706284): n is a, c, g, or t
  misc_feature (706554)..(706740): n is a, c, g, or t
  misc_feature (739616)..(739625): n is a, c, g, or t
  misc_feature (739984)..(739993): n is a, c, g, or t
  misc_feature (740772)..(740781): n is a, c, g, or t
  misc_feature (747267)..(747725): n is a, c, g, or t
  misc_feature (748024)..(748033): n is a, c, g, or t
  misc_feature (751823)..(751832): n is a, c, g, or t
  misc_feature (752158)..(752167): n is a, c, g, or t
  misc_feature (754755)..(755332): n is a, c, g, or t
  misc_feature (761790)..(761799): n is a, c, g, or t
  misc_feature (770075)..(773141): n is a, c, g, or t
  misc_feature (781173)..(781238): n is a, c, g, or t
  misc_feature (788556)..(788556): n is a, c, g, or t
  misc_feature (798961)..(799024): n is a, c, g, or t
  misc_feature (799264)..(799264): n is a, c, g, or t
  misc_feature (803059)..(803645): n is a, c, g, or t
  misc_feature (806342)..(806500): n is a, c, g, or t
  misc_feature (807057)..(807057): n is a, c, g, or t
  misc_feature (809594)..(810292): n is a, c, g, or t
  misc_feature (810583)..(810645): n is a, c, g, or t
  misc_feature (819075)..(819099): n is a, c, g, or t
  misc_feature (819525)..(819534): n is a, c, g, or t
  misc_feature (823746)..(823746): n is a, c, g, or t
  misc_feature (831993)..(831993): n is a, c, g, or t
  misc_feature (839444)..(840159): n is a, c, g, or t
  misc_feature (860764)..(860764): n is a, c, g, or t
  misc_feature (874264)..(874670): n is a, c, g, or t
  misc_feature (874982)..(874991): n is a, c, g, or t
  misc_feature (875486)..(875495): n is a, c, g, or t
  misc_feature (880231)..(880231): n is a, c, g, or t
  misc_feature (892030)..(892205): n is a, c, g, or t
  misc_feature (900420)..(900439): n is a, c, g, or t
  misc_feature (905126)..(905135): n is a, c, g, or t
  misc_feature (917837)..(917857): n is a, c, g, or t
  misc_feature (918415)..(918483): n is a, c, g, or t
  misc_feature (919195)..(919698): n is a, c, g, or t
  misc_feature (929819)..(931166): n is a, c, g, or t
  misc_feature (936309)..(936309): n is a, c, g, or t
  misc_feature (937617)..(937679): n is a, c, g, or t
  misc_feature (938166)..(938202): n is a, c, g, or t
  misc_feature (948999)..(948999): n is a, c, g, or t
  misc_feature (955232)..(955301): n is a, c, g, or t
  misc_feature (957017)..(957452): n is a, c, g, or t
  misc_feature (957755)..(957764): n is a, c, g, or t
  misc_feature (963372)..(964799): n is a, c, g, or t
  misc_feature (975972)..(975972): n is a, c, g, or t
  misc_feature (980684)..(980776): n is a, c, g, or t
  misc_feature (984316)..(984467): n is a, c, g, or t
  misc_feature (984667)..(985013): n is a, c, g, or t
  misc_feature (985138)..(985404): n is a, c, g, or t
  misc_feature (985808)..(985808): n is a, c, g, or t
  misc_feature (1017314)..(1017402): n is a, c, g, or t
  misc_feature (1021845)..(1021845): n is a, c, g, or t
  misc_feature (1037120)..(1037214): n is a, c, g, or t
  misc_feature (1041307)..(1042192): n is a, c, g, or t
  misc_feature (1043052)..(1043061): n is a, c, g, or t
  misc_feature (1061729)..(1062991): n is a, c, g, or t
  misc_feature (1064770)..(1065153): n is a, c, g, or t
  misc_feature (1065481)..(1065490): n is a, c, g, or t
  misc_feature (1068350)..(1068358): n is a, c, g, or t
  misc_feature (1070628)..(1070664): n is a, c, g, or t
  misc_feature (1073221)..(1073383): n is a, c, g, or t
  misc_feature (1073735)..(1073744): n is a, c, g, or t
  misc_feature (1082661)..(1082682): n is a, c, g, or t
  misc_feature (1083652)..(1083936): n is a, c, g, or t
  misc_feature (1084301)..(1084344): n is a, c, g, or t
  misc_feature (1084663)..(1084672): n is a, c, g, or t
  misc_feature (1087587)..(1087596): n is a, c, g, or t
  misc_feature (1088480)..(1088489): n is a, c, g, or t
  misc_feature (1100633)..(1100693): n is a, c, g, or t
  misc_feature (1103210)..(1103222): n is a, c, g, or t
  misc_feature (1103976)..(1104499): n is a, c, g, or t
  misc_feature (1108036)..(1108083): n is a, c, g, or t
  misc_feature (1108391)..(1108391): n is a, c, g, or t
  misc_feature (1121455)..(1121455): n is a, c, g, or t
  misc_feature (1131796)..(1131956): n is a, c, g, or t
  misc_feature (1139540)..(1139850): n is a, c, g, or t
  misc_feature (1141715)..(1141715): n is a, c, g, or t
  misc_feature (1153053)..(1153141): n is a, c, g, or t
  misc_feature (1158773)..(1158797): n is a, c, g, or t
  misc_feature (1159432)..(1159557): n is a, c, g, or t
  misc_feature (1162619)..(1162739): n is a, c, g, or t
  misc_feature (1163190)..(1163199): n is a, c, g, or t
  misc_feature (1166327)..(1166327): n is a, c, g, or t
  misc_feature (1171052)..(1171076): n is a, c, g, or t
  misc_feature (1171386)..(1171412): n is a, c, g, or t
  misc_feature (1188088)..(1188121): n is a, c, g, or t
  misc_feature (1188873)..(1188917): n is a, c, g, or t
  misc_feature (1190220)..(1194815): n is a, c, g, or t
  misc_feature (1195112)..(1195121): n is a, c, g, or t
  misc_feature (1210221)..(1210724): n is a, c, g, or t
  misc_feature (1221116)..(1221723): n is a, c, g, or t
  misc_feature (1246582)..(1246600): n is a, c, g, or t
  misc_feature (1247090)..(1247160): n is a, c, g, or t
  misc_feature (1252322)..(1252399): n is a, c, g, or t
  misc_feature (1255587)..(1255722): n is a, c, g, or t
  misc_feature (1256438)..(1256447): n is a, c, g, or t
  misc_feature (1264054)..(1264141): n is a, c, g, or t
  misc_feature (1264542)..(1264551): n is a, c, g, or t
  misc_feature (1265445)..(1265445): n is a, c, g, or t
  misc_feature (1270155)..(1270164): n is a, c, g, or t
  misc_feature (1270726)..(1270735): n is a, c, g, or t
  misc_feature (1276069)..(1276088): n is a, c, g, or t
  misc_feature (1285115)..(1285115): n is a, c, g, or t
  misc_feature (1292752)..(1292761): n is a, c, g, or t
  misc_feature (1293343)..(1293352): n is a, c, g, or t
  misc_feature (1296972)..(1296981): n is a, c, g, or t
  misc_feature (1297588)..(1297597): n is a, c, g, or t
  misc_feature (1301879)..(1301888): n is a, c, g, or t
  misc_feature (1302658)..(1302667): n is a, c, g, or t
  misc_feature (1315014)..(1315160): n is a, c, g, or t
  misc_feature (1318709)..(1318990): n is a, c, g, or t
  misc_feature (1319334)..(1319757): n is a, c, g, or t
  misc_feature (1321767)..(1321837): n is a, c, g, or t
  misc_feature (1324303)..(1324656): n is a, c, g, or t
  misc_feature (1327754)..(1327769): n is a, c, g, or t
  misc_feature (1348460)..(1348627): n is a, c, g, or t
  misc_feature (1353754)..(1354201): n is a, c, g, or t
  misc_feature (1354501)..(1354543): n is a, c, g, or t
  misc_feature (1361377)..(1370010): n is a, c, g, or t
  misc_feature (1373811)..(1374519): n is a, c, g, or t
  misc_feature (1404036)..(1404553): n is a, c, g, or t
  misc_feature (1408650)..(1408745): n is a, c, g, or t
  misc_feature (1413613)..(1413642): n is a, c, g, or t
  misc_feature (1418003)..(1418003): n is a, c, g, or t
  misc_feature (1422061)..(1422070): n is a, c, g, or t
  misc_feature (1435965)..(1435974): n is a, c, g, or t
  misc_feature (1436939)..(1436939): n is a, c, g, or t
  misc_feature (1442212)..(1442221): n is a, c, g, or t
  misc_feature (1466149)..(1466756): n is a, c, g, or t
  misc_feature (1488168)..(1488729): n is a, c, g, or t
  misc_feature (1489174)..(1489183): n is a, c, g, or t
  misc_feature (1494640)..(1494771): n is a, c, g, or t
  misc_feature (1495169)..(1495178): n is a, c, g, or t
  misc_feature (1496562)..(1497374): n is a, c, g, or t
  misc_feature (1501256)..(1501256): n is a, c, g, or t
  misc_feature (1519233)..(1519331): n is a, c, g, or t
  misc_feature (1530876)..(1531672): n is a, c, g, or t
  misc_feature (1539501)..(1539510): n is a, c, g, or t
  misc_feature (1550168)..(1550188): n is a, c, g, or t
  misc_feature (1559883)..(1559892): n is a, c, g, or t
  misc_feature (1560261)..(1560270): n is a, c, g, or t
  misc_feature (1560602)..(1560695): n is a, c, g, or t
  misc_feature (1568183)..(1568192): n is a, c, g, or t
  misc_feature (1575847)..(1575847): n is a, c, g, or t
  misc_feature (1580103)..(1580103): n is a, c, g, or t
  misc_feature (1581680)..(1581790): n is a, c, g, or t
  misc_feature (1582461)..(1582543): n is a, c, g, or t
  misc_feature (1598249)..(1598481): n is a, c, g, or t
  misc_feature (1615304)..(1615306): n is a, c, g, or t
  misc_feature (1620936)..(1620976): n is a, c, g, or t
  misc_feature (1622376)..(1622440): n is a, c, g, or t
  misc_feature (1623858)..(1626107): n is a, c, g, or t
  misc_feature (1639782)..(1639810): n is a, c, g, or t
  misc_feature (1657914)..(1657978): n is a, c, g, or t
  misc_feature (1658123)..(1658961): n is a, c, g, or t
  misc_feature (1662215)..(1662290): n is a, c, g, or t
  misc_feature (1662660)..(1662669): n is a, c, g, or t
  misc_feature (1666740)..(1666813): n is a, c, g, or t
  misc_feature (1671811)..(1672574): n is a, c, g, or t
  misc_feature (1673048)..(1673065): n is a, c, g, or t
  misc_feature (1674791)..(1674800): n is a, c, g, or t
  misc_feature (1675163)..(1675172): n is a, c, g, or t
  misc_feature (1678279)..(1678404): n is a, c, g, or t
  misc_feature (1678859)..(1678899): n is a, c, g, or t
  misc_feature (1684450)..(1685029): n is a, c, g, or t
  misc_feature (1690393)..(1691192): n is a, c, g, or t
  misc_feature (1698905)..(1698905): n is a, c, g, or t
  misc_feature (1713749)..(1713758): n is a, c, g, or t
  misc_feature (1714429)..(1714438): n is a, c, g, or t
  misc_feature (1721212)..(1721719): n is a, c, g, or t
  misc_feature (1722067)..(1722269): n is a, c, g, or t
  misc_feature (1733874)..(1733908): n is a, c, g, or t
  misc_feature (1743304)..(1743899): n is a, c, g, or t
  misc_feature (1744231)..(1744265): n is a, c, g, or t
  misc_feature (1748110)..(1748890): n is a, c, g, or t
  misc_feature (1759134)..(1759143): n is a, c, g, or t
  misc_feature (1762830)..(1762889): n is a, c, g, or t
  misc_feature (1771366)..(1771373): n is a, c, g, or t
  misc_feature (1775112)..(1775509): n is a, c, g, or t
  misc_feature (1782687)..(1783942): n is a, c, g, or t
  misc_feature (1792376)..(1792451): n is a, c, g, or t
  misc_feature (1802175)..(1802222): n is a, c, g, or t
  misc_feature (1803101)..(1803115): n is a, c, g, or t
  misc_feature (1804607)..(1804627): n is a, c, g, or t
  misc_feature (1807679)..(1807679): n is a, c, g, or t
  misc_feature (1815540)..(1816276): n is a, c, g, or t
  misc_feature (1816730)..(1816739): n is a, c, g, or t
  misc_feature (1831257)..(1831321): n is a, c, g, or t
  misc_feature (1840114)..(1840183): n is a, c, g, or t
  misc_feature (1841183)..(1841192): n is a, c, g, or t
  misc_feature (1853078)..(1853247): n is a, c, g, or t
  misc_feature (1866798)..(1866807): n is a, c, g, or t
  misc_feature (1867100)..(1867109): n is a, c, g, or t
  misc_feature (1867744)..(1867800): n is a, c, g, or t
  misc_feature (1868124)..(1868163): n is a, c, g, or t
  misc_feature (1872772)..(1872781): n is a, c, g, or t
  misc_feature (1876847)..(1877364): n is a, c, g, or t
  misc_feature (1880122)..(1880122): n is a, c, g, or t
  misc_feature (1885134)..(1888261): n is a, c, g, or t
  misc_feature (1908210)..(1908210): n is a, c, g, or t
  misc_feature (1917391)..(1917806): n is a, c, g, or t
  misc_feature (1938336)..(1943444): n is a, c, g, or t
  misc_feature (1943733)..(1943742): n is a, c, g, or t
  misc_feature (1965086)..(1965095): n is a, c, g, or t
  misc_feature (1965460)..(1965469): n is a, c, g, or t
  misc_feature (1972085)..(1972791): n is a, c, g, or t
  misc_feature (1973111)..(1973122): n is a, c, g, or t
  misc_feature (1974857)..(1974935): n is a, c, g, or t
  misc_feature (1975220)..(1976196): n is a, c, g, or t
  misc_feature (1977813)..(1977865): n is a, c, g, or t
  misc_feature (1978144)..(1978215): n is a, c, g, or t
  misc_feature (1988350)..(1988667): n is a, c, g, or t
  misc_feature (1992044)..(1992053): n is a, c, g, or t
  misc_feature (1992564)..(1992575): n is a, c, g, or t
  misc_feature (1993922)..(1993931): n is a, c, g, or t
  misc_feature (1998316)..(2001666): n is a, c, g, or t
  misc_feature (2007006)..(2007034): n is a, c, g, or t
  misc_feature (2022891)..(2022963): n is a, c, g, or t
  misc_feature (2023545)..(2023545): n is a, c, g, or t
  misc_feature (2030200)..(2030333): n is a, c, g, or t
  misc_feature (2033148)..(2033157): n is a, c, g, or t
  misc_feature (2033672)..(2034130): n is a, c, g, or t
  misc_feature (2040204)..(2040649): n is a, c, g, or t
  misc_feature (2040932)..(2040941): n is a, c, g, or t
  misc_feature (2043444)..(2043444): n is a, c, g, or t
  misc_feature (2044607)..(2044616): n is a, c, g, or t
  misc_feature (2044965)..(2044965): n is a, c, g, or t
  misc_feature (2045720)..(2046417): n is a, c, g, or t
  misc_feature (2048728)..(2048737): n is a, c, g, or t
  misc_feature (2054225)..(2054315): n is a, c, g, or t
  misc_feature (2055747)..(2056110): n is a, c, g, or t
  misc_feature (2060336)..(2062932): n is a, c, g, or t
  misc_feature (2064549)..(2068059): n is a, c, g, or t
  misc_feature (2071944)..(2074388): n is a, c, g, or t
  misc_feature (2077276)..(2077285): n is a, c, g, or t
  misc_feature (2077776)..(2077785): n is a, c, g, or t
  misc_feature (2079822)..(2079963): n is a, c, g, or t
  misc_feature (2099994)..(2100087): n is a, c, g, or t
  misc_feature (2101621)..(2101621): n is a, c, g, or t
  misc_feature (2111187)..(2111214): n is a, c, g, or t
  misc_feature (2128572)..(2129569): n is a, c, g, or t
  misc_feature (2129891)..(2129900): n is a, c, g, or t
  misc_feature (2136592)..(2136865): n is a, c, g, or t
  misc_feature (2137405)..(2137414): n is a, c, g, or t
  misc_feature (2142352)..(2142967): n is a, c, g, or t
  misc_feature (2152571)..(2152611): n is a, c, g, or t
  misc_feature (2162035)..(2162044): n is a, c, g, or t
  misc_feature (2162420)..(2162429): n is a, c, g, or t
  misc_feature (2168678)..(2168687): n is a, c, g, or t
  misc_feature (2168965)..(2168974): n is a, c, g, or t
  misc_feature (2170448)..(2170528): n is a, c, g, or t
  misc_feature (2172418)..(2172450): n is a, c, g, or t
  misc_feature (2175858)..(2176004): n is a, c, g, or t
  misc_feature (2176822)..(2178287): n is a, c, g, or t
  misc_feature (2183532)..(2183533): n is a, c, g, or t
  misc_feature (2192827)..(2192836): n is a, c, g, or t
  misc_feature (2193136)..(2193193): n is a, c, g, or t
  misc_feature (2226691)..(2226701): n is a, c, g, or t
  misc_feature (2228677)..(2228844): n is a, c, g, or t
  misc_feature (2230490)..(2230490): n is a, c, g, or t
  misc_feature (2236754)..(2236902): n is a, c, g, or t
  misc_feature (2237173)..(2237182): n is a, c, g, or t
  misc_feature (2242420)..(2242420): n is a, c, g, or t
  misc_feature (2244111)..(2245118): n is a, c, g, or t
  misc_feature (2258246)..(2258284): n is a, c, g, or t
  misc_feature (2262189)..(2262198): n is a, c, g, or t
  misc_feature (2262472)..(2262481): n is a, c, g, or t
  misc_feature (2266513)..(2266701): n is a, c, g, or t
  misc_feature (2272669)..(2272678): n is a, c, g, or t
  misc_feature (2298575)..(2298993): n is a, c, g, or t
  misc_feature (2299347)..(2299359): n is a, c, g, or t
  misc_feature (2307329)..(2307440): n is a, c, g, or t
  misc_feature (2307847)..(2307856): n is a, c, g, or t
  misc_feature (2308269)..(2308278): n is a, c, g, or t
  misc_feature (2323624)..(2324477): n is a, c, g, or t
  misc_feature (2335007)..(2335040): n is a, c, g, or t
  misc_feature (2350282)..(2350318): n is a, c, g, or t
  misc_feature (2369126)..(2369670): n is a, c, g, or t
  misc_feature (2381400)..(2381716): n is a, c, g, or t
  misc_feature (2392901)..(2392930): n is a, c, g, or t
  misc_feature (2402695)..(2402695): n is a, c, g, or t
  misc_feature (2411490)..(2411775): n is a, c, g, or t
  misc_feature (2431281)..(2435739): n is a, c, g, or t
  misc_feature (2445436)..(2449828): n is a, c, g, or t
  misc_feature (2452416)..(2455423): n is a, c, g, or t
  misc_feature (2461739)..(2461937): n is a, c, g, or t
  misc_feature (2466912)..(2466921): n is a, c, g, or t
  misc_feature (2473868)..(2473868): n is a, c, g, or t
  misc_feature (2476490)..(2476490): n is a, c, g, or t
  misc_feature (2486351)..(2489785): n is a, c, g, or t
  misc_feature (2490307)..(2490316): n is a, c, g, or t
  misc_feature (2494031)..(2494157): n is a, c, g, or t
  misc_feature (2496343)..(2497092): n is a, c, g, or t
  misc_feature (2504781)..(2504819): n is a, c, g, or t
  misc_feature (2513626)..(2513666): n is a, c, g, or t
  misc_feature (2514241)..(2514535): n is a, c, g, or t
  misc_feature (2515079)..(2515133): n is a, c, g, or t

SEQ ID NO: 42 - protein, 991 aa, G. tomentella
MSGVEVVAPLVGEVGALGVGELHTKIASKIASSRNLDDNYKILLKDMEMLLAIKKDKEREVQRNNHTDTTNAYKLWTNRVSDAAEEVQKLKVKYEEKMLPWWRIHRRSRLSEEMEKKCNCVRELMKVECLRDFLVDKPPEPVLKELNVPQISGYPTLQGALENTLALLRNNKIKVIGVCGTKGVGKTTIMRNLNNNEEVAKLFEIVIFVKATTDDRKLQEKIANRLMLDIGTNKEHSDDVARRIHKELEKKKYLLILDEVEDAINLEQLGIPSGINGSKVVIATRFPLVYKLNRVQRVIKVMELTPEEAWKMFRDTVHAFNPKIDSLDIQPIAKLVCKRCSRLPLLIYNIANSFKLKESASSWSVGLEDLKPWPELQNQGLEELYSCLKFCYDELKDKKKQKCFLYTSLYPVDSKVYTDYLVECWAAQGLLGDINDKRSYRSARNCGIDILEHLANVSLLEKGESMIYVNMNHCMRQLALHISSKDPECSFYLQDGEESENLSNSKAWQQSRWVSMRQLLDLPTRQDCSMILTLLLRKNPKLTTIPQTFFENMSSLLLLDLYGSMITQLPSSLSKLTGLRGLFLNSCELLESLSSEIGSLQFLEVLDLRDTKVTFIPLQIGCLTNLRCLRIPFVASEDNAQNVHVISKLHRLEELTIQVISYEQWCNDAENVLQHVASLENVTHLQCCFPSSIILGKFLSRSKSWSCKQQNSFRFFVGCQNSRRPQILESFEYKITNYLRYCNGGQKDDSAIIEVLPITDAFELVCHKDIKKLSNFAGIVCLERIRGLLIKKCNKVLTIVSADTSGNTMNGVQIETRVILPNLEQLYLENLLNLKCVFRGPLHSGTFTKLHTLSLKNCPSLSEIFSNGAIQHFSELQNLKLEDCSKIEVLISKDIERERDVLPKLEMLLLVNLPNFNTICSTHTLAWSSLELLRIHNCPKLKTLPLDSDNAVNLKSIKGQQEWWDELEWTNNDEVYQRLQPIFAASVEYFS

SEQ ID NO: 43 - protein, 991 aa, G. tomentella; identical to SEQ ID NO: 42

SEQ ID NO: 44 - protein, 992 aa, G. tomentella
MSGLEVVAPLVGEVGAHGVGELHTTIASKIASSRNLDDNYNILLKEMEMLLAIKKDKEREVQRNNHKDTTNAYKLWTNRVSDAAEEVQKLKAKYEEKMLPWWRIQRRSHLSEEMEKKCNCVRELKKDECLRDFLVDKPPEPVLKELNVPQISGYPTLQGALENMLGLLKNNKIKVVGVCGTKGVGKTTIMQNLNNNEEVAKLFEIVIFVKATADDHKLQEKIVNRLMLDIETDKEHSDDVARRIHRELEKKKYLLILDEVEDAINLEQLGIPSDVNNGSKVVIATRLPRVYKLNKVQRVIKVMELSPEEAWKMFRDTVHAFNPNIDSLDIQPIAKLVCKRCSRLPLLIYNIANSFKLKESASSWSVGLEDLKPWPELENQGLEELYSCLKFCYDELKDKKKQKCFLYTSLYPANSKVYTDYLVECWAAQGLLGDINDKRSYQSARNCGIDILEHLANVSLLEKGESMIYVNMNHCMRQLALHISSKDPECSFYLQDGGESENLSNSRAWQKARWVSMRQLLDFPTSQDCSMILTLLLRKNPKLTTIPRTFFENMSSLLLLDLYNSMITQLPSSLSKLTCLRSLFLNNCELLESLSSEIGSLQFLEVLDIRDTKVTFIPLQIGCLTNLRCLRIPFIASEDNEAQNVHVISKLHRLEELTIQVISYEQWCNDAEFVLQHVASLENVAHLICCFPSSIILGEFLSRSKSWSCKQLNSFRFFVGCQNTRRPQILESFEYKITNYMRYCNGGQKDDSSIIEVLPKTDAFELVCHKDIKKLTNFAGIVCLERIRGLLITRCNKVLTIVSADTSSNTMNGIQIEKRVILPNLEQLYLENLLNLRCVFRGPLHSGTFSKLQILSLNNCPSLSDIFSNGAIQHFSELQNLKLEDCSKIEVLIGENIERERDVLPKLEILLLVNLPNFKTICSTHTLAWSSLELLRIHNCPNLKTLPLDSENAVNLKSIKGQQEWWDVLEWTNNEVYQRLQSIFAASNEYFS

SEQ ID NO: 45 - protein, 992 aa, G. tomentella; identical to SEQ ID NO: 44

SEQ ID NO: 46 - protein, 992 aa, G. tomentella
MSGLEVVAPLVGEVGAHGVGELHTTIASKIASSRNLDDNYNILLKEMEMLLAIKKDKEREVQRNNHKDTTNAYKLWTNRVSDAAEEVQKLKVKYEERMLPWWRIQRRSHLSEEMEKKCNCVRELKKDECLRDFLVDKPPEPVLKELNVPQISGYPTLQGALENMLGLLKNNKIKVVGVCGTKGVGKTTIMQNLNNNEEVAKLFEIVIFVKATADDHKLQEKIVNRLMLDIETDKEHSDDVARRIHKELEKKKYLLILDEVEDAINLEQLGIPSDVNNGSKVVIATRLPRVYKLNKVQRVIKVMELSPEEAWKMFRDTVHAFNPNIDSLDIQPIAKLVCKRCSRLPLLIYNIANSFKLKESASSWLVGLEDLKPWPELQNQGLEELYSCLKFCYDELKDKKKQKCFLYTSLYPANSKVYTDYLVECWAAQGLLGDINDKRSYQSARNCGIDILEHLANVSLLEKGESMIYVNMNHCMRQLALHISSKDPECSFYLQDGGESENLSNSRAWQKARWVSMRQLLDFPTSQDCSMILTLLLRKNPKLTTIPRTFFENMSSLLLLDLYNSMITQLPSSLSKLTCLRGLFLNSCELLESLSSEIGSLQFLEVLDIRDTKVTFIPLQIGCLTNLRCLRIPFIASEDNEAQNVHVISKLHRLEELTIQVISYEQWCDDAEIVLQHVASLENVTHLRCCFPSSIILGEFLSRSKSWSCKQLNSFRFFVGCQNTRRPQILESFEYKITNYLRYCNGGQKDDSAIIEVLPKTDAFELVCHKDIKKLTNFAGIVCLERIRGLLITRCNKVLTIVSADTSSNTMNGIQIETRVILPNLEQLYLENLLNLRCVFRGPLHSGTFSKLQTLSLKNCPSLSDIFSNGAIQHFSELQNLKLEDCSKIEVLIGENIERERDVLPKLEILLLVNLPSFKTICSTHALAWSSLELLRIHNCPNLKTLPLDSDNAVNLKSIKGQQEWWDELKWTNNEVYQRLQPIFAASNEYFS

SEQ ID NO: 47 - protein, 1686 aa, G. tomentella
MASISSVQSSSSAYDVFLSFHGEDTRNNNNNSTGFLFQALRRKGIVAFKGHTLPEKGEPELLHAIEGSRLFIVVLSKNYASSTRCLRELAHIFNCIETSPRRLLPIFYDVDPSDVREQTGWYEEAFWKHEQRFLVDKERMEEVRTWRKALTRVANLPGWYIPNKPQYTEIEEFVQYIITILGPNISTLQNEAEGTSSDKDEVLYNELSGLMRIRDFISLVLTYPGKLEDENILRSWISAFPEWKAQLLSTGDDTVMDKPWCVLTDKALGPMKGFMPMEIISKVESGERSIFSHNDVDAIPEAILQQSVDLAVNQLLQTLFSGDYCARYIRLLTRNLAEKGSVVDTIVSAVEDKHTMFGIDKDFLRALWINASTYETDAEVRVQEQIDINMMMEVDDMGSNGQLVIVVDADSNNKLDLQKLRFPTGIVVLITTEPSTQAEKDVDFRIACTMDLNIWTQDHLLPWKVFCSYVGSCISSSMVSSSMAIQKIAEEIVKECHGHLLAIVLVAKYLTYVQDFKQWELALDKLSSLNPSYDYQDSDRIGISRVMVNAFVNIIWEDIDDAQKLCLELSLPVHNIKNGVRDDILVSDWAKIISGYTQELGEYRRQLQHYINELQDRFVLLKYESGDVYLPVETYDIIKSLHTSKPSILRHGALGLTEPPYIGRWHSLVQIELMDNKICELPQSPDCPKLKVLLLQGNVDLMDIPDSFFNHMPLLQHLDLSYTSIRDLPPSVSKLIQLQKFYLRGCDLFMELPHQIGQLKNLKELDLDGTLITHLPIEIRELINLQSLSLCFDGTSRSTIIPPGLVSNLTQLNYLSINVDPEDERWNENVISVLREIFFGLWNLQRLSIYVPKADLLEFIPTQKSLNFRLVVGQHMRRLISRVPPELETKFKHCDYSIKFVNGVNVPNGVKMHLGRFKALYLDRHMTIKSLSDFDLRNLWGLEVCILAECNEMETIVSGSNSPDRPASLMLKFLSVFYMKNLRSVCEGSSPFFLCLKSIALHTCPMLTTIFTLDSLKKLSFLEEIIIEDCPKVTTLISHATPEQKPVFFLPKLRMISLLYLPELVNIFNGIHVGPFIEEMIFYYCPSLQSLSKSELSSKSLKIIKGESIWWEALKWNVAEWGDAGRPNYFDRIFSPINEEADMMNQLAALQETRLNEHHNTTYQGISSSTHSIAKSSLEIPVLSPLAPVSSVGRGSSNSEAQKRKVVTEPKILQDASKKIIKQVREQRTVQTEVWTEPEVWTEKISVNAEGYLNDGYSWRKYGQKSPLGAKFPRGYYKCAYGSVQGCPARKQGISSSTQSIAKSSLEIPVLSPSAPVSSVGRGSSNIEAQKRKVVTEPKIFQDASEKKGILGLGLKLSVPVSDQSNFAKFLDGVRIVSQNDVEAPPQIKPTDNQLTLADIDVIKVVGEGNGGVVQLVQHKWTRQFFVLKVIQMNIEESMRKQIAQELKITQQAQCPYVVVCYQSFYENGVISILLEYMDGGSLADLLKKVKTIPEDYLAAICKQVLKGLVYLHHEKHIIHRDLKPSNLLINHIGEVKITDFGVSTIMESTSGQANTFIGTYNYMSPERIIGSQRGYNYKSDIWSLGLILLECALGRFPYAPPDQSETWESIFELMETIVDKPPPSPPSEQFSTEFCSFISACLQKDPKDRLSAQELMAHPFVNMYDDLEVDLSAYFSNAGSPLATL

SEQ ID NO: 48 - protein, 992 aa, G. tomentella
MSGLEVVAPLVGEVGAHGVGELHTTIASKIASSRNLDDNYNILLKEMEMLLAIKKDKEREVQRNNHRDTTNAYKLWTNRVSDAAEEVQKLKAKYEEKMLPWWRIQRRSHLSEEMEKKCNCVRELKKDECLRDFLVDKPPEPVLKELNVPQISGYPTLQGALENMLGLLKNNKIKVVGVCGTKGVGKTTIMQNLNNNEEVAKLFEIVIFVKATADDHKLQEKIVDRLMLDIETDKEHSDDVARRIHKELEKKKYLLILDEVEDAINLEQLGIPSDVNNGSKVVIATRLPRVYKLNKVQRVIKVMELSPEEAWKMFRDTVHTFNPNIDSLDIQPIAKLVCKRCSRLPLLIYNIANSFKLKESASSWSVGLEDLKPWPELENQGLEELYSCLKFCYDELKDKKKQKCFLYTSLYPANSKVYTDYLVECWAAQGLLGDINDKRSYQSARNCGIDILEHLANVSLLEKGESMIYVNMNHCMRQLALHISSKDPECSFYLQDGGESENLSNSRAWQKARWVSMRQLLDFPTSQDCSMILTLLLRKNPKLTTIPRTFFENMSSLLLLDLYNSMITQLPSSLSKLTCLRSLFLNNCELLESLSSEIGSLQFLEVLDIRDTKVTFIPLQIGCLTNLRCLRIPFIASEDNEAQNVHVISKLHRLEELTIQVISYEQWCDDAEFVLQHVASLENVAHLICCFPSSIILGEFLSRSKSWSCKQLNSFKFFVGCQNTRRPQILESFEYKITNYLRYCNGGQKDDLAIIEVLPKTDAFELVCHKDIKKLTNFAGIVCLERIRGLLITRCNKVLTIVSADTSSNTMNGIQIETRVILPNLEQLYLENLLNLRRVFRGPLHSGTFSKLQILSLNNCPSLSDIFSNGAIQHFSELQNLKLEDCSKIEVLIGENIERERDVLPKLEILLLVNLPNFKTICSTHTLAWSSLELLRIHNCPNLKTLPLDSENAVNLKSIKGQQEWWDVLEWTNNEVYQRLQSIFAASNEYFS

SEQ ID NO: 49 - protein, 921 aa, G. tomentella
MIKCVTKGCAPLVGEVGAHGVGELHTTIASKIASSRNLDDNYNILLKEMEMLLAIKKDKEREVQRNNHKDTTNAYKLWTNRVSDAAEEVQKLKAKYEEKMLPWWRIQRRSHLSEEMEKSATDECLRDFLVDKPPEPVLKELNVPQISGYPTLQGALENMLGLLKNNKIKVVGVCGTKGVGKTTIMQNLNNNEEVAKLFEIVIFVKATADDHKLQEKIVDRLILDIETDKEHSDDVARRIHKELEKKKYLLILDEVEDAINLEQLGIPSDVNNGSKVVIATRLPRVYKLNKVQRVIKVMELSPEEAWKMFRDTVHAFILILIPLTFNLSPNLYAKESASSWSVGLEDLKPWPELENQGLEELYSCLKFCYDELKDKKSRNCWAAQGLLGDINDKRSYQSARNCGIDILEHLANVSLLEKGESMIYVNMNHCMRQLALHISSKDPECSFYLQDGGESENLSNSRAWQKARWHDFDIVAEKKSKTNYNTTNFFENMSSLLLLDLYNSMITQLPSSLSKLTCLRSLFLNNCELLESLSSEIGSLQFLEVLDIRDTKVTFIPLQIGCLINLRCLRIPFIASEDNEAQNVHVISKLHRLEELTIQVISYEQWCMMLNCLQHVASLENVAHLICCFPSSIILGEFLSRNFCGMPKHKAPQILESFEYKITNYLRYCNGGQKDDSAIIEVLPKTDAFELVCHQDIKKLTNFAGIVCLERIRGLLITRCNKVLSIVSADTSSNTMNGIQIETRVILPNLEQLYLENLLNLRCVFRGPLHSGTFSKLQILSLKNCPSLSDIFSNGAIQHFSELQNLKLEDCSKIEVLIGENIERERDVLPKLEILLLVNLPNFKTICSTHTLAWSSLELLRIHNCPNLKTLPLDSDNAVNLKSIKGQQEWWDELEWTNNEGISDCNPSLLPLMIGRLDGSL

SEQ ID NO: 50 - protein, 1317 aa, G. tomentella
MATAFLPLDPILQLPHSVRSPTPAIEKYLSFFTNKFTSTFAIPMASISSVQSSSSAYDVFLSFHGDDTRNNYTNFTGFLFQALRRKGIVAFKGHTLLEKGEPELLHAIQGSRLFIVVLSKNYASSTWCLRELAHIFNCIETSPRRLLPIFYDVDPSDVRKQTGWYEKAFSKHEERFLVDKERIEEMLTWRKALTRVANLSGWYIPIKPQYTEIEEFVQYIITLLGPKFSTLQNEAEGTSSDKDEVLYNDELSDLMRIRDFISLVLTYPVKLEDEYILRSWISAFPEWKAQLLSTGDDTVMDKPWCVLTEKALGSMKGFMPMEIISKVESGERSIISHNDVDAIPEAILQQSVDLAVNQLLQTLFSGDYCARYIRLLTRNLAEKGSVVDTIASAVEDKHTMFGIDKDFLRALWINASTYETDAEVRVQEEIDVNMMMEVDDMGSNGQLVIVVDADSNNKLDLQKLRFPTGIVVLITTEPSTQAEKDVDFRIACTMDLNIWTQDHLLPWKLCGSCISSSMVRSSMAIQKIAVEIVKECHGHLLAIVLVAKYLTYVQDFKQWELALDKLSSLNPSYDYQDSDRIGISRVMVNAFVNIIWEDIGDAQKLCLELSLPVHNIKNGVRDDILVSDWAKTILGYTQELGEYRRQLQHYINELQDRFVLLKYESGDVYLPVETYDIIQSLHTSKPSILRHGALGLTEPPYIGRWHSLIQIELMDNKICELPQSPDCPKLKVLLLQGNVDLMDIPDSFFNHMPLLQHLDLSYTSIRDLPPSVSKLIQLQKFYLRGCDLFMELPHQIGQLKNLKELDLDGTLITHLPIEIRELINLQSLSLCFDGTSKSTIIPPGLISNLTQLKYLSINVDPEDERWNVNVISVLAEICYGLCNLQRLSIYVPEADFLKVIPAQKSLSFRLVVGQHMRRLISRVPPELETKFKHCDYSIKFVNGVNVPNGVKMHLGRSKALYLDRHMTIKSLSDFDLRNLWELEVCILAECNEMETIVSGSNSPDRPASLMLKFLSVFYMKNLRSVCEGSSPFFLCLKSIALHTCPMLTTIFTLDSVKNLSFLEEIIVEDCPKVTTLISHATPEQYPVFFLPKLRMISLLYLPELVNIFNGMHVGPFIEEMIFYYCPKLQSLSKSELSSKSLKIIKGESIWWEELKWNVAEWGDAGRPNYFERIFSPINEEADMMNQLAALQETQLNEYHNTTYQGISSSTHSIAKSSLEIPVLSPLAPVSSVGRFSSNSEAQKRKVVTEPKILQDASKKVRKLRTVQTEVWREKISVNAEGCFDDGRSWRKYGQKISLELSFQEDITNAHMDLYKGA

SEQ ID NO: 51 - DNA, 33 bp, Artificial
  Forward primer
ggattatgtttatattcgagtacatgctattgc

SEQ ID NO: 52 - DNA, 35 bp, Artificial
  Reverse primer
gggattcaaaggcatcttagattagtcaaacatcc
